United States Patent 7,868,149 (PLANT GENOME SEQUENCE AND USES THEREOF) - sequence listing, part 106

SEQ ID NO: 57234 - DNA, 823 bp, Oryza sativa
ccgttccacttccagtgtttctataaaattgagatctatttgatggcactattaattagtctaaacaggatctttcttttggtcttttgtttaggttttcgattgtttgcgtatagttgcggttaccggattttcgtcgatcgcgggttttctcgaagattcgtgaagcttcgtgaagaccttgagcaaggcaagtcaccctttgaccaattgctcctataattggaaaatcattattattttgtttgcaactggcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctaagcgcatataccaaatatcccacatacaccgttgtttgtcgaaaacttgggaaatgggtttgtgaagccttcaaaacccgatatgtggtgtcgatgtgtttgaaaataaaatgaattatgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtagctagtcgattcagggaaacctcgcatgccaatagttgggaacgccggggcggggtcggttggagccaaaccgggttcctggtattgcaagaacgagaagcttgctgaattaccgatcgaggtggttggagtttgaattgtgaacgcctataatggcctatgc

SEQ ID NO: 57235 - DNA, 20622 bp, Oryza sativa
tagtttatatataaaatagtatatcttgtcaaatacaaagtacattgataatataaagcaattgtctaacttgacagctattaagacatattgggcatcctatttcaaagggtaggtagtggattacgtaaataaatggttaaagttaaacacgtcctgcaaccaaataataaattgggtttttctcctagtgttattgtagtccgatagaacacaagtagttaactcaactcggttttagaccaaggtttagatctgacaaacacaacttaaaatgtgagagtggaacaattgttcaccccgtatatttataatagcaaagaccatttgcaaatacccctaaaaaaagagctgcccaaggttcggcataggcttttccccaaataagtcacgcatattaccaagattgggacttaaatctctcaaagtgaaggtcagaaaggatttcaagagggtaacagcatgcagaacaagaacatgggtattttatagagtagagctggcgaacaagagactctgcatatgttcttctcccatgcatattgcaacagaaagtctcaaatccaccaagtatgaaatgaatatcagaaaaagaatacacaagggcaacagaaaagaattgcaagttagcgctagaccgcttcttattcatatcagtaaattactagaaatcgattgcaactccaatcaaccacagatgaagaatagcataaacgaattaaaaagggcagttgcatacaccgtccgtccccaaaaaagaaaaattacttctggctatgtatctagacatagcctaaataggtaggcaaaagttttttttttttggaacggagggagtagatcaagaacaaaaatcccccttttgcacgcatgggaaatagaataaggatacatgaaagaaagggggaaaatcaataggcgtaacaaatgttaaactactgataataaactatgggtaaacaaaagaccaaactttatggctattacagattactttcatctcaaacccactaaatctcaaaagctggaatcattcttgcaagttagaaggaaaagagttcagccagctgtttgggacaggagaagggaagaaagaaggcggtttcgtgagatttcgtccagcgtgcaatgtgttactctcgagattccatgagatttcttccatagttcaatgttttaggttagaagcacaagaaaagctaacatacaagccttttcaccaacagccatcacatatggacatttcactcccgaaatctcaaaatgtgttactaatatacctagcaacccaagtaaccttgtgagagaatgggaatacccacaagcaagccaaaggtttctaaagagtctacagaaatgaaagaaatatgctctaccaagccaaagcatgttgacacaggttgtatcatttgtccaaatcttactattaagataagtccattctcatcctatccctttcctctattggcccagctaatcccttctctccttgcaactcttggttctttttctagactcgataaaccatagccatcattgacaacaaaatatatgatgcagccccataatcaaaagccttgtcctgttgtccatctataatgctacaatttgatgcataatcaggtctaccacattcacacacatacatggacagagataagtaccaaaagccatcaaatttgtataaagtgaattatccttctttcctcatcgaacttagacttttggattgaactggtcggtgcatgtaactcaatatggtatcaaagaagaggccttgagttcaaatcctgactggcatgcaattaaataaaaaaatacagcccacttctaaatattccacgctagagacttgaggttgtctcgtgtgaaggggagtattggaatacaaagtgaattatccatcttttctcatcatttagtttttgagttgaactggtcggtgcatgcaactcattacatcaaatctaaatgagttcatccatgaacaacataatctgagattaggagtatacctcagttttgggaggcgttggggaggggaaatcgatgtcgatgcaaacttgtgcgccgaatctagctgtcctatcctcgccgccacctactcgctgcgtgagccaacctgtgctcgtttgtcgaccggccgccgcctccctgctcgccgcacccgtcaatcgcttgccgcctacctgctcgccccttgtgctagcctgtgctcgctcttctgccggccgtcgaccccctgctcgcccttgcgtcggcctgagttcgctctggcttccgccccctgctcgctgcaaccgtcaaccgaacggcgtgattttttaatattttctaaaccttttgaatatataatattttaataatagatcctattagattttattgtcacatctgaatttggaccacgtcgagaatacttgcgttaccaaataaccgtaccacatcacatgcataggcatggcagaacacgccacagccacgtggaagagtgtgataccaaaatgccctacctcatcggcttcgttgccatcggctagtgggatgccgtggcacgggggcggccactggacgctgatgtggtgtgggcttgagcggtgctagaagctcctgatcgtcaggtgatgcaacaatcttgcaatgcttccacccatgcagcaccaccgccccgcagcgccaccgcctcctcctctgccttcaaccgcaccagcatcaccgcccccttctatcccttcccttccctcacccccttctcgtccagcttcctcttcacagaccgccggcacatcacgaccgcgcacatcatcaagcaacacgagcacgagctaccctctgccatcgccattgtcacgcccgaaaattcacaagtaatttccgaactaatttgtgcattaaaccctcgtccagaaatcagccaaagtacacaaactgacaatttaaaatgcagattcatcataataactaaagcgcttaaatacttacataagagacacttagtcatcaccacgaagaaaactgcagcggaaaaacttacataagagacacttagtcctcaccacgaagaaaactgcagcggaaaagaaaatctagcaaagcttcagctccactcccacaggtagctcaattgggatataagccaaagatcttctccttatggatcctttttctccaactgagatttgatgattattgcaaggcgattatatggaataatccgcaagccacacaacaagtatgcaagtgcacagggataacataggatggcataatgttgggttcatttgcgaaagcagcatatggcaaagagttgtgaatttgtaaaatagtagagtaattaattaaacagtattaatgcaacactatacaacatactcgttgcataggcccaaccatatctgtacaaccatgcccggttgaacagacccaatcttcaaccaggaattaaccatttcaaaccaggagctaaaccaaagtatcatcatttatcacaaaaaaattgctatgctcgtccatgaccgcgggcacggctattcgaatagttttacacaacaagtatgtaagtgcacagggataacataggatggcataatgttgggttcatttgcgaaaacagcatatggcaaagagttgtgaatttgtaaaattgtagagtaattaattaaacagtattaatgcaacactatacaacatactcgttgcataggcccaaccatatctgtacaaccatgcccggttgaacagacccaatcttcaaaccaggaattaaccattccaaaccaggagctaaaccaaagtatcatcatttatcacaaaaaaattgctatgctcgtccatgaccgcgggcacggctattcgaatattttaatatggccagaggtgtaccactgtacccacaagacacaaccccataacatgttaacatgccctcagtaccaccatggtacctcgaaacgggactatgacaaggcacctcgcataaagcaattcaaagcaatgcaccattcccagatcatagtcaccccctttagagcaaggtatagactccccagcgacccccatgggattatctccgccacttctcagtctagcactccacaatgaaccatgctatacatcgcatccagttgctgcccatgctggcttatggttagtacggttaatgcttcacaacagtagctcgccaaccggttcttaattatcatgagtacgaccttcaaaaccatgtactcataacccaccattatcaggttttagttggcaaattaattaattaaccaatcacgattaaccattatgagctatcactaaatattcatcattaagtaatagtgaaacattagttatgccaatactatgctaatgtttctaaacatggctaagcaattatatcaaatatctaatataacgcccaagctagtcaaataataacccatagaataataaagtcatcttcggccataatataaggaaaaggctcacaacagctaatgacatttgaaaataaatgtatatttgaatgaaatagagaatttaaacataggttcaacatgctcagaggaattatgtttgggatctgtatgacttgccttgcaatcaaacatcttcaatccatcttcaggagcttatccaacgaacgaacggtcctccaaaacgacagaaaactaaacctggaacacaaaatgaggaaaaacactaataaaaaccaaataaacaatacaattaaagttcataaatgggtagagattgaatttatatgaattacgagacttgaacgacctcattccaagtttgtatgaattagttatgaattaatgaagttttaattgattaaaacctataaagaaaacaacctaaatgatttattgcatcatatttaattattttataactgaaaaggaggaatatgacatcagcactaggatagaagagtgaaaggactggggacgagtgggacccacttgtcatagagacaagcggtagaccgggtctaccatgacccaactccacaaaggtggtccacgggtccacgggatggacggctcagatcgagttgaccaagatccaacggacgagattagttctggtctaggttttgaggtggatgccatgcggatagaggtgtgacatacaataaggccatggcctacgctccagcgtggagcgtggtctcaccccgcccgaggggaatattcccgccagctcagacgggaccacacctcagcagaggtgcgcgaccccagcagaggtttgcgtggatttgtcagagtggggcgaggaacgggcgaggagccatgttgagaggcctcgtcccgtaacgtcaccccggacgctgcggacaactacctctcgcgccaaggacgaagatggcgccgccgcggcccaatctgccaccgacgcctccatccgtcgccgttgccactcgatccggcgccgctgcatcgatccgcccccgccgccgcttgatacgccgttgccgcctccatccgacaccgccgccgccggggaggagagcgccggggaagggagaggtggagagaaaggaggcacagagagatatggtgatgagaggaggggtcggtgtttatatatgtttgtgatttttagggggtatactgcaaatattggacttatatgcgaataaaactaatctaagggtttaatgcaaaatgtgaccgacagataggtattgaattgcaaaaataagatggaggcatggcttacactatgaggcatatccctagccgggtctttattcacttttgctcacgtggatgttgggggtgctccctgcgttggcgatggcctaaggtgtcagctgacgtggacgcacgcgggatagacgtcgacggcatggtacgacaaccacgacggcaaacggcggcggaaaccgagagcacggggaggaagaggagaccgaggccatccttaccagtacttacaagacgacagacggtgaacggagacggccggctgcgagctcgggtcggcggctttctggcgacgacgggcggcggcaacggaggggtagacgggcttctcctcggcgctggcgatgccgaggatggcgatggggggaacaacggtgggtcacggctggaggtcgatgggaggcagaggcgctcgggttcgcatcagcgagcagcttcctgcggtcttcggtacaagcgaaccggcggccgaggtagccctcgcccttgtggagccgaaggaggcaacggcgcaaggcggcgtcgaccagagaggcggcgcgacgcggccggagttggcggcggtggcggacagagaggaaactcgcgggaagaggtggctaggccacggcggctcggggacaggaggggaaaccgaagaggagacccgggcatcatttatataggcggaggaggaagagatccatgcggatttggggtttcggcggtgggaaataagggttcccgagttcatcgggataagaatggggccgaaatccagcgcgaatttgttgggggctttcttgtggcgaacgtagaggtgatcgagggaattccgtttccgcggagcaacgacgaggccgaatttggtggaggtggcggcgttgatgtgcacgggcacggccgcacgggagaggcggctgggggaggaagacggcagtcacggcactgtagccgggtgggccctaggcgtcaggagaatgaaggaagagggacgcacagaggacttcggacgagaaagacgggcgcgggctgcgggctgaggaaggagagaggagattagtgggatggattcgttccaaaactcagggaaggaattttagttgattttctatttcaagtaattactgacatgttatttcatttattaaaaatacttaccatactcaaataattccaaaaaaatcctgaaaatacttaggatactcaaagtatttaataaatttttatctagctcaatttaatgttcgaattttttatagattttattcaaacacttactttcattattaaataatttctgaaattttctttttcaccacaatttataatttagctattgttagggtgtgacagctgtcactgctgctccagccagtgggttgtggtcctcgtccatggccgctcctagcgcgtttggggcatttttgttccatcaccattagagatggcaatggggacccgatcactgattccctacggtgaattcacatattaggggatggttaatatctattctccatggggaatcaaatggtcccaaactaatcaccatcggtgaggacggtgaaccattcgccgtccccgcctcccgcggtgacacttcttcagacgtttcgacccataatattgaagcccaattaacatgtatatgtacatctaaccctaatcaactagtcaacctccacatcttccagatccacacttccacaaactccacaccaggcgcgcgcgcgccgccacctcctattgcgcgggctctgtctagccccagctgtcgacgcgggcgcacgtctgcagccgtcgcatcgcccgaagccgctgctcgaagccgtcgccgccgtcgccccgcccggagcccgctgtcatcgtcgcgctgttcgtctgccatccgtcaccagcgccctctgtcccagtcgtcgacgcaggcgcgcgcttgtagccgtcatgccgctcgaagctaccgccatcgcaccgctcgaagccgccgcccggagcccgccgtcgtcgtcgcgctgtccatccgccatcctccaccagcgccctccgtcgctagcacaccgtccgtcgccaacgcccttcgtcgccagtatgctgtccgctgccaccgtttctctgccggctgctgagtgctgactaccgcaggacgggggtaaccgtgggggaaattcaccgcgtggggatcgaggctggagaaaatgtagccccgttatggttgacgggggcgaggacggtgaaattttatcaccgtggggacggggacgcggatgtgacccccgacggtgaattcaccgttgccatctctaatcaccatgtagaattgcgaaaaataatttaaaaatcaatggaaccaaaaaataattactgttttgatactgttcatgggttgattccgcacaatggaaccgcgtgactaccgcgtgaacagtattaaatcgctggctgcgggaccgttgcagtgccatgcgaccatcccgtgggccgttggtcccgcgttttggagctacgagatcatcgcggtcatgcgttttcaccccgcaggatgggtttatttatacaaatccttcccatgcaggtatataaacgtaaattacagaaaaaaataagtatattttgcaattttttattacagaaaaaaaataagtatattttgcaattttttttcttggtcttctttttttttgtgaactaggagagcaggagctcccccatttccattaagaggaatgatagaattatagtatccggttctaggcagcagatcaactttcttcgctcaccaggcgcgccatcccaccatggctaagaaagtaagaagagaggctaacaaaaagaataagacatacttgcacaccaggtgctcggtggcactgtggcagtgttcaggttggctacaaagttttaatttctcccacaaggaaaatccccagggttaatcaaagctgcgctaagaaattgctcgactcatttaccaccatggttatcttcctgtcttggagccccaaccatgcctggtgctataaacctcatttaccactcgttttagcagtctgcccccctcctgcagtcttcttgtttcttcctccttgttttgtaaaattgcccaatcaaagatacaatgagctacctgaaagattacatctacgagatcattaggaagaatattctcaaagcaggccattttccaaattgcccataaagcagccgcaataccaacagccactagctttgttataaaaataaatgcacaacagagatataatttttatggggaaaaccctttcgagaaaaaaccacggtaccgaccggtagcgatcactattaaggagttgattacaagcgtagtggatacattggactgtcgcaccctccccatccggcttacaagggatatatatagcaaagatctaggagtactagtggggaaagacttaagagtcatactaggaaactaatcggaaaatgcttacgatcggcatgccgatttggagagaaaaatcgggcgctctcctcttactataatgtgcacgcagataagtgctaggtagtttctcttctttcttctcctcactttaaatgttttttttctcttaaaccatttgtccgatttacgatccgatcacactgttatatttattataattaaatctttacaataagatattgcataattatattctgataaaagaagaatatatgtttcaaaccgttataactcaatgtttcatacgtgatagtgacatgtttcatcatgtgcttttgctatgtttcacaaaattcatttaactacttgcacatactctatctctctccactccttgcatgcatgcatgcatgtatttagctatctttaaaatgatttttctcctgaactacttattcgatctacgatctgatcacaccattctatttattgtaattaaatatttaaaataagatatcacatgattatgttttgatgaaagaaaaacatatgtttcaatctgttcatatttgatatttagtttcaatatgttaatatttgatgtttcatacacgataacaatatgtttcaaggtgtgttttcactgtgtttcacacactttttaaatgttttaatgactgatttttttttcaccatgtataacttaatgtttcacaagcggttaactgaaacatttgaccgtccggttttttgagagaggatcggatgtccgattggaaatttcctcccacttcttcaaatattttttcttctaaactaattatccattctacgatttgattacaccgttgtgttcgtcacaactaaatctttataaccagatgttacttgtttctattttgataaaaaatcaaataatgttgcaacacttaaaataaattgtttcattacttggtcaaatgttctatttctatgtataaaatgttttaaaatgtttcaaggagatacagcattcataatttgttattgcaaccctgacaaccgctccactaaaaatttttctatcatgtaatgaaacatcgatataaatcatatgaaacacaatttttttttacaaatacttgaaaatgttgaaacattattatatcatgtaaggaaacattaacttgtgactactaaaacatcataaaatatttgatgaagcattcgaagaacaccacctgcagcattttaagatcaactagtgaatcatcctaaaatactacctgaaacactcaaatataaccaagtgcaacatataggcctgtttggtacagctccaactcctaaatttagctccaggagttgggtctggagtggagttgtggagctgccctctagttcattttgtaagagagctccacccagctccactcctagttttggtggagttgaaactgtttggctgagctccaactctaggaggtaggggtgaaaacggtacggaaacgtacggaaacaacctttatcgttttcgttttcatatttttttttggaatcggaatcgaaatcggaaaccccaaaaacgaaaacggaaacgaatattattgaaaccgaaaacggaaacgaatattattgaaaccgaaaacggagcgaaaacgaaccgccgcggatacggtaacgaaaattcatcagaatacataaacccctcaaactgagcctcacagcaaaaacatattcttctataacttcatataatttgcataacaaatattctaaaaaaaattatagcaagatactatggtataataatgtatagagtatatatagcctattattcagtgctttcactccataatcagtacatactacatagttctcttctacaaaattaacagaagatatcattcatttacacagtataaccaagctccttagtacaaacaaatcaatcatttacacagtataaccaagcttcttagtacaaacaaatcgatcatttacacagtaacaactaacaaagagtgatagatagagctggaggttgaggaacacctgcttactgttgccgctaggctgctggaggcgttggcgtcggctcggcatcgatggcggtgaggaagccagtggggcttgagatgtcgtcggtgtggtgtggctgtggcctgtggtctcgtcgtcgatgtcgcgtcgtcgtcggtatggccggcgtcggtggtgtggctgtggcgtcgtcgtcgcctcgtcggtggtggtggcagcggcgaaaaggcgagaggcggcgggacggcgccgcgagatggtgggggcgaggacggagcgaagaggaagggcggcgcgagatgcgagacggcgggggcgaggtcgcggggagccaaggaagcgaggacggcaggccggcggtgggtggtggcgcgctctggatgcgccgctccgccgccgcctctggatggcgatgcgccgctcccggcctccctcccgatctgtctgacttctctctctccactctcttctcttgggttagcagcttgggttgggccggctggggacttggggagggattatggactattgattggatgggcctttttaacttcggaaatttcgacaaattttccggaatgtttccgaccgattccgagttccgacgcaaactgcgattatcatatttgattccgtttccgagaaaatatttccgttttcgattccgtttctgagaaattctgaaaattttccgaccggctgattccgtttctgaaaataggtacggaatccggaaaaattccttaccgttttcacccctaccaggaggggtggagctggagctgtgccaaacaggcccaaaatatctattgaaaaaagagctaaatattttttttccgttggaatataatcatgtctgatcttgttgtaaagatttaattacaacgaatataacagtgaaatcgaattataaattgaagaagtaatttaggtgaaaaaaatagtttcaaatttgctaaaaagacttaaaacaacctaactaaccctacagaaatctcatgcatgctcctacaacactgctatgtgaagggtcaacgtgagagaaaggggtctgaccaatttacatgtaaaggagtggagtggagtgtgcgtgtgttgaggagcgcacgattttttagccagttatcgggcgcccgatccgtagtcgtatcaaactaatcctaatagttaagttagtattagaaagacttatccaaatacattgcagatctaaaattcgaatcacatatttaacaagctttattgtcttttgggtaaatttcttcatccaaggtcccattaaattctgcatcccatttggcatttcacaatcaaacacacattttactgtactccaaacgaatttggcaatattttcaatcttattagatatcggaattgctgtcatgtacagattatttcagccaggcgcccaagctagctattggtctccatgtgttctgcgacgacgatggctgcattttccccgaaaatatgttcagactgaagagagagacgaagaaaaaagagaacttggttgaaataaacggaagattgctacgttctcttctttcatgtgccgatgtgcctcaagtgtcggtttccaaatccaatcaaccccttgagtaaagtagtacgtactgtatgaggaattgacgattgatcttaagaacagactcatcgatcatgaaagattggttgggattgccagtgagctgttcagtacagtatgcgtcgatctatgcgactatacaccaacggtatctcgactgtaaaatttgctacagaagcagagttcagtgcctggcaaaatcattatgatgtaacaaggccgaagagcgtgcgaaaaatagagttggaacagctcacgacggccagttcctgtaccagccggcccacgccgagacgagcccactgatccccaacgtgacagcgtggttgcagaacgggttgggctcgatgtccgcgatgccgatgacgaggtcggcgacgttggcggccgtcgccatgagccgcatcaccctgtccatccggatcttcttcacctccttgtccttgtccttcccgccctccctgagcagcttcctctcctgcctgaggcccctcctgatcatgatgaggtccatggcgatgaagaacacgtagccgacggactcgccgaaggcggagatgaagctcatgcgtcgcgcgagccaggcgtcgaggacgccgacgcgggagagccacgtgaagtggtcgaagaagaagtagaccatctcgccggcgttggcgagcacggcgagcgcgccgaactcccccggcgcgcggcgcagcccgttgagccccgtgaggaagcggcccgtgcggaaggccttgcggctgagccccgcggacgtctcccagttcttggcgcgcccggcgaggcccgggctggacgactccgccgcccagtgcgcgagcttggacacgtactggaacgtcttgaccagcttgtcgatgccatcgcgcttcgcgaggaagaccacgagcttgtcgagcgtgtcgccggcgctcatggctgcggctgcggtggcttggaaggctcagtgggagagcgcgcgtgcatgggagggagagagggcgccctctggcttgggaagtgagaagcggacgcggcgtgtgtggtttggtttgggataaagcggccgtggcgggtacttggctgggatgcgtttgtcctctgcgccagaagtgattttctggtggtggtgaggattgagatcgagggctcggtgagagttctacccatctttgtttgcttgcttgattggtcccttgtcttgttattagtcttttttatttttgcaacttgggctctcttatctttatttctccgcacaatgcatccgtaacctatgaattgttggggggaaacactaggcaaaatcatgtcaagtagcaacaccatacaaggctgaaagtgaacaactaggcaaacactctacctccctctttcaaaaaaagagaaaactgaaaaagtagtagtagaagaagaagaaatacacatatttttgaaaaaaagagagagagagagacaaacactattgtacagttcaaggcttcaagcccatagattctctaccaaaaaaggttcaaagcccacaggtgaaattccgtatcccacacggcccatcaaatctcattgttgcttattgggccagttacctctcctccgtcttcccccttagatgaagctgcagtgcaggttcagggggcagccgcgacctgcgtccgggactccggcgctgcgacgacgacacgttcagagactccgggctcccgccggcgagaggccgagggaagtccaatccggttagctctcgctctctcctgcctattcctcgctcatacgcatatgcgtgccttagcggaattggagtagtgcttgaaaccttgtgtttctctttagtacctctggatctgatcaaattggaggcttaggtgtgtgcaaggttttgccgatgtttccaaatgatatctgtattccgcgtgtttgcatacgcggttatattttcagcaggaatcgtccatggaggggcggaaatcaacttgccttcgataagggcaaagcctcgtttgataaaatggacagttaaggatttgcttgtggtaaatatgtttggattttagagaaatatttttttaaccagctgatgatttggctaaggaatttgaactcttgcgcacttctattggtcgtagatttgggtggtcagtattgcttgatgtactaaccggatagtctgttattatggcaattatgttgttatcatccttctgtgatttgtctgacattcagagcgaagcttaattctcaattatgctcactgtatctttggttggccctttaatattttcctagtcttaggctcttagcactaaggatttcaaccgcaatgatcgtttttacctgattgtgcctcacaatgaccatgtctagttcgatgcaaaatacagttttgtacgtttctttttacatctattcatgccatgtactcccttagttttctgtatgttttgaccagctatagtttgggacagaggaagtagttccgtaatatataatatgcaaacttttgctaggtgtagcttgaagttaggatgagtgtgaccacagaaatacataattgcaaagcatttggaaagctgtgttccattatattttttcgggaatacgcaaggagcacatttttgtattaagagaaataaaagttatttacatggaaatacaaaaacagcaggggactgaaaccggaatgaaacacaacattcattagcctaaatcttgcactagttttggcgaccttgatccctccggagaaccagggaggggatagccgagtttgcttgacgccaaagtgtcttctcctccgccattccccttgccacttcaacccaggtcctgcgttgctggttgaacacccggccatttcgttctttccagattctccggaggaaaaaaaacatttagaagattcaaacacacaaacctcagctgattcctgtttcagccaagccagctgtgttccattataaacaagtggcaaagagcagaaaacacacaaatagatgtacatggagttgtgatcttgattcttgaaactcagttgaatgagtatcataaaacacttagtgaagttaactgatccttgagttcctattgtattgtcttctttgttgcgcaactagtctctgtgatgtaactctttcatacatatggtattcatcacttggattgattgatatctttggttcagagctatccgtcaaatggctgtgttatatgggaaaaacaaaactaagccaattgtagatctatatgccgtcttttgtttcgttgttgttaacctgatatcatactggataacattccattgtttctgtctttttcgtgatactgttgagtttttgtttaccaatatgctatgtatagtaccatagttgaggcacttgataactagtttgttttgttccctttgcagtgttgaaggcacagatgtcatcctgtaccatggcctctttaatttgttcacagataaaattaagcaaagcacatattaggaacaggagacagattcatgagaatggacaaatcagattgcctaaatctctttattggaaacctctacactctggccattttgaaaatattgtcttgcgatgcactcaaaatttgtcttgggaggcctcccttccatatgcctctgcagaagatggtgccaacattattaagggaactgaagttgttgaacctattgatacagaagaagcaccagaaattccgatcctccagagtgaccaggattttgtggaggtgataaaagaaccttccatgcagctgacaacttttaaactgccaatttggcttttagggccttcaattctgttggttacgagtatagttccaactttatggctaccattgtcttcagtgtttcttggtcccaacattgccggccttctatccctagtgggacttgacttcatttttaacatgggagcaatgctgtttttccttatggctgatgcttgtgggcgtccggaggccaattcatccgaactgataaagcagatcccaacttcttacaggttctggaatctggctgccagcatagtaggctttcttgttcctttggccctgtttttcgcatctcataagggtactctgcagccacatataccattcattccgtttgcagtgctgcttggaccatatctcttgctcctttctgtacaagttttgactgagatgcttacttggcactggaaatcgccagtttggttggtggcccctgtggtttatgagggttaccgagttctacagctgatgaggggtcttcagttagccgatgagatcactgcgcctggatggatggtgcaaagtcttcgtggtttggtgtcatggtgggttctggttctaggcatccaactgatgcgcgtggcttggtttgctggactcaaatttgcaagcacttcaaggtacggagcaagtgatgataataagtaaattcggacaagaaaaaaatgttcaggtttacatgttttgctcatgcctctgccatctgcagcacgaaatgctattctgatgctactcctggcaccgtctggggttgctcacaggtgccttcttcatcaactagttcagtagatcgtatagacgaacaattatcagactgtgtgtaatcactcttgtacatacaaagtttttttttataatacagaaatatatgtctttacatttcctcggtgaaggctgaattgcattgcacatatgctattttctgtttcaaactttttttcacaaagcgcctggtggtattcatgtactacttgatactcctagtactacaaaccaagcaaacgtttgacaagcgatgtgtgtcactgtggttgtgtttagatggtggaaaagttgggaagttgagagaaaattgatagtttggagaaaaaattggtaatttatgtgtgtaggaaagttttcgatgtgatgtgatgtgatggaaagttaggaatttgggggaaattaaacactgcttatgttttcaagccaatccgacacggatataacaccaaatcacccaaacacacggatgtaagttaccgtgtctgttcacccacttgatggggagttgaaatcctcgtcccgaaatgtgacgctctgcctgcaatcatcaaatctgaatctgaaatgaagattgaagaacaccccaactgtcagaaagaaaaaaggagccacgtgagcactacttttctttctttgtttttctcaaatctaccattgccttaaccaaacaaacatgtggccttttccagaaaaaggaatgtgtagtgtagttaattactacactaggcttttgctcgtcttccgaatttccgatccacctcgcgcagccgtgctcgtgctcgtctcccccaccaaaagacccacccgaccgggggcgacaccatcacacaccaacccgacattccctcgtgctcttcccatccgcgactccaaaattcccgtccgctcctccaggcaagcaagcacggaaacccactcatcactcactcactcccccaaacccaaaccctagctactactagctccccgctccggatcaagcgcatctcgagttcgagcgagcattcccctcttcggttcgagtgggttggctggcggcagatgggctccgactccaagaagttgctcgggatcgagccgctcgagctccggttctcctgtacggtttcctcgccggaaattccctgcttgtgaaattccggagccacatgccgctggggttttgtttgtttttgctgattcttttgctgtttggattgagcagtcgagacgaagaagcagatctcatgctccatgcagctgacgaacagaacagatgactacatcgcctttaaggtaactggaatctttttcccccacgaagaaattcagcaatttggtttcacggagcatagagcttgggaattctgcaaaaaaaaaaaaagaaaaaaagttaatgagatttgacgcgctaacgctaaatttggtgaaatgttgtgctccttaggtcaagacaactagcccaaagaagtactgcgtcaggccgaacagtggcattgtgccgccacggtccaccagcgatgtcatcggttatgctcaattctcatctccttcatgcaaaacgttgggatattttcctcgtcctgttatctgtgtgcaaaaaattgacagttctctgcatttccttagtaacaatgcaagcccaacgggaggcaccagcagacatgcagtgcaaagacaagtttctagtgcagagcgttgtggtgactgaaggcacaacaaccaaggatgtcactggagagatgtagttcatgttctaatgtctatcagatggttgattcttgattatgttgcttgatgtttgtttctaacttcctagttcctatgatgccaacatgtgtaccttttctagtttaacaaaggatcaggtaatgtggtggatgagaggaagttgaaggttgtctatgtccaaccaccacgaccaccatcccccgtgcgtgagggatctgaagaaggctcgtctcctcgggcttcattatcagaagggggcaacttgaattatcaagatgtgagatgtctgattatgcattgtttcatttccttgtttttctttaattcgtgtggatatgactgattgtttttagacgcagacaactcgggaatctgatgagccaccattgctatctgttagtaccttaacttttatatgcacttccccattctgctcttttcaaagacgagttaaactgagtagtagttatttttccaggctacaagagcacacaaggatgcagaagatgtaacatctgattctgaggtgagtcactccaaataagttttctatgttcacttgtaactttacatagaagtaaaggaaacaacagtacttatgtaaataggtttcagtgatctcttagcaaacattgcatttcaatcttctattgaagtaaatatcaagtgcctttgagacttgactatttcaacaaaaacatggcatggatctgatggtcaacagtaccccaataaaacttgccaatttgttttacagctttaaatataaatgtcttttacagtcaatgattacaattaaaatttcaatgagacctgagcttggtaaagtttgcttggcacctgtaacgtagaaaacaaagtaatactgatacaagcaagatggagtagatgttgttgtgctgattgatacttgtaattgcagtatgtacttctcattgtaatgctggatatttgcacagtggtttgttatatgttaagggatcattggtcaagcccaactacgtataagttcaaaagttcatttcagttgacaccttatttgttgtcaattcgtcattttgttttgaaattggtcctttctactctctgtagcaattatttttgctctacgtgcaaatgcacataaattacctgttacagagtggaacattttttttttcgacattgattatttgttttatggcactaggctttcattacaaagcagttaatgtgttgtccttttcaacatttaacactgttcactcctcagccatattggccagcaaagtatctttcgcttgccttgtactgacacgaataatgcctcattaatttcttttatcctatgtgtagacatctgctttgatttcaagattgacagaagaaagaaactctgctattcagcagaacaataagcttctcgaggagatggttagtagatactgcccttatggaaacattttgtcgcatgctctactctttcattgtataagtaatttattcctactgtgataaaggttgatattttgtttaatttgttattatttatgtaaaaatatataattttctacttcatacttcctttttttaaaaaaatatattatgctctcacctaaatctgtactcctttttgcctctcatcattttggcgatgacaatgttgcatcacaaaaggt

SEQ ID NO: 57236 - DNA, 11512 bp, Oryza sativa
tccatttttacctgatttttccatagcaggcagcatctattatatatattcttttgctgagatacctagcagtatttaagtataacgaaaaaaaaagtattcgtagttgggaatgaaatggctagatacaatctgaatccatatttcttaaattgatgttgataaatttaaagtaaaatctagtgaaaggtggtgcaacatatctacagctctcctgtgtattattttgttggaaactctgaatagatccaagggacaccgacataacgttatagactctacagtcggagcagattgatatcggctttaaacttctttttcttattgtaaaacaataaaagtttagcttaattggatccaagagatgtaccaacatatgcctaaagtccatgcatcttgttagaatggatttaagagatatcattactgattgaataactcctcaatttataccatgtcagagcggattgatattgttttaaagctttccttttcttattgtaaaagaataaaagtttagcttaattggatccaagggatgtactgacataccgttatagagactaaagtctgtgcatcttgtcgaaatgtatttaagagatatcgttactgatcgaataactccttaatttatatcatgtcggagcggattgatatcattgtaaaaaaatgtctccttttattattgtaaaacaataaaagcttagctttattggatcaaaaggatgtatcgacataccgttataaaatctaaagtttacacattttttacgaaatggatataagagataccgttactaatcgaataactcctcaatttatatcacggcggagcggattgatatcattttaaagatttccttttcttattgtaaaacaataaaagttttagcttaactagatccaagggatgtaccaacataccattatagactaaattttgtgcgtcttgttggactgcatttaagagatatcgttactgatcgaataactccccaacttatgtcatgtcggagcgaattgatatagtttttttttaaaaaaaaacctttccttttttattgtgaaacaataaaagtttagctttattggatccaaggaatgtaccgacatactgttatagtctaaaatccgcgcaatttgatggaacggatttaagagacacaattatcgatcgaataactcagtttatgtcatgtcggagtagattgatatcgttttaatgctttccttatttattgtaaaacaataaaagtttagtttatttggacccaagggatataccgacataccattatagactaaagtcggcacatcttgtcgaaatggatttaagagatatcgttactgatcgaataactcctcaatttatatcatgtcggagcggattgatattgttttaaaaaacctttccttttttattgtaaaacaataaaagtttaacattattggatccaagggatgtatcgacatatcgttatagagtttaaagtccacgcattttgacggaatagatttaagagacagttctcgatcgagtaactcctcaatttatatcatgtcagagtggatagatatggtttcaaagctttccttttcttattgtaaaccaataaaagtttacctttatatattttttccaactagctgctgcattttatcaataaatgtaaatttatttgtataatcagctgccagtacatactgggaagtggacaacgaacttaagcacccattccttcgttttaggcggagcaagaatttaaattatggctttagtgccacgctgtactgtagtaggacactaggacagaactactgacagaatcgctctagaaccaaaatgcatggtttggtggcctactgttaattctagctgtagctagccttgcataattcaaccttattgatcgtccatgttttccggtgaattaaacccacatgcaaacgtagtaggttttttatctctctcggttcacaaatttggacccctgaattccgatcctctgtaataagctgagtagtttgtgcaaattacgtgaaagcctgtcgtttccgtggcccacatgaactggcccccatgcttgctgactcagactccgatcacttcgcccggccaatgctccgctataaaaccctccctttttttggcaaggagttcccaccgtgagatcgagatcgcctcctctctccgtttccttttatttcccgattcgctcggcgtctcggcggcgaccttgcgcgagcgcgcgatgcggtgaaaaaaaaatcatcgcccgcgacagagtacatctgtcccttccgcataaggcaacgtcgctataaatactgccagcctcttcgttcgtttccatttttcctcgtccgctcgctctcgttcatgtacaaataggagggcgcatgcaccttgtttgccattagctctcgacgtagcctagagcgcaagcagcagcagcagctagattggttggttgccaatgatcccggccatctccccgatgatggacggcgccgcgcctctgcttcccgagacgagccccgagagccgccagcaacgtgatccggagagggggaagaggcggacgccggtcctcccggccgtcgtcgcgtccgccgtggtccttctcggcctcgcggcgctcttcctggtgtatggatttcacgacggtggagacgggagggcggccgtactcgcgcccggcaccgtggaggtcgcggcctcgtcgtcccgcggcgtcgtggagggcgtctcggagaagtccaccaccccggcgctgcgcctcggcggcggcgcggtccgggactacgcctggaccaactcgatgctgtcctggcagcgcacggcgttccacttccagccccccaacaattggatgaacggtatgtatacacgttgccatcgttcccgtggtttcatctaggccgttggatctgtaatcgcacggctccgattcaccggttatacaatgttttctcgtttctaatcttgttccctttccgtttcttttccacggacgtctcgtgcgcatggccgtgctgctcgtctttttctcggcatctacagatccgaacggtaagttgctggcgctgattgtcaatgcacggcgcaatcttgtacttgtcacgcattgacatcgatgtcgcgagacgtgacactttttttttgcacgcactgaccgggccgtcgatggatcgatctgcaggtccactgtactacaagggatggtaccatctgttctaccaatggaacccggactcggccgtgtgggggaacatcacctggggccatgccgtgtcgcgcgatctcatccactggctgcacctgccgctcgccatggtgcccgaccactggtacgacatcaacggcgtctggaccggctcggcgacgcagctgcccgacggccggatcgtcatgctctacaccggcgccacggaggagtcggtgcaggtgcagaacctggccgagccggccgacccgaacgacccgctgctgcgggaatggagcaaggcggaggcgaacccggtgctggtgccgccgccgggcatcgggctgacggacttccgcgacccgacgacggcgtggcgcaacccggccgactcggcgtggcggatcaccatcgggtccaaggaccgcgaccacgcggggctggcgctcgtgtacaagacggaggacttcctgcactacgacctgctgcccacgctgctgcacgtcgtcaagggcaccggcatgtgggagtgcgtggacttgtacccggtgtccacctcgccggccgtcgaggacgggctcgagacgtccaccccgccggggcccggcgtgaagcacgtactcaaggccagcctcgacgacgacagaaacgactactacgccatcggcacctacgacggcgagaccgatacctggacgccggacaacgccgacatcgacgtcgggatcgggctccggtacgactacggcaagttctacgcgtccaagacgttctacgaccccgtcgggcggcgtcgcgtgctatgggggtggatcggcgagaccgacagcgagcgggctgacatactcaagggctgggcctcccttcaggtaacgtacattgatcgacaacccccataaccttggtttcatatttctgataggctatagaattagtagtagttacgtataaacaaactttttttatttaattttgacaatggattgaacgagacacggatagagatacgaacccgtcaaatttctttgtgaagcatcataactgaacataattacaaaaatataaaaataacaagttatattaatctcaaatgacgtaggaaaactattataaagctgtctgaaaagccatattgatctgtgatataattcattgcaaaactaattagtcttttttttttgcgatgacatgaacaagatacttaattaagatttttaggtaactgggtatgtactatctcaattggcacagaacgagttactattaaaatctgaaaagccgtactgatttggtataattcatatatattgtaattaatttaacttgccgtatacatccctttttcccaatcatgtactgtactccattaattactgtgtcaaaaacatttagctcatactatttgaatcgctagagcaaaaaagtaaagtgactaggacgatataaactcatggaaatccattaaaaccttatgaaaataacgcccctagctaagccagctagctgctagccagctggatatgatgatcatgctgatctggctagttaaccatggatggctagctaggacccggtcattatgtagttatacacttgcatataccatttctagaccacaattccgcccactaagatataatgcaaaacgtctttacctgtgcaccacgagaggcatgcaggcgtgcggctttcttgttgcgccggccggtcgatccagaagaaaacgtgcatgaacatagttggaccagtagtatatgcagtagtccaggtctgggcgggccccacggggatcacgtccttttttttattattttttgaaaaccggatcacgtccttctaccggtctacccaaacgagttgcacgatgccgacttgattaatcggtccgagtcacgcccgcccaaccaccagaggtagccgggcccggcgagatttgcaggctgccaatagactcgcggggatttgcatgcagcagcggcgccatgacatcggactggatcggccggcgttttctggtgcccgaccgtgacttgtctccggttggccgcgagagcacgagagccgtacgtctaagcaaactagttgtcaccacgtcttagtgtggagaagtattagtactctattaattagctaaggctagagttagattaatcctcaaattgcgaagggttttttttatgcgtccataacgtgtcttgcattggcgcatagctagagattagctaggacatttacttgacgaaagggggatttgagtaaatttctgatttgctagagtttggaattccaaacaggactattcaaaggggttgttccaacgaagcagcacgtggataatgacttgcttagcatcaggaaatttaataccctgacctgtcgctgcaatcgtgttgtttttttaataatccgtaatcatttgaataacttagtaatttcgcggtatatgtacatgtcattcttgtggcaagcgtgaaagtgagttcttgagtggccggttcgactcctaggggaattaacttcgtttttgagaaatttgttttacgttatttttggaactaaaatgtttggcaatttattttaatcgatgatgaaatcaatggtttttgtgaaatgaaaaaaaaaatccactcatagttattctaaagatgaaattgaggagttttcgatatttgtactatactataatataaaaaaggaaatcaacaaacgtctcctttctcagttggttaggcaagttgttgtgatgctaataggctacacaagtctaaccgtgttatctaagttgtaaagatacttgagatgtattttaaaaaatatatggaaatggtaattgagtgagtgtgttcaaacttgaacgcggtccactaggtttctaattctaaactttaccaactgcgcaaggtggagttatcgaaattaggtgatagattaataagtaaatgcactttcttggtggtaaagatacttgagatgtattttaaaaaatatatggaaagggtaattgagtgagtgtgttcaaactcgaacgcggtccactaggtttctaattctaaactttaccaactgcgctaggtggagttatcgaaattaggtgatagattaataagtaaatgcactttcttggtggccagttaagttgtaaaaatacttgagatgcatttgaaaaaaaaagcaccatggtggaaagggtggctgttggcgagtgttttaaaactcgaacgcggcccgctaggttcctaattctaacctttgccaactgcgctaggtggagttatcaaaattaggtgatacacaaatttataaatgcactttcttggtgaccagttatgcaaatacactagacttctattaaaaaattatggtggaaaaaggtgagcatgataatttttatattaaacgcaaacgaaaacaagggtgaaaaggtgagtgtgctaaaactcaaacacaataaacaagggtgaaaaggtgagctgctaaaactcgaacacggtccgctagtctgtctaactatagactttgccaactacactaggcagggcttcttaaaaaagcagtggactttgagtaaatatacttccttggttagatggccgggtatgaaaatatcctagaattgtatcaaaaagaatttgggtgggaagtgagcgtgttaagactcgaacccgggctgttatattttacaactctactatttgccattggcgctaggcgagtttatcagaattaggtgataggttaaccaataaatgcattggccttttgttaaattgcgaactatacaaacttactaaaattgcatctttttttaatcatgctaaaattatgtatttttatctgaatgactgtaaaaacttgctaaaattgtatatttttaaaatcatgctacaattttgtattttgtctgaatgactataaaaaaaactaaactgctactaccatctctaaataaatgtaattttaggtgatccactagaccattttaatactagtttatcttttttttttcgttttctccaccacaaggacatcgtagttttttaatctcttgcttaataatatatctttaactagttaaaactatacatttttagagtcggagggagtagatccttaactgtctctccttcaatcattcatgtcattgtccctttttctttaaatcttatttttttcctgttttaaattgttgttgaattcaatgtgcccttgatgggccttgaccgaggcccatccaaacaaggcatttccctttatttaaattaaccttttattattattattatttgcagtcaattccgaggacagttatgctggacacgaagactggcagcaacctgctccagtggccggtggtggaggtggagaacctccgtatgcgcggcaagagcttcgacggcctcgacgtctctcccggctccgtcgtgccgttggacgtcggcaaagcaacacaggtacgtacgcgtgattttgacacatgaacacaaaatgtgtcatacatttataaaaaaaaagtgtgccatacacatacacaacaactgctatatatccgacccgagaaactgacgtgcaagtgtggttctggtgtgcgtgcggttgtacagctggacatcgaggccgtgttcgaggtggacacttcggcagccgacggtgtcgtcacggaggctggagcagcagcatacagctgcggcacgggcgacggtgcggttggccgtggcttgatgggcccgttcgggcttctcgtgctggccgatgatcagttgtcggagcggacggctgtcttcttctacctggtcaagggagtcgacggcaaccttacaaccttcttctgccaagacgagctcaggtgtgtgtggtacacattttccagtatatgcgtgcatgtcttcctctgtgtgcacatatttttgcaaccaaatattcacacttgatcttgttattagaggatgtattttttttcgatacttcaatttgtggacagaggatgtgtgctgtcgtgtgtagaactccttgtgtatatataaaggaggcttaaattttgctttaatcgagtcaagatgtaaattttaatgcattttaaatcttgtttttttttcaggtcatcaaaagcaaacgatctagttaagagagtctatggcagcttggtacctgtgctagatggcgaaaacctgtcaataaggattttggtaagtctttctagcaaatgttgagtacatgcatattcatatgccacaacgcatatattttaatacgtcgtaacctacctttttgtgtgaattttctttcaataggttgatcactccatagttgagggcttcgctcaaggagggaggacatgcattacctggcgtgtgtatcccaccaaacccatctacgagtaggccaaaatctttcttttcaccaatcccacaaatgtgaaagtcactgccaaatcgataaaaatttgggagctgaactctgcttacatccgtccatatgtagactagatcatttttaatgtaatgggaatgaatgatttgtatacatttgttagttatgtttttatagactaatttatcttttttgcttccttctttatgtcaaactacaactatgacatattactagcagttgaaataaaacataatcaatcatattgttttgcctcaattttgttattgtgtgtgcgcatgcgcacacgtacgtgcacatgtgcgtatgctatcactctacccctgatgttattattagccatcaccgtaatgttgtcgtaagccaattgtgtcatgtttatcctacataaacaatatacgactttgcgaacattcctcttcaacaatgccacaaatttagggcccctagaaaatcactcaagattttggagctaaactctacttaagttcatcaatatataaactacatccttttaaatgcaatggtagtgtggtatgtttagattcattagttgtatctctatagtcaaatttgtttgtcttcatctttctacctatcaaaccacaactgaaaatttttagtcaaatatgtttgtttgctttcttcttcttatcaaaccacaattgtaaaatgtaactacaccttgaaagacacaaaattaatcacatatttctattttgtaatctaatttgtttgtttgctcttctctttctatcaaactccaactagaaattgttagtacacaatttaaagacactaaaaccaatcacatttttgccacagtatttataattgtgtgtgttacatttgtgtgtgtgtgtgtgttacatttttgtgcatgtgcattatatttgtgtgtctctgtgtgtgtgcgcgcgcccgcacccctactctggctatgttatcctcactcctcaccaatagccataaataaagtagtacaagtcatgccattcaaccagtcaatcgcgagacttcatctatacctaacatctacctagtggttgttagcaagtggggaaatgggtgagctcgtagcctcgtcatctccggttcaactatggacttattcggctaacagtttctgtggctgcatggcagctagctgtaggagcaaaaggcaaaactgtcctcgcacaacacaagcgctgcaaatcgcaggaatgacttccgaacgtgtcctatgtcttctaggacctctaaaaagtccttcccactttgatgtttgtttggatggccttattttcaattggaatcatttgatataaccaaaataataatcctttatatatggtttctctctaccatgtatcttgtttgaatccaatttatcactagattttaagaatcgttgacatcattatactagataatgattattaggagaagattcttacagcctgaccaacattaatcatgccatatacatacaacttgaaactatcaaaaccaatattatgacaccatacttcataacttgaagacaaattaacaacaatcacaatgatgccaattacctatcacactccatagagcctatagtcatgcgcaaaaactcacaccaaggcttcataaggtgtttgttccaatcagatgagactatatcagatatggcatgttaactgtcttttcctccccataccatcattttttgtaaaattatccatgaacaaattagtttgtgaaatttgaactatagtcagctgttgccggggtattatttttttatataagaacaagaagaagatgccttatttcaaggaaaaatgagaccaaaatttgcggtgcataattaattatacaaaactaagcaaaaaccgcaactacaacacattcgtagccaactaacctaaactaccacaactagaagtaagacaactaagctcaacactcaaactctgttggccacaaggcattattgccacacgttgttgatataggtgttgtagctacgagaaacaaactgaaagcatagacccccacacgttggcaatgacatgtcactgtcatcataccatcgcccacacgatcaagtgacccctaattcgctaggaagcaccatagcaagaactatacaacttgctactctacaccgaagtgaaacacgattgacaggtccgacatgagtcgtcattgccgagttcacatccacgcagcagcttcaactttcctaggagacaacagccaaacgcctctcccaacttgtcatggttacggataagacataccttctatcctacgacttataaaatatacggatatgtcatacttttgtatgtacgatacgtttttgtgtatgataaggaaatcgacaagagattatggaaataaacctcacgggcaagtaacgtggtagagttctactcagagaaggttgggattataccatatcgtgtaggatacagagtctcccagtagacgttctacttggagacaaaggggtccaaggtataaatagccaccccctggccgggggggggggggagccaacaccaccaccatagcctacaatctggaggacttgaagcctactcgttgggagatctcgtcgaaaccatctcgacaaggatctcgctagtaatctcgggattgactgttctctattgtaacatgtgattttctatatcaatctcatataaactggattagggctattaccttacgagctaggggcctgaaccagttgtagcgcccgttccgtcgtggcgcctagcggaaaaattatctcttaaaaaccctaattgcgaaatttgtttcttcgcttgttgtctagtgtccgtgccatctcaagatctcaaatccccgatctatcgtcaagttcaattccgaatccaaatccttccaaatcatatccatccccaaaagtctattttgcc

SEQ ID NO: 57237 - DNA, 1740 bp, Oryza sativa
cgcgtgcccgagccgcgccgctcaaatcgccgcgccgcccattgcttcccgcgcgcgcgtgccgtggtggccgaccgcctggtcgctgccgccgtcagcctctgtcgcgcctgtcgcttgtgtcgccgctccgctccacaccgccccgccgtcatcgccgtcgtcatcgcctccggccctggcctctccgcgcgcaaagccgccaaggggacagagagcagagccctcctcctctcttgccgcgacagcccccgctccccttcctccttttcccaaagaagcaaggggcgagccccctttctctccccctttttcctcctttttccctctcgccggcgtcatcctcctgccgccgttttggctgctagccggagcgccagctcgcgccttgaccgttcaatgtcggtttccctcgcccaaaccgacattgccgcccatttaagcccaagccctccccctccaaactctctcattttcgcctccgcgccattgccgccctctgtttcgccgtcgccgatcgtcgttgcgcgtgtcggaggagccggcacgagcaaggacgcggaagaggacttcggccgcgccctcttcttcctcttccccggcccgaggccggagagattactcccgcgccgtcggcctctcgtcacagcgccccgtcccgcacggtagtgcctccctccgttcttcctcctcgctccatctcctccccttagatttcggtagtagctcgagtagcctccccgtagttagccggcgccgccctggccgttgccgtcgctcgccgtgtgctcgccgccgtcgccgcccgagctcggaagcgcgtcgtcgccggcctcgctcggcgtagttccgcccaattcgacgctagcatcggattcccgtagccacgtagatgctctcgccgccgggaatcggcccctcgtgacctcgtcgtcgtttcccccttctcccgccgccggttgccgccgccgcgattcgccgccgtcaagctccctccggcgaatccgagccgttggctcgtctcccctcgtcacgtgcaaccacccggtgtgctcgcttttgcctgtatcgccgtggttcgctccgccgctcgccgccgtcgtccgccgtccgttcaggccggcgtcgtcgtctacctcccgccggcccgcgtggcagccacttaggcgccacgtcggcgccagctcagccaagactgggtcgagccgaccccggtcagcccctccccgtgcgcgcgttccaccgcgaggcgtgaggctgcgcgtgggcccgccgcatccgcatccaccgcgaaccgcgcgcgtgcaccgcgtccctcccccaccctagcgccgcgccgcgtgctccctccgcacggtgagccgagccgctgacaagcgggtcccacccgggaccgcgcgtggtgagcccggtccaccggctctctctctcctccctcccgcgcgcgcgcgtcttgggccgctctgggccgccttcttgggccggccggcccgttaagctcggccgacccgccctttctctcgggccgcgccctagccacccgagaaaagtctatattccctccctcctttcttttctttttcttttccaaaaaggatttaattaaatcctttttccgttagaccaaaaatccaataatcttagaaattcaatatcttcccaaccgtaaatcgtttgactccgttcaacttccaaaattcctcaaatctcgagatccatctaatggcatgcttagaggtc

SEQ ID NO: 57238 - DNA, 1280 bp, Oryza sativa
ctccccctctccccgggccatctcctctcccccggagagctccgctccccccccccccccgctcagctccgctccgcctcgcccgcgcgccgcgcgcgcgtgcgcgaagaaccgcgccgagtgctcctcctcctccgctccgcccgcgcgcgtgcgcgtgatccaccgcgccgagcgcccccttcccctctcctgtctgtgccgcgcctgcgtaagccgcccgcgccgagacaagtcctccctctccgctccctcgctgccacttcccgcgcgccgtgttcgcgtgcgcacgcccgcgcggacgccgcccgttgcaagccgcgcgcgcgtgccgagtggccgaccgcccggtcgccgccgccgtcagcctttgcacgcgtctgtcgcccgtgttgtcgcgccgctccaaaccgcccgccgtcatcgctgtcgtcaccgcccggcccagccactccgcgcgcaagccgccaagggacggaggcagcgcccctcctccctctgccgcgtcgcccccgctcccctcctcctttttcctgaatcggcaaaagggcaagcccctttcccccccccccctcctttttccccttttcccccgccggcgtcatcctccctgtcgccgctttggccgcgaccgccgagcgccagctcgcgccttgaccgccctaagtcggttcccaaaccgacattgccacccccctttaaaccccagctccttcccctccaatctccctcgttttcgcctcctcgccatagctgccgcccccgtgctctgttcgccgtcgccgttcgttgttgcgcgtgtcggaggagtcggcacgagcaaggacgcggaaggggacttcggccgcgccctctccttcctcttccccggcccgaggccggagagattactcccgcgccgtcggcctctcgtcacagcgcccctcctcatctcggtgatgcctccctccgttcttcctcctcgctccatctcctccccctagctttcggtagtagctcgagtagactccccgtagttagccggcgccgccccgaccgttgtcgtcgctcgccgcgtgctcgccgccgtcgccgctcgagctccgtagcacccgctcgtcgccagcctcgctcggcgtagttccgtccaatccgacgctagcatcgagttcccgaaaccgcgtagatgctctcaccgccgggaatcgacccctcgtggcctagccgctgtttccctcttccctccccaccggttgacgccaccgcgattcgccgccgtcgagcttcctctggcaaatccg

SEQ ID NO: 57239 - DNA, 897 bp, Oryza sativa
aaaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcattacggaaaactgtgcgatgcgagcggttgctgcggcggggttgctcaacctctgcgttgcgggaaacagtacggtgcgaacggttgctgtggtgagactgctcattagctgattcatgattttcttctggctcaactctaccatcctcaaaaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacgactgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacac

SEQ ID NO: 57240 - DNA, 2835 bp, Oryza sativa
  unsure (1)..(2835): unsure at all n locations
cagaaatgtcatcaagctgccatcatcgtcgttgctgtgatgccgtcgtcgccatcgccgtgatgccgaggcgtcttcaagccgacgctctcgtctacaccgccaggcgatggagattgctgtccatgcgatcccgccggaggttgccggcaagccatcgtcgttacatcggtcttcgcccatgccgtccaatggagtggagtcgccgtcaaccgggaggccatgacatccactttgtcatcgacgctctaaatctcgccaacctcgtcgagccgccagtgacaccgtctgccgaaggccatctcgtcggaagacgccttcgtgccgtcatcgccgcaccaccgttggactctgagcatgtctcgtcattgagactccgccgaccggcaacactttcacgctcgtcgcggtatctgaggcgctgctgatgttcacttgatcgtgttcgacggtgctgtctcctccctcacgtgttctccgttgctgtcgttgccggcgccgtgtgattcacattgccgggggctgccgtggagccgatggccaagcctggagaagagcacgccatctgcagcaactatggcaaaaatcatcacacgctaatgtttcacgtgtgcatgcatgctactgtgcgcacagtgacaagcaaaccaataaaatggcttattgctaagctatactcatttggccatgaggatgtgtatcgttatacactaatttctcaagtgcaagtatagtttggtggtctgcatcgaccatctcctactactcctttctttcctaatatgatcccgatgcaattgttatgacgtcgagccgtccaagctacgcgattccatgcatatcttcttcaagcaatctacaccgacacgtcgttcaagaccgacgaggctagacgacgagggcgggcgaagccgacgctaaggctacgtcaccaacaccggcgcacggaccgacgaggccgtggattgctgccagtgcccacatctacatcaccatgacaaccatgcatggagaatgcgaagcgaagacgatgagacgaccactagcagcttaatcggaggttctctgcaggcctagacctgcggaggtaattaaccgggagctttacgaggccccaggaaccaggagaccacattgctcaagtcagatatgtccaattacaggctatgaagtgcgtatcattatatgggaatttgtatttataatccttgagattaataaagtgcatgttccctatgttttgtttattgtgtacttagttacactggcacgcctgcacatatacatatctctaaataaagagatcatagacgttattttccaccctaaacaaattggcacgcccggtgggacctggttctcctcccatctttgccgcgcttcagtggtcgtcaaattcgtcttcgccaacatctccaaccatcaccagcatgctgcatgatgatatttggtgtgaatatctcatgactaaggtctccttgcaggaggaccttccatcatcgagaacactccgatgccctttgtgatccaatttgggtcgcaaccaccagcggcggtctttgagtatggctccaagatctattttcagcaagcctaagacacggcttagttccaagagatccaagctaagaagcagcgcaagcgtgcttctgccaaggctaagaaggagcgacgtgccctcatgcttgaagtccggacccttttgaaggagttcgttgtagctgagatcaagggagacatccaggctgcgcaaaagctgcgcacaaaagcggccaacaggtgttcaagtactgcatccctgcgcgcctctactccgacttttgctccaaagccaccctccccaactgtgcaacatatggaagtggggttgcttgaagctttggaagccgtctctgacaacctacatcgacacatatcccatgctcgacacatggatagtccacatcctctgcgcaactacaggaggaagtaccacaaggtgcagcgtctacatcaactggttagttcgcgcatcgcccagagttctgtcccggaggaagattggtctcttgacacatccatcctcatcggcaaggtgtgcaaatatccgagcatcttggaaccaccctatgacttgttccctgatgaatgggcacatgagccaaccaagatcaaggagaaagtcaggcgcgccatcatgaaggagtattggaagcggcgttatggggagcacattctccttcccggaccaacgatctccttcgactacaacacatacgccccttgccagcagagcacatgggagccatgcctccacttgtncgnggtaagaagatcgtccgtgtcacgcccagaaattagcccaaatttgcagactattttgtgtattaaatccctgtccaggaccagccaaggtacacaaaacgacaagtgatanacagttccaaacgtaaataaagcgtagaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacactactgaaaaggggaaataaaagcaaaactgagtacaaccaccgtactcagtaagccacaccaacgatgtagatgtgcaaggggatacaaggatggtttgtagctatttgcataaaggcggttgtaaaacattttattgagcaaaccagtaaaactgttgagtaattacagtaacattaaatctccactgatcaacgctacaccatgttgaacaggcccaaccaacccacct

SEQ ID NO: 57241 - DNA, 9853 bp, Oryza sativa
tcaagaggaggccagagcttcggccccttgtcttcccattggcataggaaagggatcttcgtccaaaggagatcaaaatctccagtcaagctgcctaccctcatcggtacgtcgacatcacaacgcatcttccccaagaccaaagtgatctagcacaagttgcaagtcgacctggtgctaatactcgtgtgaagtccatcgcaatcagaagtgttgaagaagttatatctcaggcaagggaagagcaggaagatcacattaaggatggagaacttaccgaaccagaatcatcatcatcatcagcatcctccttggagatgaaccttaatcctcttcattacaatgatctcaacctgtccataccttcggatggagaacgttatccggctaactttgatagtgcaccggcccatatggtagtagatggagaaccgaagcaagatgttgtggtactcccggggcaggacattaacccacctccgaggaacaacgcgagtacatcaagagtaccaccagcaagcctagaagaacaaatacaagagcaaagacaagtggtagatcagttaacggcgaaacttgaccgcttcatcgacatcatgacgacatctacttcaaacccaccacgtgttgacatggctccggccattatagatccgcaaattgaagaattggacgccattgcacaacatccaacacaaacccatgacgcccgacgttctacatcaagtgcacatccttgacacctcaacattcccgctgcctctgctccagctcccaccacattgaaagactatcatgacatagttgaagacctggtgaacaggcggttgaagcaaatctccatcgagcaaacacccagaccaatggagagtgagctcgaaaagccatatgaagcctggcatgatttagttgctttcccggcaaggtggcacccacccaagtttcgtcagtttgacagaacaggcgatgcaagggaacatcttgcgtacttcgaagctgcatgtggcgacactgccaataactcttctctcctcctccgccaattctctggatctttgactggccccgcctttcactggtacagtcgcctccctacgggatctataaggagttgggcaagtatgaaggaggtgctcaagaagcactttgttgccatgaagaaggacttctctattgttgaactatcacaagttcgacaacggcgagacgaagccatcgatgactatgtcatccgcttccggaatagcttcgtgcggctcgcaagggagatgcaccttgaagacgcaattgaaatgtgcgtccatgggatgcaacaacattggtctcttgaagtgtctcgacgtgaaccaaaaacattcagtgcgcttagctctgctgtggcagcaacgaagctcgagtttgaaaattcaccacaaataatggaactgtacaagaatgcaagcgcctttgatcccgccaagcactttagtgcaacgaagcctagcggcggtgggagcaaacccaaggccccagctgaagcgaacgtcgcgagggtcttctccaccgcacctcaaggtcaagtgcccatgctcggggcaaagaatgagcaagctagaggtaggcaacgcccctctattcaagatctcctcaagaagcagtacatcttccgccgggagttggtgaaagacatgttcaaccagttaaaggagcatcgtgccttgaacctgccagaaccatggagacccgaccaagtaaccatggtcgacaatccattatactgtccttatcacaggtatgtcggctacgccattgaggattgcgtcgccttcaaagaatggctccaaagggcggtcaacgagaaaagaatcaatctcgatgcagacgccatcaacccggattaccgtgctgtcaatatggtatccgtcgaacccgggtcgcgggaacaagaaggagccgacatatgggtaccactcaaccaagttgagcaccaaattgcaagaatgatgttaacgacgactccggcagctcatagggaggtcacccatgacaccaacaagaagatgtggaatacggtgcgacgaaggcctcaatttacaggccctccacctcgtcacccacagatgaagccacaaccccgtactgccccaacaacaagaagatggccagacccaagtcggcgacgcctaccgccttgcttcgtccccttctcgaagggagatgaatcctttcctcgccagggtcgtgagctacctactttggtgcagtttctgcccaagaattgggggcaagcatcaccaataagcacgaaggaagccgaagaggtcgccggctctaccccaactccggacgtggtttcgtgtaacgtcgctccgtgcaacgtcgtgctcacctacaacgacactacgggcgctagctctgatgacgtgttcaccacaagggagcaagaaacgctccatgccaagtcagatcagacgagagtagaagaagcccacatgaatctgcgagggggcaaaaccttgccagacccacataaggccaagccatcaaaggtagataagcctatcaaggaagcatctcctccaggagaagctccagaaacaaaggctaggagcaaggagaaacccgatattgactataatgtccttgcacatctcaagcggatcccagcactgttgagtgtttatgatgctcttatactggtaccagatctacgtgaagccctgataaaggcgttgcaaactcctgaagtctacgaagtcgacatggctaaacaccggctcttcaacaaccctttgtttgtgaatgaaatcacattcgctgatgaagataacatcattgaagggagcgatcacaaccgtcccctctacatcgaaggaaatatcggtcctgcgcatcttcgacgaattctaatcgatcccggatccgctgtgaacattctacctgtccgtagtctaactcgggctggtttcacaacaaaagacttggagccaactgacatggttatctgcggctttgacaaccaaggcaagtcaacactaggcgccataacagttaagatccagatgtccacattcagcttcaaggtgcacttctttgtgatcgaagccaacacttcatactctgctctcttgggacgaccgtggattcacaagtaccgtgttgtgccctctactcttcaccaatgcctgaagttccttgatggcaaaggggcacaacaacgcatcgtcggcaactcctcctcgtacactatccaagaatcgtaccatgctgacgccaagtactactttcctgtcgaagaaaacatgcaacagctcgggcgaacggcaccagcggctgatgttctaatccagcccggcaccgcaatgaccccggaggtgaggcgcctcatcatgtcatgttccccgatcatcagcaagtcttcgtcacggaaccgcaagtgcaaccgtaggggaaaatcgtccctaccagtcgatcttgattccaagcttccatcccccgctggagctagtgtttagacactgactactgcaccaatattactcaaagcaagacaccctacctcaacgcccataaatttgggagcgggtactcacaaaggcagcaagttgcctaaaagcgacgacaatgcgccaacaaccatcactctgcaggcaaggcggacaccaaacaaggaagccacgcctacgcgatcaggagtggtcaagaagagagtagcagaaatagaggaagccaaagcgggtgttcaatgtatgcagcccccggcgctctacacttccgtctctaccccgctagaggtatgggcaattccagatccatctgcttgtacacctcggaccattctctacaaggtcccacaaattcaagaatgcgattctgtgattgaattccctaaacctcactctgatacagaggaagcatgcacaaccatgaaggctgagcctagaacggctcgcctactgcagaaggcgggcatcaacctacggtgaaactaccggctactaccacctccagcgatatgtgaggactggtgggcacaagcagaagactttatcaagagaaaatgtaaagagcaaccaaagtacgggctcggttacatcaacacagatgagaccgatgacgaagatgaagcacttgatgatcacacattccattgctgcactgcaagtgtcactacaatagctgacgctcaactaccacaacacccgttccaggtagcagcagctgaagtcgaagaagaactcgacaccatgcaagcacctcaacaactcgaggatggcggtcagccaactattgatgagttggtagagatgaatcttggaaccgaggatgatccacgcccaatattcgttagcgccatgctaacagaagaagagcgagaggactatcgaagcttcttgatggaataccgggattgcttcacctggacatacaaagaaatgccaggacttgaccctcgtgtcgccacccataagctggcgattgaccctcaatttcggccagtaaagcagccgcctaggcgcttgaggccggaattccaggaccaagtcattgcagaagtcgatagactcattaacgtgggttttatcaaggagatacaatatcctcgttggctagccaacatcattccagttgagaagaagaatggacaagttcgagtctgtgtagactttcgcgacttgaaccgtgcctgtccaaaagatgacttccctttgctaaacacggagttggtggtcgcttcaacaacagggtatggtgcactatccttcatggatggatcatcaggctataagcaaatcaagatggatccccttgatgcttccgacacagcgtttagaacccccaaggggaatttctattacactgttatgcctttcgggttgaagaacgcaggtgccacttaccagcgtgccatgcagttcatcctcgacgacttaatccaccattcagttgagtgctatgttgacgacatggtggtcaagacccatgatcctaaacgtcaccaagaagacctacgcgtcgtctttgagcgactgcgccgacaccaactcaagatgaatccccttaagtgcgccttcgccgtacaatcgggtgtcttcctcggcttcgtcgttcgtcatcgagggagattgggaaagtgggctctactcatgatggaatatgatattaccttcgtactgcagaaagcaatcaagggccaagccttggcggaattccttgctgcacatccggttccggatgattccccactcgtcaccgacttgccagacgaggaaattttcagcgtcgagcttggaacaccgtgggagctttacttcgatggagcctcacgaggagatgtcaaccctgacgacacccctcgacggagagccggagcaggattagtgttcaaaactccacaaggaaggggtgatctaccactcattctcccttctcaaggaagagtgttccaacaatgaggcagaatacgaggccctcattctcggccttcttttggcactctctatgaaggtacattccttaagagcccatggagattctcagcttgttgttagacaaattaacaatatttacgaagtccgtaaaccaaaactggtgccatattacacagtggcccggaaacttatggacaagttcgagcacgttgaagtcgtacatgtgccacgaagtagaaatgcaccagttgacgctctagcaaaactagctgcagcgctggtctttcaaggggatgatcccgcacgaattgttgttgaagaaaggtggctttttccagctgtcctagaactcatccccgaagaggttgaaaccaacaccatcaccacagatgctgttgacgaagaagattggcgtcaacccttttttgactacttcaagcatggcagcctacccaaagatgcagtcgagaggcgccagctacagcgacgactcccctcgtacatctacaaggtcggtgtcctctacaagcgatcttacgggcacgaagtcttacttcggtgtgtcaatcgaaatgaagccaatgaagttcttcaagaagttcaacacggagtctgcggtggacatcaaagcgggccaaagatgtatcatagtattcgattagtggggtactattggcccggcatcatggcggattgcctaaagctaaaacttgtcatggctgccaaatccacgacaacttcaagaacaaaccaccagttccactctacccgacagtcccttcttggccattcgacgcttggagaatcgatgtcatcggcctcatcaacccgccttcctcaagagggcaccatttcattctcgctgccacagactacttttccaagtgggcagaggccgtaccactccgagaagtgaagagcagcaatgtcatcaacttcctcgagcgacacatcatctaccgttttggcgtaccacatcgtattacctctgacaacgccaaagctttcaagtcccagaagatctacaaattcatggagaagtacaagattaaatggactactccaccggttattacccccaagcaaatgggatggccgaggccttcaacaagaccctcggcaagatcctcaagaagacggtggacaggcatcgaagagattagcatgatcgtctctatgaggcgttatgggcgtaccgtgtcacagtctgtaccccgacacaaaccaccccgtactcccttgtctatgggagtgaagctgtgttaccattggagatccagctaccatctgtacgagtggcaatccacgatgaacttactcgagatgagcaggttcgccttcgattccaagagctcgacgccgtagaagaggagcgcttgggcgccctacaaaaattggagctgtatcgccagaacatggtgagagcttatgacaagctcgtcaagcaacgggtctttgggaaaggcgagctcgtactcgttctaaggcgccccatcgtcatcacgcacaagacgaagggaaagtttgagccgaaatgggaagggccgtacatcatcgagcaagtgtatgatggaggtgcctatcaactgattgatcatcaagggtcgcggccaatgccgccaatcaatgggaggtttttgaaaaaatattttgtgtaaacttcgtgccttttgtttctaaaaaaatatatgggcttgccaacatgcactaaccattgcactgcttggcacccctttcttttcatttttacacggacatcgtgtccaacaaaaattcaaaaaatggctttccccatgtcacgctgagctggtatgtgaagacttggctacctcagaacctcttagcaagatccaatgggtgacatgactgactacgcctacgactaaacatcctccacaccaacacacaagtacaattggtgctcatcttcatggggcaacaaagacttgcttgggttacttctcagtaacaagttggtccacatgctctcgtgccctccggtgtgcttcagacccatggagatatcaagccccagggaagactataggagaagagcaagaaagggctacctacctcaacacaagttgtggcctagtgtgcagccacttgccattcctgtgaggtgtgtcaacaggggactttacaaaataaatcggcttgcgaggattacgtagcccacaaaggggaatggttatcctccaagttctaaggatgccaagatcctagatcaatctcaacgaagtcatgatgatctcaactcaagaaaacaatgcaatatcaatctcaatgaagctgcggtgttctgaagccacgaggcaaaaaaaaaaagaaacaaaaggagaaacaaaaatccaagcaaccagttatctccactgcattctgtcagaaggaggaggataaccattcaccatcctcagcaaaaggaaaaggccgctctcatagccattcccctaaaaccctctctcaatttagccatacctaaatctctcggttcgatgaagcacaataccgggggcatgaaactcgtgggtggtccagtgacaagaaaggctagagcatggattttcgctgccatccgaaaatatcaccgcgtatactactccaatgcacaaacacaacaggaagttaagttgtcagacggcaatcgtcatggtcattcagcggttctgatgactggttctttggcaatctcgtctgaaactacctcatagccagtgttcagtgggaaagccaacattttttttaaaaaaaaacaaaaacatcaaaacccttttcggtgttgggttccgctcttttaaacccgcctggttgcgcggctctagcaaccatgctcgatttcttttatgtgatgcaggattttcgcttcacatctctcagagacaacacttcgctctccaaggcaacacacgtccttttctggcaagtcggaatcgcagctgccattcggtcacatccggattaataaaggacactttcgggagcagtccggcgcaccaccacggttggtgcttagctgcacacctttcaatttggcggatcggcatcgcattcatcaggcaatcacgtccaaatcgataaaactatcttcgggagcggggtggcgcaccaacgctgttagcgtcaagccgtgaaacccttcagttcggcaagcaggcaccgcgatgtactagcggtcttggccgtacgcctatagtatacgtatacgtgtatgtataccaaataatcctccctaggattaaaccaacggcaagcaaaggctagtacatgggctgtatatgggccggtggatcaatgctgcatgctcatcgtacatatgcggctggataaccacgcgtacacacgtacgtgggcaggatttctcgccaacggcaagttactgatgcggagataacgtcagtcttatccggtcatctcgatctgcagcaactgaacccggaagagccggatcgatctaacgctcggccgcggcggcgccgagggattcgtagtgtgggttagggctccctgcgcctataaaaggagaccatcactcactacacaggagacgcacacagccatttcactctcttcacacagccatctcagtcatctcgacgcagccatttcactcctctcttctcacacactcactgacgtagcctcgccggagcagccgagtgggatcggctcgacgggaggagactccgtcaggaacaggagtggtgcacgtcgacggctgctcggcggctggaagaactcaccagcgacaggagtcggcgtcagatcgtcggcgtcagatcgtaggctgtctcctccctcacgtattctccgttgctgtcgttgccggcgccgtgtcattcacattgccgggggctgccgtggagccgatggccaagcctggagaagagcacgccatctgcagcaactatggcaaaaatcatcacacgctaatgtttcacgtgtgcatgcatgctactatgcacacagtgacaagcaaaccaacaaaatggcttattgctaagctatactcatttggccatgaggatgtgtatcgttatacactaatttctcaagtgcaagtatagttcggtggtctgcatcgaccatctcctactattcctttctttcctaatatgatcccgatgcaattgctatgacgtcgagccgtccaagctacgcgattccatgcatatcttcttcaagcaatctacaccgacacgtcgttcaagaccgacgaggctagatgacgagggcgggcaaagccgacgctaaggctacgtcaccaacaacggtgcacggaccgacgaggccgtggatcgctgccagcgcccacatctacatcaccatcacaaccatgcatggagaatgcgaagcgaagacaatgagacgaccactagcagcttaatcggaggttctctgcaggcctaaactgcggaggtaattaaccgggagctttacgaggc

SEQ ID NO: 57242 - DNA, 8346 bp, Oryza sativa
ccgcggtggttcatgctctaaaaatctggccgcactatctcattgggaattccttggaaatggtttccggtccttaaaagtttgaaatccatcttcactcattcggacctgaatcttcggcaaaggagatggttagaactcatcaaggattatgatgtgggaattcactatcatcctggtaaggccaacgtggttgccgacgctctaagtcgaaaaagccattgcaacactcttaacgtccgtggcattccacccgaacttaatcaacagatggaagccctgaacctaagcatagttagtcgcggattcttggctgcgctggaagccaagcccaccttgctcgatcaaatccgcgaggctcagaagaatgatccagacatgcatggactcctcaagaatatgaaacagggtaaagccgctggtttcacagaggatgaacacggaaccctatggaacggaaatcgagtatgcgttccagataacagagaacttaaacagttgatacttcaggaagctcacgaaagtccttattccatccaccctggcagcacgaagatctacttagacttgaaggagaaatactggtgggttagtatgaagcgggaaattgcagagttcgtggccctttgtgatgtgtgccagcgcgtcaaggcagagcaccaacgaccggccggacttctccaacctctccaagtacttgaatggaaatgggatgaaattgggatggatttcatcaccggacttccaaaaacccaaggtggatatgattctatatgggtagttgtggatcgattaaccaaggtagctcgattcattcctgtgaagaccacctatggagggaacaaactagccgaactctacttcgctaggatcgtaagtctccatggcgttcctaagaaaatcgtatctgataggggaagccaattcacctctcacttttggaagaagctccaagaagagctgggtacccgattaaacttcagcaccgcgtatcacccgcagacagatgggcagaccgagcgtctaaatcagatcctagaagatatgcttcgcgcatgtgtcctggatttcgggaagacctgagataagagtctcccctatgccgagttctcctacaacaacagctatcaagccagcatacaaatggcaccttatgaagcgttgtatgggcgcaaatgccggacaccgctaatgtgggatcaagttggggaaagccaagtgttcgggactgatatcctgagagaagctgaagctaaagtcagaaccattcgggataatccaaaggtggcacagtcccggcagaaaagttatgcagataaccgtcgccgtgacctggaattcgcagtggacgattttgtatatcttcgggtcacgccattgcgaggtgtacacaggtttcggacaaaagggaagctcgcacctcggtatgtgggtcctttccgtatcgttgctcgacgcggagaagtcgcttaccaattggagctgcccgcctccttgggcaacgtgcatgatgtgttccatgggtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggtccagtggagcaaccacgccgaagaagaagctacctgggagcgcgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtcctttttccccccttcctctcttgggccggctcggcccagctccctccttctctctcctctcccccgcggcccatcggccttcccccgcgcgcgcgtcgctgacgggcgggcccgcccgccaccctcgctgacgggtggggcccacccgtcatcccctacctcgcgccgcgcccgccgcctcgcccgtgccctagcgccgccgccgccgcggattccgccgcatcccgccgcccccgcgcgcaataaagagggggaaatcactccccgtgattccctccctctttccccccacttttccctctctctctctctcggattcgtttggaaatcctcccgcaaacttcgccggcgtcattgatggagccgagatcgccgcgccggtttccttcccctccggccgccctctctcactcccaacactatttaagcactccctgtgcctccctcctccgtttccgacccttgccgctttctttccccgtcggaatcgagctcgcgccgtcgtcctctctctccgccgtcgccgccgagcttcggttcgccgccgtcgtcgccccggacctcctcccgcttcggcatcgcctcctttggcttcgccgcgtcctcgtcgacctcgtccaccccttcgtttcgcccgccgaccgccggaacgccgccgtcctcgtcgacccgagccgcgccgccgcctctctccgcttcggtcgccgttcccgtcgtcgcagtcgacccggggtgagccgaggaccgccatttcgcttcccccttccctcccctctctcgggcgccgctccgtcgcgccggaggtcgccgccggtgaccatcggggcgcgggcgcgccgcctcccgtcggccgtgccggcgaggccgccttcgggcgcgccctgcggctgccatgtggggcccggccgtcagccgcccgcgccctcgggtgcggctgacgcgtgggacccacggcgccggccggcgcaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcacaaatatccatttaaagagcatataaacttcaaatggccatatcttggccatttgaactcggaattggaccgttcaagtctctaatttttccttaagaagtcaagaacccatttttgtgctttgtttctgcttgttatatggagttgagtagagtaaaagccttttcttttccgttggtcgtgtagacgctgcagcttcggaagatccgctcttcgtggaagttgaagccggcgtttgggaaagcgagcaaggcaagtcacatcatctttgaacatattgattccccgtttgtaaaattatgttgatttaaattattgcattatcgctttatttaaattcccgcgttatcactgttttatttagccatgcctatttacctttgttatgaccttattattgttattgttattattaccttgttcaccctagaataaacaaaacaccaactagtggacactctactcatggtaccactagtacgattataggtagatgcttcgcttttaattaggtaacattaggcggttttacaactctagactttgggaatattcatatcacctggacactgtggaattgttggagtattgtggaattggattcacaccgccccctctattcaaaatccccaaaaatggtttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcctgggggttccggccgtaggtgggattgggtcggtactcttgtctatggctaggatgggttggaaactatgtcacgtgttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgaggaactaaatatctttaaatgctgtttactgcaaccctaacccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaccttgcaggtatcagagcccccttgaccctaggacgagccgtagatcccaagccttagcaatattttcgaaataaaaatcctttgtatttgtgaaaatcctcgtctctctctatcttgctgcttcatttatcgccaaaatctgacctttaaaatgttgcttttctttttgtttttgtttgtagatggccggcagcgtcacccgtcgtggtttggacatgactggtttcgtcttggagctgcggggcatgtgcgtggccctggggtatccacacggagtggactaccaggccaggccgcttccggagcaggagggtgacgatgcagagccccacgctgcttgggaggtcactgcagtgatcctcgctggctctcccgagcggacttcgctgacagtcaccgcgggtggagactctttccccgccgcttgccagagcgccgctctcctcgccatcggcactcttcaccagcgctacccggacgagttgcagcactcgccctaccgctaccaccctcgtcgcggaggagcccgcgaccacaccaccttccgggatgctagctcggaggatgacgctaccatcgtgcacctggcgcgcatggtggaggcgtacgacgcggctcgtatcgacttccatcagatggtgcgccgtgggatggtcgaggacaacctgaagatcctggagctgcgtcaagagaacctgcagctcaagaaggacctggacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttctgtcctggcccgtcgcagcagtagacgagcatttagtaggcttgcgcgtgtgttcattctcgtttgtcttcttgttgggttgtgtggggcacggttatgccggtgtgtggtgtaactgtgtcggagcctgtctttattttattcgcctaagcaacttgaactttaatgaacccatttaatagcagtaataaatttaagaattatggtagtcgtgggtggttagctttaattgtcagctctctctgtttgctggttctgtgtggggttttcagatggtgatgaccagagaagtgctaacaccggtgatggcaaccaacctgaaggcagcaaccacaaccatcagggcaacccacctccacctcctcctctgcctccaccaccaccaccagacaccaacgccattctcacccaaatcctcgcccagcaggccaacatgatgactgctttcctccaccacctccaaaatccgccacaacttaatgctccaccaccacccccacaacactctaaactcgccgagtttctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcagggacccgcatctctatggtgggaccatttccaggctacgcagccagagggacagcctattacatgggctcgcttcaccgccgttttccgaagaacccatgtgcccgccggagtcgtggcccttaagaaaagggaattccgagagtggaagcaaggcaaccgctccgtgatggagtatttgcacgagttcaacaacctggcccgttacgctccggaggatgtgcgggaagatgaggagaagcaagagaagttcctggcaggaatggaccctgagctgtccgtccgtctagtctccggggattatccggatttccaacgtctggtggacaagagcatccgcttggaagccaagcacaaggaactggagtcgcacaagcgccgcttggcgaatttccgcaaccaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctccaccgactgtgcagcctggtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtgttaaggacgtcattcggggtcgtgtgaaccatgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttagaaaccctctgctcatcaccacccctggaggggttatgacagcaaagtattatatccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagatagaactgtcagaaattcccatcgtcagagagttcggagacgtgtttccggaagaactacctggtatgccgcccaagcgagagattgagttccggatagatcttgctccaggaaccgctcctctgtacgagcgaccctaccgtatggcagcaaatgaactggccgaagttaaaaaacagttggaagagttgaaagaaaaggggtatatacgtccgagtacttccccatggggtgctcctgtgatttttgtggagaagaaagacaagtacgaagaggatgtgcgttgactacagagctctcaatgaagtcaccatcaaaaacaagtaccctcttccccggatcgatgatctgttcgatcagcttaaagcgtgccacggtattctccaagattgatcttcgttccggatatcaccaattacgtattcgcgaagaatatattccgaagaccgcattcaccacgcgatacggactgtatgaattcacggtgatgtcgttcggtttaaccaatgctcctgccttattcatgaacttaatgaacaaaggatcatggaatacttggataagtttg

SEQ ID NO: 57243 - DNA, 2687 bp, Oryza sativa
actgtacctacaagacacagccccacgacacgtttccgtgcgccgacatgtcaccacgacataccggaaagaggccgtgacaggacccttcgcataaccccctctaaccaagcacaccacacctcaggtttcacccccgtccccagcggtcaacgggcagtcccctctcgtgcctaggtgaatccggaagcgacagaggccgtcgcagggcccgccccgctccatcacgcccacccttgcctggatgcgtcggctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagtcacattttagttggataattacgaccatgaagcatggccagatgtctcgagcacgcagctcactctgatactaaaaaggtctaatactgtaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcgaaacaatcttacggactcttttcctcgcgactgcggacttccgaaacgacggattctacacgctagcacgcaaaacaaggaaaaactctaataaaaaccaaggaaatagtacataaaaagtaaacaaacatgtagagctcaattttagatgaattttgcaagttgaacggctcaattcggagttcgaatgaattagatatgaattttagaagttttgagccatttaaatgaatttctataattattcacgaattattgcgcaattattatttattttctcaaaggaaaaggctgtgctgacgtcagcaaagggccggcgccgacaggcgggccctactcgtcagcggcacaaggggcaagcacacggtggactcgatccaccgcggccgaggcggcaccgtggacccggacctcggaagtggtccacgggaccgacggcctggatcggcccaaagccgatccaacggccacgggcggcgcggctggggcaaggcacggctcaaagctggctggccaaacgacggcgcgcggcggcgcggccacccgcggcgacggccggcgacagctcacgcgggcgaaagcggcgcacgcgagagagcagcggcgcggccggcaagggggaggcggcaaccggctgcccggcaccaccggcaacggcgcgggcacggagtgcggagcgcggcggcagcgacccggtcggacgaccaccggcggcggcagcacgtcgcgaggacgcccgggaggcggccgacgaaggggaggaaaagggagagggaggggagtgctcaccgagatgcacgacggcgaaggggcggccgacggcaaggaacggtggcgacggggctcctcaggaagacgacgcgacggagctccggcgacgggcgtcgctcgggatggggcggacgggctcggcctcgatcggcgaccgaggaaggaggagctccggcggatttccggcgaagaggggcggcggccgaggtcctcctcgtccttgtggagctgagggaggcaacggcgcgggtcggcgtcgaccgaagcggcggcgcgacgcggctagagtcggcggcggcggcggagagaggtggttcgcgtggctacggcgctacggaggtggagaggggaaatggagcggtagccgagcttgcccgggcggcggcaaagctggcggtggcggcggcgcagtgcgggggcgacggaagcggcgacggaagcggctggagggtcgtcggcgtgcggcggcacacaggagtggcgtgggaagctctaaagagcgcgcgggaggggccagtgagttggggaaacgcattagtgcaggtcagggtgcatttttataggccccggagggggagatcgtggccgtggcgggcggcaacggccggcgggtggagctccggcaacgtgggcaagtggggctcgaacggcgccgattttttgggggggggaaatgggggagaaagtggaggaaggggaggacgtggggtggaccacgtctgcacgcgcgcggaggaagcggcgtcgtggggtggctcaggcggccatggcggcagttggagctggaggaatgggatgacaggtggggtccatgggtcccacctgccggagagagagggaggaagaggccggctggggaggcagaacggacttgagggggagagagaggcgagcgggccgagggaggaggccggcccgagagggagagaaagggggcgcgtgtcacgtcctgataaattcatcccgaaataaaaatcattttctaaaaggaataatagaattaattaaaattcgaaaagaaattggcaaacactaaaatacgtgcaagaaaaattcaaatgtggcccggagaatttttgttaaattctccttggtctaaaaagagccctcaaattttagtggaattttcagagcacaaataataattattaagaaat

SEQ ID NO: 57244 - DNA, 7683 bp, Oryza sativa
ctcggaattggagcgttcaagtgtctaatttctccttaagaagtcaagaacccatttttgtgcttgcttcggcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgattaaattaatgcattatcgctttatttaaattcccgcgttatcactgttttatttagccatgcctatttacctttgttaagacattattattgctattgttattattaccttgttcaccctagaataaacaaaaccccaactagtggacactctactcatggtaccactagcatgattttaggtagatgcttcgctattttaattaggtaactttaggtggtttttcaactctagacttggggatattcatatcacctggacactttggaattgttggtttattgtggaattggattcacaccgccccctctattcaaaatccccaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatagctaggatgggttggaaactatgtcacgtcttccgtctgtataccgtggtggtatgtggcacatggttgcacgtgaggaagatgtgtcttgtgggtaaagatgtacacctctgatcagagtaaaacctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcactgccttgattaataatactgtgtagctctaggatcgtctttataaaatggctttgggcaactaagtgacttttaaatgctgtttactgcaaaacttaacccctatattattaccccttgtacccccttgcattaatcatgcatctgccggtgtgacttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacagcgcgcgggccgcgggagagaaaggagggattgggccgaaaggggcccaaagagaggaaggatgattttatttgttttctatttattttaattgatgcaatgatctttatgctattaaaactatttctcgagctccgaaaattcacgaaaaattccggagagtacattagggcacaaagaatattacaaaatattcccggccaatgattttttttaaaggaaattttaatttcctctataatttcacttgattaaattgatttaacttttaatataatttctagaaatgcattattaattgatttttaatcccgaacgaaaatcggggcgttacagtccgactacaacaacaacaggttcgttgtcctgagacctgaggcacctactccaagaagtgaagacttacgacaagaacttcacgagttgcaagaccggatggctcaacttggaaggcggctacaagaccatgaggcaccatcaacacatgctgggggcagatcaagacgatatcaaccaagctatcgtcctcaacatggtcgccgcacattggctcctcggcatacacccctgccagcccaagtgacgaggcaaaggcagacggcgccaccaccacgctggaaccggtggtcaagacgccaagatcatcacgcatcttcacgccctgctcaagaatggcgagttcgaggggctcccccaattcaggcgccgcctcacgctccatcttctccaagacgaggagtccaaatacaaaggtgacaggaaacatatgcatctaccgcagccgcacgacaagttgcgcctcctctcctaccaacaccaccaattccaccaagacttcaacatgcacctaccgagaaccaacgcaagcgggagcggcgtcgcaacaaccgttacgccctctaccgagagctcgaagacttggagctgaaacacacccaagttcgtgttcatccagatggagaagttcgtcaagaagatgagaggattacgttccgcatctcccccaacttggagagagacgcaagatatagctaccttatagctcgcttgaccccaagaccacgaagggtgagacctgtggttgatgaaaagagggagacgacggctatccaacctcgccccgtaaccatcttgcaacgatccaagggtcaagcacaagtttccccaagtacatcatcaccaaagaaccagtttgagcggaatgaatctactccaatggagggagtcgagcaggcaccaatagaacatgttgacatggcgccgcgtcaagttgatgccatccttgagaaagatccatcccccgttcctcccttcggagttaagcaaaagatgggaagcgagaaccgggaagaaacacaagagaatattgtcatgtgcggcgcattagtcgcacactccgagattgagtctagtgctgtgtgggttcctccacctgtcacgcaagaactcacttacccttctgatgaggagattgtaccaaacccaagggtgaatttctccaagacatttcttccacgattgaaccaagttcgttcatggttcagctcagaagactcgagacaaaccactattccgtctcaagaggaggccagtgcttcggccccttgtcttcccattggcataggaaagggatgcctagcccaactaacacagcccaatccctattatcttgtacaaagtctagaattgatcctaggggaccacatcccactcaaaaaccgtggtttagttggccttcttctccccttgcgcgcgttgccctggcgttcgacttcgccgcgcgccgagctgccgcgcatcggcctcggggccgcttgcgcgtgcccaaccgccttggcgcaccgtcgcccgtccgacgcccttagaccgtcgctgccgcaccaatcttgacgacgacaaagccaggacgacctccgccgcaaggaatcgccgctcgacgccgtgcgcacctgtccaaagccaccgccgagtccgattttgattctactcggggtgaatcgagccaattcttgccgcacggttggattgaagatagacggtggtatcccctctcacaattcaaaccattcacccccgagtcggccgttttcaccctcgccgccgccgtgcgtcgcgcccggattggcgccaacacgtcgccagccgatttcacacgcggtcaagccaatccttcaccggtaaatattcaaacgtggcctcccgccactcaaattgatcttgcccgccctctcacaacctctgccgccctagccatatccaaagctcgagctcatccatggcgatgtcggtgcccgagctcatccattcctcccagccctataaataggacctcaatcccttccttgtccatcatcgatcatcaacaaccatagccccacaacctcgaagctctgcttccccaatccattccatcaaccaccatcgcccgtcggtcaaacaccttgtgcacgatcgactccacacctctccatccatcctccgccctaaataccccttagaacactttatatcaactatgttctagtatattagaccctaaccgaagccctgcgttgagttttacctcgctgcaccaagccgagcaccgccgcccccgcgctgctctgttcttcgccgccgagaagtttttccgaccgcaatccttcatctcggcatatctcggtgagttcttatgtttcaaccatctacatactctctagattccattttagcaatccctttgcactatcatgccaccccctgagctgttgacgtgagcacgaccgccaccaatggaggcgctcgtcggcaactattctccgcgtcttgccaaaggacggcaagctgtcggaatccatctaggtgcctcgtagatgctctagaacccctcccctagccatgtctaactcatatcaccttgatcaccatcacgacctaaccgtgccaccgccgccctagccacaacccatccacacatcaaattaacccctccgccgccgctcgccgttgccggagaaccctagctccctcccctcctcggcggcaaccactttccccctccatcgccgccgtaatcgccaaccctagcgccgccggccgattttggggaacagccaaaggaagaagaagagaagagagagagagagagagagagattgacaggtgggacccgcacacagtgccatttcacatttatttgattttcaaactttagaagcccatatcttttaaaatatagatccaattccagtaaaaggaccaatattcttctaaaatcattctctatcttttgagcccctttttcctatttttgtattttattttattttctctatttttcatatttttggattttatttgaattccttttgaatttgaattttatatgtctaaccctaggtcttgaggattcttctgactcaatagataatatcaatcaatctcaggacatcgagcaaggcaagttaccatatacctgttgatcatttaagcctatattttacaaattatttatttatagccttctattcagtactctattttatatgcacaattcaaccatagaaacccagataatttagtattgcttatttctcttacaatctggttaaaatatcttatacttagattgggacagtacgtaagatttggttgatttccgggtgactaggattgtctcgatcgatataagttttgccaggtacttatgtcaaacgaacgggtacgaccgcagtttctagaatggggacagacctagttattatgttaattagcaatatggcacctctgtatagtggttcttatttttaagtcctcgcgcatgaggcaactatagccgcgaaggacgactttaaccattaccatgtacaggtaaatggtttgtgatactcgagtataaactatatggtatatttctaaaccctgatcaagatgacgtggtgtcatacgatcagttccccttaaatatctcgggaacgccagaactcctcttgttgctgttaacaatacgttcagagcatatgaggatataagttcatggaacaggtgccacaattgttaatgacttaatactgggccatgactaaagccgatgattatcagcaagtcgtggactgcggataaagcgtacatctgctgcagtagaatatctttgaaactattcgaatagccgtactcatggaattgagtaacgagactcatatggtaccctggttagaaatctaaagtctatacgttttataaattcttgctataacacttccagattgtttattactgctttttgcaaagaaccctactatatattaattcataacatatttccatgataatttgctgagtattgcgaatacttatccttgctcttataacccctttttcagatttgggtcaagaggacccttatgactattactacgatgaccccgataacttagagaatccctaaaggttatacctccctagtcagaatgtatagaagcttctgctgtgtattaattagttaggtaagtacctattattgtaaaacccttagtattgtaaaactttaacgtatgcaatgaagaaccagctatattggatgtatcaatatttactgattcagggattgatacattaattctagtcggatccaagttgttagttttgagctccgacaaggggagccgcatcatcccgtccccagcgtcaccgtggccaatcgtggaggatctacagcggcagtggcagtgctgtagcggcaaactctcgagagagaaggaaggagataacagtggaggagagatgatgtcactggggtccattgattttttattttttttcatgagacttacatgtaggtcccctgtttgtaattttcacttttattttttctggtgttgtggaaaacgatcgtactggccgattaatcggccgtatatacgttaacggtagtaaaattgttccgttagcatgatacgatgtacaattatcatttgtaaacgtcaaatctccgtttttagcgattagttggccgttttccgtttagtcacccgaataatcgtctgtatgttgtattagatgatgatttagagtagtttttaatttaatttagaattgtttatgttttacttaatttagaattgtttgtgttttactcatttaatgcaaccaattctacataaatgcggtgttaggagatttaatattccacttatcttctaaaacatgaacattaaaatcagtgaaaaccatcctcaaaacaatgaagagagcccagttgcacggttttaatagtcaaaggggacggcatacctgattttacgtttgggagagacgcatcagaccattactcaagggactcaaattggattttttttttctcaagggccaaaagtcactgattgggtccttgaacggaaaggccgtcagatttgggtcgctgtaggcctactgtcttgaaattcgtcctgtattaaaagcataagaaggtcaaatttcggccttgtcgatgtccagtacgggccgcaccgacatcatcggcccaaactagcactaatgggttgttacggataattttgcgaagcaaatcccccctcccctaatatcggagcctccgtcgcaatccattgttgcgatttctgccgttcgggccatggcgatcacacggcgaccggagaatagcagacgagccgcgctatacgaaggccgccgccctggctagtccctaggaaggccgcgcgataggcgcccacctcccaacgcgtcctttccgccagctccaatctgttccgccgccacccgatcgacccaactcggcagtccccaactaggcgacgaggtaaatacacgaaatcccctcttgttgtggttgtacaaatcgatatgcatgcttgtttgggatttcttgcaaacttgaatgattactgcttagtagttttgacctcaagatctaggtaattggctgaagaacattatgttgtccgtcagaatat

SEQ ID NO: 57245 - DNA, 6218 bp, Oryza sativa
agacgttggttggcacttggcaggaactggtatgaagcaacactatctgtggctcatttcttctgtttctccacccaaattcaacggaccttgttccaaattccaatgagatgaagaaaattagtagtatatttctttgtttccctcgtgtgttttgtcattttccagtaaggtgatgtgtgatactatctggatattcctaccctcatggtaaaactgattttgcattgccatctcaaggtttgattcttcttgtttcggtcaatcctacatcacatttatcacactgaaccttgcttagacagcctgtaagtaagcaatcatccactggatctatgattatgcatgcatctagctatctttaggccaactcccttagttgtttgagtttgaccattcacattatctcttcggttctataattctccaccttttggacaaggttaagatcaaacttttgtaactttaactattaacaactttaaagctatttagtttagaggcattagaataatatatgtagatttatcttataaaatactacaatgaaagtgaaatttatcaattcattgtatatattataatagaaaaacatagtcaaagatatattttaaacaccgtgttattattcaaaacgttaagaattatgaaagaagagcgagtagctgcaagaggcactagctaagctataaaccaaacagtgcacgcttccattgccatctgaaaacggcatgcttttgactaatcgtggagcgaagacaacaacaattgttcagaagcggtgggtgtgttcttttggagggttgcctgccatccgcacgaaaaacggtgcgatagattaacacgtgattaattaagtattagctataaaaaaattaaaaatgaattaatatgattttaaaataacttttctatataaactttttgtaaaacatgcaccgttcatcagtttaaaaagcgtgcacacggaaaacgggagatgggttgggaacccattggaaagaagacagcctgtggcatcttcctcttcttgttgtcatcttttatcaatgcaggaagatacaatctagaactgataacggcatgcacaacagtccaggcatcaataacatcaagtacaactatgtaatgacgtacttgtacctaagtagaaacgatgatcccaatctcgtgtacttcccatgacagttccctaacatcggtatctaagcaagattagctcatctctccagctgtactattttttttaaagatctaccctctaggatgtaatgagtgatgactcaaaagtgctagtctggttgatgactcaaccagcgtccttttatttcgagctgtagtcagtgtccttcacgaaaggagaaacgaagcagaggacacaaagtttagttcagatttcttggtcgtggcttattttccccccattttttccttctttttcttaagaagaaaaactaactctgcagtgagaacgcaaatatgctcgtgggccccattcagagaagcagtgacgatcgagatgacgaaattaacgaaaacgaaaggatacgagagaccgtttcgcgtgcgggcttgtggcactggcacctagtacgcgcgcaacgatggtcacagccttacatttacatctccgggcattttcacgggagggtcgcgccatcgcggcccctatcgatcgatcgcccccccggcgcttgcgtggcgtagtggtgcgagcgtccgcgagaaactatctgcgcggtgtcgcggagaaaaacgccagcgtcaaccactgccatccggcgactgttggcgaaccgtgcatgtgtgtgcagttgtcccggccgttgatggcggacggggagtcctcaacaagcggtgaggtaggacgcgacgcaggacgtgaggaaacgcgcaggagatgtgctgtttcgtgatcacgcctgctgagctgacgacgcggggggaaaggggcggcacacggtggcgtgcaaaagcggcacggcgaggacagcatgctccaactaccactgccggtaccagatcgagcgtggaggtgcaagtacggatgagggttgtacgggttcgtacaaggtacagcggccgttgatgttcctagttttcccaccttccagggggaaggtctcacaatggcacacgcctccaagcatccccagtccacggtgtaggcagtctggtgagtggtgagtaccaggcgtggcagaaaattgaactgcgtgactgactgctgatgagtcatgacaaatttccaagcaaacgacgggtgtcatagctcacaggtcgactgcaggggatttgggggccattttttttctctcttttgagaacaggaaatttgggtgtagtccagtagtgaaagttgaacgtcagattcattgtttctgatgttttgttctagcgcgagagttctttggtgattagttgctctccagctagattcatctgggagaaaatgggaaattcatcaacaccatgatcgatccgtccaagttggatttgtaaacaacatcggaactaaaaagctaaaaaaagacaactgttactccgttaatgattccaagatgatcccggcacgcacatgtcgagaaaaaaattagcctctaaatgactagctaaatccatggagaaacagagaaccgaacaagagaacaaaatcagcccattctgatggaacgcatatttacaccatccccatccgccgcctgatgctaccacctgccgaacgccttcttcccggcggccgccacggcggcggcgcgctcgaaccgcgacgcggcgcaggggatggtgatgccgccggggtgctggaagccgaactcctcctcggcctccctcagaagctccccgaacatggggtggttgaagtacaccaccggcaccacgtacctcagcgactcgccggggttgccgccgccgacgtacaccgccacctgccccttgggcgtcgacacgggctcgtccagaatccgccgccgcccgccgtccttccgcccgaggctcagccgccgcaccagcgaccgcccccaccgcagcaccggggccagcctcttggcttcttcgctcccctccttgcaagcgccgccgcacccacccgacgtcgtctgcaggcgcaggtagccccgccggcgccggcgccggcagcagagcgcccatcgccaggcactgagcagcttccgccccagccggaaccctccatgcgaccgctttagcatatccaaaccccaagaaaccgcttccaccttcctacgtgggtgagttgaatggactttgggaggagtggcgagccagaacgggaggaagtgggagcgcggtgaggctagagaaacgagtgttttatagggcacgggcgcggaccgcggagcgcacaactgagcgtgtgatctcgattaaaaatttttaaaaagcattaaaaaattaaaaaaaaaaagctgatgccatttgcgttccgcttgttttttggcgtttggccacaggctaagattcgtgcgaggattttggctaggatttaccggggtttctggtggttcaggcggcgtttgttcggtaatggctggtgtggctgcgcgcgggcggtggtccatgattccttgggctaagctggacagtgagagctcgcccgcccgacccgttcggctacgctgctttcttcgctttccgcgactactggcgtgatagactcacgtacttaaaaattgagttggataaatgccttcaacttgtatatctccttgcaatctagcaagagtttggcacccagcacaaaagcgtctttgagatttcagcatacgtagctcctggtcgacgtcagtccccaacaggaaggggtttagaagcagtctttgctgtgaagttcccacaatatcgggtttgtttcggaacaacagagaaatgcttccaggttaggtctaggaatgtcgcgatactgccgtgcagtttagattgtagtagctgctactggctgtacgtggcacactgttatgcattgatacgaaactattctggcatattgttaggggctctcaagaacacgcttcacaattcacgaatttagtggcaatatttgttacttctcagatccaacaggaccgagccgccgccgccaacgcctccagatgccaattcccgaattgttctagtgttgttcgtttgatttattacaaccaacccactctctctctccggcgccagctcacaagcgagctgataccttacgccacccactctggaccgtggaccttcggattgggccttctctcacggactggacgccgagttgcaacccaggcttgattgtcacctgaagtctggatcacctcctccttatcttctctgctaccagcttcatcagcaacttcaggacggcttccttcttcttcttctggttcttctgcagttgagccttgcgagatatctcctggatgatcttgagagtccctgacaagcccctctccttgagaattggcttgcccccaagccaatgctgcgggaaaccttgagcgaagatcgtccagatcttcccaagtagcgtcctctggaacagatgcagaccactgaataagaacttgagcaacagcagaattacctcgttttgttaacctcctgtccaagatacgcaatggaacttgtaaaggagcagtggatgccggcaattgatgttgaaccgggcctgtaaaaccaattgcggatttcaattgagatacatgaaaaactggatgtatagaagtagaagaaggcaattgcaactgataagccacagtgccaatcttggctgtaacttggtagggtccaaagtacttaaaagccaacttatgatttgctcgcacagccacagaagtttgcacataaggctgtaacttaagatatacccagtcgcctacttcaaaggaacgaaaactccgcttcttatctgcaaagtgcttcatctgctgctgtgctcggtggagatgttgctgaaccaaattctgcatcaatcttctttctttcaaccactgagctagatcaggaatggcacaatcttgcgacccaataccaaagtggctaggagaatggccatataagacttcaaaaggagtagcttgcactgaagaatggaaagaagtgttataccaatactcagcaagatgcagccaagcagcccatttagtgggaaccgaatgaacaaaacatcgaagataaatttccaggcactggttgacacgttcggtctgaccatcagactgaggatggtaagctgagctaaagtgtaatttagtaccagccccttcaaagagatgctcccataactgacttgtgaaaaccttatccctatccgaaatgattaccaaaggaaggccatgcaacttaaaaatgtgcttcataaacaacttagcaacactcagtgcagtaaatggatgggataagggcaggaaatgagcatacttagaaaatttgtctaccacaacgagaatacagttagaatgatcagaccttggcaacccttcaataaagtcgagtgaaataacttgccaagcaccctcaggtacaggtagaggctgcaaaagccctgggtatcttgccctgtcaggcttggcttgtaagcatatctgacattgctgcacaaaggtcttagtcattttcttcatcttgggccatgcaaatagctgcttcagttttctgtatgtaactgggaacccagagtgaccaccaattggactggaatgtaattcagttaaaagcttggactgtagtgtaggattatcaccaatccagactctgcccttaaatctgattagaccagaattgagtgtaaaatgtttcctgccggtggcattaacagctaattcagtaagcaattgagtggaaaaagggtcttgtttataaccatcagtaacttcctgaatccaagtgagagtacaggctgaaatatgacagagttcatcttcagtatcttggaatttccttgacagagcatcagcaggcccattacatgtacccttccgataacaaattctataagagagacccaagagtttagtgaaggccttgtgctgccatggagtatgcaatctctgatctgagaggtgcataagactgtggtggtctgttagaataatgaattcacccatttgtagatacgatctccaatgatcaattgccatgagcattgccatacactccttttcataagtggataaacccttggttcggggaccaagtgtagcgcccgttccgtcgtggcg

SEQ ID NO: 57246 - DNA, 1438 bp, Oryza sativa
aaatcctaattgcgaaaattttcgttttttgtgtgcgagtctaagttgtgccaaggatctcaatttaatcccgttgttccctctcatcgaaatcaaaatcctccacctcaaatttctcttccgattcaagtctccaaatcaaattccgaaattcagtcgcatcctttgaatcctcactaaacgctcgctcccaatttcgaaaaataccaaactctatcttgagccttccttgattcctccctgaaccctcgagttcgagtatcaaatttgaattcgaatccaaaccctaaatctctccaattctatccaaatcagttttctctgtaaaagtctattttacctccctctggctcggtgggccgactctttttacccggcccatcttctctcagcccgcttttccaccttcccgcacgtgtgctgcatgtgccgagagagagagaggcatcggctctctacttcctctctctttcctcgctctctctctctgcttcctttctccctctactcggcgccgatttccccgccgtcgccgttcgaaatccggccgcacccccgcgttgcgcgcgcgcgctcgctcgcgaggaggtcgaccggccggtcgctgccgctgtcagccctgccgcgcctgcgccgggcaaccgcccggccccgctggccttgcgcgctggaccacacagctgcacggccccgcgcgcgtgcctgagccgctccacgcgcgtcctgccaaaacccggaggccgagctctccctctccctcctactcccttcctgaatcggcttggagcgagcctctcttttcccccttctttttctctttccccgaccaccatcggcatcaccgcctgccaccgcctggaccacgggcgcgaccgccagctcgccgcccccaccttgacccagcgccagctcgccccgcgccagccggcgctgctcctctcgctcccgcggttcaatttccgccgcacgatccaccgccttcgccgcccaatgcatccacgccgtcaccgctttcgcatcgcccacgaaaccgccgctgccgccagccgagcgcttgaccgccaaggtcggttctcccctcccaaaccgacatcacctcaccccgtgcctataaaacccgaagccgagctccccttcccatctcaatccctcccgcttcacactcctactccaccgcgccattgtcgcccttcctctgctctcgccgtcgccgtccgccgccgagcaccgggaagaccggtgcgtgcgaggacgcgtgacgcgggactccgggcacccatcttcctcccctttcccggcccgaggccggagagctcgctcccgcgctgtcggccgctcgtcacagcgcccgtctcggctcggtagtgcctccctccgttctcccttcccgcttgccctctccctcctatagctcgcgcggtagctcggtagtcctccc

SEQ ID NO: 57247 - DNA, 2780 bp, Oryza sativa
tttgtccagacaatccatttagacctccataattcatatccctcgatccgtagctccgatcgcctccgttccacttccagtaattccgtaaaattgagatctatttaatggcactattaattagtctaaataggatccttctttggtcttttgtttaggttttcgattgtttgtgtaaagttgcggttgcggattttcgtcgatcgcgggttttctcgaagattcgtgaagcttcgtgaaggccttgagcaaggcaagtcaccctttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgatttccttgtcactccacccttgtggtacctcggtattcgtgctctctgagcgcatataccaaatatcccacatacaccgttgtttgtcgaaaacttgggaaatgggtttgtgaagccttcaaaacccgacatgtggtgtcggtttgtttgaaaataaaaggaattgtgaaaactcgcgatgcggcggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaagaacgagaagcttgctcacttaccgatcaaggtggttggagttgatttgtgaatgcctaaaatggcctatgtttatgtgagaatttgatccttctatgtggcatgaggtaaccctgggtcggcttaggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatagacgacctgagtggtcagaaacgaatctatgtgattcgggatgtctgtgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaaatgagctgttgaaaaacatctcttaaagtcgaaacgagacgcaagtctcttttcggcccaaacttagaaagaaataaatcacttagtgttttcaaaatgtcttcaaataaaagatttgcaaaacaaccttgcctctcttccaagcttgcattaaacacctaagttcccgtgacttgctgagtacgagagtactcacccttgctctatatatatatatatatatatatatatatatatatatatatatatatatatatatatatatatatatatatatatatatatatatatatatatatatatatatatattctttgaattgcttcttttcttcctgctcagcaacttggatttcttccaccggaaatacctggctcttggacacatcaattactgccatcaacaagaaaccgtccaacgatcgattacaactgctgccacccttcacgagcctgactattactgaattgggctagcaatcattatctcctgatccattccattaatccattccattaatcgaaagacaaatcttttatgaaccgagccttcacttgatattccagtaccatgataacaagaataattgctctacttaatgtgtttacttttccataacaatacaaactttaacttccatttacttcacattgaagacgtgagaattgaatcttcttgctattttttcttctaaatcaacatctctttacattcctcgttgttgaatgtcttagccttactgacactattcttttgacttaaaaaatagtgcaaaaagaattgtcctttcagacaccttgatataatcatttcttctataaaccacattgtagtgggaataatcatcttgatgacatagatgtaagcttttattttccttattccttattgactcttgctcacatcaaacttggaaccttatatcgtgagataccaaatgtgaacaattctcttgaattttttttcaatggcgtcccttgagcttctgacttttaaccttccttggctgacagactgtgttatccacaacagcatctggatgaattttatttggagatccagacacattgttccttagctgaaataaccaggttgagtatattaaatgtttacttgtttaaaccactggcaccgttgagcacaaaacttcctttcctttaattcattctcttaggtaggaggtaagagagagatagaaagggaagagaaagtagataggagactcaaaatagaatagactttttactaagctttattttttttattgatgtgaagtaggttgttttttaacactaaactgaacactgaaactagtatggttatatcacaaccctcgatatactccatacgctaaaacccacacacacacaaacaaaacttaagcaagcaagctaacaca

SEQ ID NO: 57248 - DNA, 8969 bp, Oryza sativa
aggtcggtacattaccaatgagctgttgaaaaacatctcttaaagtcgaatcgggacgcaagtttcttttcggcccaaacttagaaagaaataaatcacttagtgatttcaaaatgtcttcaaatgaaagatttgcaaaacaaccttgcctctcttccaagcttgcattaaacacctaagttcccgtgacttgctgagtacgaaagtactgacccttgctctatataaatatatatatatatagttcctccgccctaaagagaagataaagtgaagtgaagattagggtttcgtcctggttcccagccgtcacctgtggtgttgggtgttagttcgttggttcctctgctgctgctgttgttggtgtttcctcgtccgtatcgtcagttgcattctcggtttgttctcagctgcaacctaagttaaggtaaataagtcctctatctattttaaggatttgcagtgattcataattgtcaccgtgggtaccagcactatgtcctgggactggtaccgagatcgcggtttcgtaggaagcggttcgcgccgtttttcctacgacacgctcctatcaggtgccgttgtgcggcggtgccggattggggtgtgacagatccatgccactacaaatatgcaatttagataaatgttaatactattcacgatatcgattacgtgccactggaatgtggggaaattggaatcgtgtcactccatcgcgttttccgtcagacccccagacgtgggacccacatgtcagttacatattccttcatcgtccccccttttcttttttccccatcttttcctccatcttccacaacttctatgaggggcaacgtggcggcggcacccgagccgtcccgccgcggaaggggtcgaagacgacagtggcggcggcggttcccaagccctcccgctgcagatggggtcgaagacgacggcgacgacaaccgatccctcccgccgtggaggtggtcgacgatggcggcagcgacgatgaacgccgtggagagagagagagaggaaggtgaagaagaatgaactgacagctaagtcccacatgcagttgaggcttacgaagacttttgacggaaaacatgacggagtggtatagttccaatttctccaaattccaatggcacgtagccgatatcgtgaataatagtgacattgatctaaaatagcttatttgtagtggcatgggttcaattaactctaaaaaaactgatgatggattggacaaaaacttattcagattcatcgtcataagttactacaaaatggcttatttgtagtacttctttttacggatggagtattgtatatgcatggtctgtataaaagagataaggacgaagaaaatatagcacacgttgatgtgacgtgagagaaatatgagagaaaatgaaggaacacacaacatcggtagagattgggttatcattctgcctccatcaaaactcatgttggtttgcaaaataaacgcttctattttcacaataaccaaatttcacaaaccatgctatgataactacggatatagttagagagaactttccagcgcctgtgtcgttctaatgaggacaacacaggcggcattttcgtccttggatacatcttccatgtgcctccatttttggattcttggatgacaactcaacttagctcttgggccgacaatggtgctgctttatgacgacatgtccttccaaaaggcatcattgtagaaatctattgttgtgttttagtagtttttggtctatcatgcctcgcgatggcatccacgggtagcctttgggaagtaattagagctaatgcgccaaggtgacaacgagctaggtaatgatgactcaaagttgtgtttggttgtgttgactggggatacctgtggaccagatgaatagtgtattggggtacgctagtacgaggatgtaacgctccgcttttcgtgagacgttaaaaactaattcggcaaaatcctaattgcgaaaatttcgttctttgtgtgcgagtctatgttatgccaaggatctcaattcaaatcccgttgttccctctcatcgaaatcaaaatcctccccctcatccaaattcctcttccgattcgagtctctgaaatcaaattctgaaattcaaatccttcctttgaatcctcgccaaatacttctacaaatccagaattattcaaatctcgccccgaatccttcccttgacttcaccttatgttcctaaagtcaaagtatcaaggttaaattccaaaaatccttctcaaattctctccaattgaaaccccccccccccaccaaatcagttctctcgaaaaaagtctaaattgcgtccttcttggctgtgggccgtttctccctggctcggcccatttctcctcagctccctccacctccacgtgcgctgcacgcgccgagagagagagaggcatcgcctctcttcttcctctctccttcctctctctctctgtttcctttctctctctctcacgccagcgctgccgccatcgccgcttcccgccgtcgccgccaccgccttcgctccttcccgcgctcgcgcgtggccgaccggccggtcgttgccgccgtcagccctgccgcgccctcgcgtccgcgcgcacgcgctcgcgcgtgggtcgccgccgcaccagccccgctgccctgccgcgctgcaccacgcagccgcacggccccgcgcgcgtgctcgagccgctccatgcgcgtcctgccaaaacccggaggccgagctctccctctccctcctactcccttcccgaatcggcttggagcgagcctctcttttttccccttctttttccctttcccgaccaccatcggcgtcaccgcctgccaccgcctggaccacgggcgcgaccgccagcccgcgctcacaacccaaaattcggccgtccgatccaccgccttcgccgcccaaagtgtaacgtcccgcctcccccaggccgggcccacttacatctgatagctttcataggtcatagactgccctcacataccaacacatgtcttttctgcacactttgtcctcactcgtgtgcacccgggaagaatttcccggtcggtcacccatcccaaattgctccaggccaagcacgcttaaccctgaagttctttggagattggcttccgaaaaagaagttgcaacttgttgatcgacgccccccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcccgccttcccccaggccgggcccgcttacatctgatagctttcataggtcatagactatgcccccccgtcgatcaaccctaggccaggaacgtcctctcttggccacgtccatgtgtatgtgtccagtgccagcgcatgtgccatgctgtgtaaccactcccggtctacaccagccatgcgcaccatgcctgcgcaactgcgacacacgcgcgccgggcccgcttacatctgatagctttcataggtcatagactgccctcacaaaccaacacatatcttttctgcacactttgtcctcactcgtgtgcacccgggaagaatttcccggtcggtcacctatcccaaattgctccaggccaagcacgcttaaccctggagttatttggagattggcttccggaaaagaagttgcaacttgttgatatgagtattctattaattctattaagccctataggccgggatgttacaggatccaactaacattttttctacagagggagtacgcgtgatttcctgcccgacctcttgtttctctgaagcattacatatgccacgtttttgtttgatgtcacgtcaacagcatataattcttagaccggcacgcgtcttaccggtcgaatggtaagcagcggtcggtgggacaagtggccagaggcagccgccatctcacctcaaactgctgagatgggctgaggatcgatggaacgctacccggcctgccaatcgatcgagatgatgcgagcttttttgcactgtggaacccaagtgagaaacatcaatcattgacccgtgagaaaaataaaaagaaaactgtccgtaggcgctgctatgtctgatggatcgatcccgttcgatgcaatgtttgcaaaccatttgacgccggtggtgcgtccgtgcgagtggacagatgagatgaaaagctcacgtggacagagagaaagagaagagagagtagtagtagtaggtagtataagcagtgcagcttagcagtagacatttggaaatggttgcaccgttatatccctgtagatgctactagtgcactgcatagatcaatcacatcagctcccctccccggcccggccctccataattgcgaggcagcagcagccggccatgcatgacgctgctgctgcctcggcccagtactacgtgccatccatccgtccatacatccatcagctagctgctgccctgccttctctgcttgcccctgcctgccagtgccaccagtacgtagtacgtcaagcagagcagcagtgtgacgagtgtgacgaaaccgcccctagctcagctcgatccagcttacgccgcggtctctcccccggcctcccctcgcttgactggccggttcgatccatccctgcgctgcgcggccgccgcaggctttcgacgacagcccgcgcgcgcgcctgcgtggccgcagttctgatcgtcgctagcgctggatctaaggcgccgcggcacgctggaaacggcacagctgcgtgctactgctaagtagctgtgccgtgccgtgcagtgcagtaccgtgcccccggcagctcgcctcgcctgccattgcacgccgaacgatgcgtgtggtgtgcgtggcgctagctagctgcatgcacggagttgtatccatgcgccgagcgctgtctgtttgtcgtcgtggggggcatatgcgcgcacgtactttcctaccgatagagacccgtcaaacgccggttccgacccgcaggtgaatgaatggatcaacatgcatcttccatacttcttccatttcgccaaaaaaacgacctctagggacgtgactaacaccgaaaaaaagttgatccaactccaagtatacatttcaattttcccaagcaaaatttactttggtaattaaattaactgtagcaccaatatggaggcacggatctatgatatataaacgagtcttttacctccaattatttgacactccgtgtgtcttgctgtggccacggaagcatgcatacgtacgtacgtacgtggtatagtacgtgcctaggtagctaggctagtcggcgcgagcgaacagtcgcgttagcggacggatgcgtaaaggccagcttaatcttgggcccgtttgcaggcatgatcgaggtcgcgacaggccgggtcagagttgttgatcagggctagctgctgcatcactagtcatttcaatggacggagggcaatgtaccggaataacataccaagtccaataatacatcaatcacaattagtgggccctagaatcgatctcgcattgcagatcgtgccaaacaggatattcaatttgtctcgatttttttaaaaaattaagtttgccaggactgttcacaatgttcgtctatatcccaaaattattcaattagcagagatatctccttgggcttcattttattttcttttagttggctatactacatgaggcttagtcctgtacatgcatttaatactactcattacaatgtttgcgatttttattcgtaaaaagatcttgaaatgaaataacattcaactgaccacgtttcatcacatgtactgtactattacacttctaaaaactgtttccttttacatgccgtctaaatgtgcaaaactttatcttaaaacattataaatgtccatttaaaattgggttaggtccaattcaacccccccccccccctcagttgttttgaggcggtttggcggtacgtcaactcaaaagttaaaaaaatattgggttagagccagggttttaaattttgaaattgggttttatgccaggggttactgaaatttcggaaatttcaagccgaaattatttaaaaatttgaccaaattcacaaaaaaagcaaaaaaaacgaaaatttcgggtgagatttgagtatgctggtggggggcgaaatttcggaaattttgaaccaaaatttcaaaccctggttagagctttgcttataattacaattccgtagtttcgagaaataaaattgagaaccgtgcaaaaatatagttctattttcaaaatagacggaataattctttaatattacagacatatttttgacaaagaatatgctgctacgttgtcttattcgtgttgatatagtacgtatatattttttacataatagaaatattttatatctctagtctcacacaaccaaatgtgatgcgtgaactcgtcgtgtcataattcaaaacttttttttactgctggtccccacttatataaagagatcagtcattaaaatcaaatatatattatgctgccaatgggttcagttaaaccaagaatggtgaaaagggtttcaactccccacccctaaaagaatcagacgatttgatttcaaatgatcacctggtaattaaaccaaatcgatctagttatgtccataagatatataagaggcagcacgcacagctagcagcctctgtacaggcgaataggaataggaaaaattaaggggaaaatacatgaagaaactgagaaaactagaattacacatagataaggacttagatacgatcgatgcatgccaagatgccatgcatatggtgccatgatcgtccatatatagaggaacatttcagttaacaagcaaccggagatcatatctggagatcgagacatgcaggaccctaactacagggtgggacacaaagttttttttaagccagatcgtgcattgatctgaggcgttagaatggagtgacacccatgctagatgctgctgtggctgctgcagcggcggcggctgcagcgtagagaccgtccttgaagagcatgcattccccagctccgtcctataaaagcacaaaaaatactataattaagtctcggttttatattcatccattgacatcgattctccaccaatagaattagggtttagattttagggtccgtctttactctttacctggctttgtatgccggtcttcttcaggccctggtccggcatcaggccaaaatggatgtgtgggaaatgggcccactggtgcatgcacaaagatgagacagagtaaatacgaatttggtttatatatacagtggagtatgctgcacacatcacatgcatgttttttttatcaagaaattaaacggggagattttgtacgttcttggcagcagcgctgaaagcctccctgtgggtgatgtccggattgcttgccttgatgcgttgtatctcatctctgatattatacgtgtcataaacggagtgaagcacgagtagtttttgtcagatgatgtaattaaaagaggaaaccaaaattaaacgatgtgaaccattatcgatgattactcacttgatgaatcggttgtatgccgagggaaccctctgccgcttctctgaagctgcagaatcacaacaatgagccgaacataattacttggttaacagaataacagcgtactttgatgacactactgcagcactgctgcagttcaaagaccgaagcagcacggacgcaacaaggctagatcagttgaaagaccatatgtacattattagttcgcatgtgcaacctgaccattaatgttgctccctgtgagctcacagaacaaattagggactggttgccacgttacgttctgtctgtttgaagcagtattcgatctggagtttagaatagttttccatttgatctgtacgtgttctgttcccttttccttaacccctcttcctatttttttattgattttttgttttgtcaagactcaagtgatcttacctatctttgcactgtgcataattaacgtcgggatttgggaagaattcctccacggacaaaaggcactattgagctgatgtgaaaactattcgacccccttccacttgttcgaaaacttcattgaccatcgaaaagaactctcaaaaggagaagctcaaagaggagcatgctgtattcgtgccaccaagaacagtgtgtgctactgcagcgcacgcgcacgcagctatctatagccagcttctggagttctctcctagctatacacagcgttgccggaggatcgaggaggagaaggcgaaggaatgtgggagaagtgaggcacttactcctgttggctgacggcgcgttcttcggctgctgcggctctcgctgggtagccttgttggccgccgacgccatcgacgtcgccggcgcgttgttagcacagctgctgttgctgctcgtgatgctgctcacgttgggactcgcctgttcggtcattaggctcgccggcgcttggaatgacggcacctcatcctgcaagccgaaaatgattaagcatccggccggccggcgcagtgagcaaaaactaagtagaaatagatcgttgttacgtacaaggaggccgttcggtgaggtggggaagagcagagcctggccgaagggaagctggttggcggtgaaggcggcggccgggagcaggaggccgcggaggttgacggagagcaggttggcgcagtggccgcaccgcacggtgaccgtcttgaacaggctgctacacggcacgcccacctgcaaatgcaacggaacgaggctttattcaagggacgtaccggagtccggagctatagttagctattacggccggacagatcaacggcgcccggcgagggaac

SEQ ID NO: 57249 - DNA, 9859 bp, Oryza sativa
atggcgcgtatcctagctaggtgatccctgcccggccggccggcgcgcgcggtcttggctttcagctgggtgatttgatagtgcggtgttcaacgaggagagggagaaggagggatgagactagtggagatgaagctagcggatggggggaggaagagggagggatcggagggggtatatatatgggtggcaccggcttatttggtccccctctggtctggatgtgatagtatttccgttgatgtgatgaggtgagggtgaggtgaggtttgaggcggtttctcttgatttgatgggtacgtgagtgagagtggctcgctgctactagctcctgatggatttgatgctttaatggaccttgcccgattcgagaaagcctcggatctgttgttgcttctgatttgaaagcccgggacgcaaataatggccggccggctggctggccggggagagaggacgagtgtgtttttttctttccctcttcgcgaccccagccgtgacagcgacaaagagagcaaggcaacgcatcagctgagcctgagctgctgctagccttggcccttgggtgaatggacgcagcaggctccactgttgatcaggccaggccacaggccactgcgccccgggggcagattgggaaacgcgaggggggcaacaaagccaagcgtccagtacacacacactctctctctctctctctctcgctctcgactgggaacagtggctgcgacagtagccggtagctagcatcttgggactgttccgtctgaaaagcgggcagaggggtgcaggacgagtggtggggatcggggtgcagacagaggctgatgccgatagagcttcgccgagcagcgggcggggacgggggatgcatatgggtgggcctcgcggctcggtgttgtgtaggccggcccacctggcgccctgttccatgatgtggtctggtcgcaattcgacgcgttcggcgcagtgccacagtgctattttcagtcgctcgcgatggggcgtaacctttgcagggatcatctcatcggttgcccatcaaacagaccatcactgtgtctaatctttgtatagctcggcgtggtcgttacattccgtccatagtcacaggcactcggattggacagatagctaaggctctaagctagctcgctggagaacacgtatatatatggatcaccttatccccttcctgaacagttagcactgttaatcacagcgttctcctttggcatttttatttttacctatctcagtgttccactcatcttctttggcaccaggtccatcacttgtaacccccagtgttccggccctcttctgttttgaaacgaggacgtgatttgtcagccgcatggtagggcttccctgtcaaaatactggctgcatcattacagcttgtccgcaggagaatgaaccaatcgagatttcgcgtgctgttttgggttattcgaggtctctggtcgatcttctgctttggtggtggggcgtacgtcgtctctagcttagcccggcctcttcagttttgttgctactttagcgcctctgcgaggcctcaggactggacgctcaggcaaaattcagcatgccataataactgaatctgcacttgtgcaggctacatagcaaagctacctggtgaattgatttccctcctccggcctccaatgtagagtaaaacatatgtgtaatccgtcgtcctttgcctgagcaagctgcacgccttggagattcgatccctgtgtcggtgtcaatgcgtgcctcgttgctcagtgtctgcccccctcctcccaaaacctaaaatacatatagtagtaaggagggaaaaaaaaaactgcgcatgcatggtcccgtaactacgcaggaagtaggacgtactactgttccgtagccggtgtaacccaaagatgaagcacagtgcgcagccgaacaggccaaagcgcaaggggagaaatgggataggcaaaggtaagcacgcacccgcccgggaccagctcatccaaatgaccaaagtgtctattgctgcatgtcgttgctcgcgtgtcagggggcacgattgcacagggggtgcttgccggtttagctagctaatcaatcatcgtggtaaaatctgcatgcagctagcggcctcgcgtccctttagctcaggtgcgagcgtgccggcatctcacgcacatggccctcccccgttacgccgatcgagctgcagcctgcaggcttgtgcagtgctgctcgctcgctttcgtctccgtttcactcttgccaattgccatgtgacatgtgagcgcggcctttggcgtcgcgaaaatacagtggctgctgcgctgccaagcttaagatcctgcgaatggaaagacggatctgagggggtggactttcggtatgtgaatatagaaattctctccctgtgtagcctatgctgcatgctccgatcgaagaatagggagtagctgcttggtttacaggccggtaacgacgctgtcgacgcatgcagtgtgcagagccgcggaactaggtatagctataggaaatgtgcgtgaggatccgctaaaaagcaagcaccaaagtgccatgcacatacttgtatgcgtagcctgccctcattatctaggtcaacttatagctagctttacgcatgattcagcggataaaaacgtacatgagtgttataatgcggttaacgtgctactagtgcgtccgaaaaatcttactttgtgcataggaaccggtctcagattgagacaaaacccagccgccagattgatccgatcgatgttgcatggctaccaactcgatcagtacacacgcctagaacacgatccgcgaaacacgaaaacagagacatgcaatatagagcctgctgtaactgtaaacgtgctgtcttacagaaggcgatggcagagaccaagctagctagaacagcggctaacagaccaagctagctagaacagcggctaacagacctacagaaggccccggagtatctagacctccttttgcaagttgtaacgtgtgcctagcctagcaactttaacagcggtaaaaaaaaaaagtcgaaggcacagagaaaaggctagcaacagtattccagcaacgttcgaaaggaagggtaaaaaaagagtgcacaaaagaataccacccacgaggtcaacggtcagaatttgtatgttcacttgaattcacaattgggacaggagtgctggacactgaactgacgaaactgtacattgcccatccacgaccaagaggtagattgttgtccaggccgatgctttggacccaaactttgcactctccttttcctgatttcaggtcctataacctaaaatttgttacaacggcccaaacttatgagccagcccaaaatcgcatttcactcgctaagcaggccacgccccagtccaacgcctgcctgggtcgtcccctttccttctccgcctaggactcctccccgtacacgggttcgaccttcgacgagctcgatcgaccgcaaggggaatgcgactcgtgagcgcggcactccgccgccgtgtgcccatccctccgcttcgccaaagataacgaagccgcgacggccgccgggctttctgatctctccgcccccgctcttcccccacggccaactcgtactgaaggctgaagcactcgacgcgtctcctgtgagaggtttagatcaaaacgctcctacacgtactgcagtttgtttttctttctttatctgtcgttatatgatttgctttatcctacattagtggattccgaggggttttagaaatctcaggtacatagttacatagacggaataataattaggtttgttcaggcgtagtagtattctttttttttcttcaggtttgtgatcaggtttaaatattttctttcttcggtatggaccgtatggtaatattctctagctcgtctctgccggtaaacttcccatcacagaaaattcaggtgcacgtgcgtatagccgtatatatcaaagagaaatagcgaattcgacatgtagtccttataactccgtaatgcggataatagactgctgtctatcaggcagccacttgttacaggcttacagctgacaatttttttcgtcatgaacctttaagtaactccttacggacttcacagttcaaacacggaagatttgatggcaaattaattaatcatgcatgcatgtataaccacttcggttatactttattagtatatatagatgggcagttggtaattaccatgacaatgctagctatttatacactgtatcaaatcacaccgcaatgttattaggctgtatacaatggcgtatatgttagtatgtgttttgcatcattcacgcggctatttccacaaatcctcctcccctccgcaggaggcagacgtggacacgtaatccaagctatcctcctgcttcccctcgacctgaaacacctgcaccggattgcagtaactgggctccttcgcagtcgagtcgccgtggccgaactgagacgccaccagcttgtcaagatccctccaatctgctgccgacgcatcggccgtcacgtagaccggctcgatctgcagctgcagctgctgcgccgtcgtgtggccgcacggctggagagcggacgacgctgcggtggcgacaatgatgtcggcggccggtagcttggggctctccagccttgggaggtgcatgaacggcgccgcctcctgaggaaggaggtggtggtgatactctacctccagcttgcaagggtggctctggcggtggccatggtacggcgagtcgaggcctggcgccggcgccatgaacgcgacgtgctcgttgaaccagaaaggtgagtcgccgccgtcgccggccgccctttgcaccgccgcgactcgcttcttgaacaccctgcagaccacccatccttcctcctgaacatggagcatgttaggtgtctgaagtctgaatcctcggtagcatgcatgcactagtacacaaacttacttggggagctccgtattcgttggtctccaagcgatactcgtgcatgatccagtccgacttctgtccgttgggagcccggcccctgtagaaaaccaacgtcttcctcatcccaacaaggcagttcttgacatagatcggcttgtccctcccggtggccttccaaaagccggcagtggtcgccctgttggtgcgtgtgcccgtcgggtacttcttgtccttgtggctgaagaagtaccactcgttctgctcctcgtttccaatcttgcattgttctgtttgagcatcattttggagatgtcgattaattagctagttatgatattacagggttagagataagcagcaagcttgtagaataagtggagtaaattgtgattaccttgtaggtcccaaggctcaattttgtacagatcaatatcttttatgacgtccaagtctatcttcttcagtgctaccttcttcctaaggtagtaatccacgagttcctcgtcagtagggtggaaacgaaaacctggcgggacatgggagaatgcgtccatcttcttccgcggatcaaagtatagctcccgaactggtagcaagttaatatgaactgcatgcacgataagaagctatatttcagttacaggctagtttgataacgatgcatatatgcatgtgtaacgaattccaaggaagaatttgaacatatagcatccaacttctcgttagctcatgtctactagtactagctagaatcaggaaatctcacaggaaatactccttttcttaattgagaaagcattcgatcggtttgcacctggtctctctaacgattctgaggagtttctttctttttgtaggaagatgaatcggaaattcatccagtgaagtttctctgaccagaggctggtctctctaacgattctgaggagtttctttctttttgtaggaagatgaatcggaaattcatccagtgaagtttctctgaccagaggctgattctcgctcttctgcactcctatagaagactagcttgatcaacaggaggtgtatccttgcttccacttccatttatgcatccatgatgaaacctttgccggtttgtgtgaaaaagaagacgagatagaggaggacaggagcatcgagttcaagttgttcagctaaacaaaccgagcgcaaactagggagagctaaagttgctcgccgtcctatccgacaaagcacactgcacacacctaggccctagggactcgcgaaccttgtacccacgaagacggaagaaaagacatcgctaatcacgcagcacgtaccccagttcagcacgcgcgcacagtgcgcggtaaacaaacaaaaggtaaaacaagctagcatcatcgatcaagcagaaaaccacgggttggaaatggacgagccgtctcttaccttgtgcgcgcgcgcctgcaattgctactgcttcgtagcttgcagcagcatgcagcgcctccctcggccagcagcagccagccttcaaacggatggagcagctatatcgatcgcatgaggagggacgaggccgcggcggggtctatatatcccgcgcgcggtggtggtgatggcctgggcgcgaccgaggtgggtggcgcgcgcggagggcaggggaaggggacgcggccggaaagcgcggacggattgcgggccaaggctggctacaatccaggagcaccgcggccggagagcgacgcggcggagccccgcgtttttctattggcctttttcgccgtaaccgccacctccccgcacccgccaacgacagcgacccctagctagctccctccgatcacgctcagcctcaccccccgaaacggagcttccactgccgcgtgcagcttatgtagcagcagagactagcagtggtggacaccggccagcgctagttgccacctttcctcatctgaaaaattcacagatagagtgggtgtaaacctttctctcgtctgaaatggtaacatttgatcgaccccaactgaaaacgagcaccggcgtgtctggcccagaaagccaggtaatcatggtgacgcatcaagcgcggtcggtcgttgcgtttttaccctcatgcatgactgtaaatgtgtgttagcttagtgtgtgtaggtttgatcatgcatgcggttaagtctgtctatatgtaaactctctttggttggtcgtgttcgctatctggctttctaaggattcggccatatgtgctcttcgcaggtagctagctagatagccgcctatagcttctagttgcgtttgtttgctcctggatggtcgctctcaagacggccacggctggaccccgtttctcgaccgacctaagtatattttcgatggcgaccctcctccaaatggaaacagatccagtgccacacaagccaaaaatatgctactcatgtcatccttactgaaacggggacaaaaggatctcaagcctttcaagacacgtcacatttggacaggaccagggctacaggcctagtgggctacatatgttagaactccaagaactccagactgatgcatgggttttctgataattaatttgcacctttgcttctctgctgcataattaagtaaaactttttttgctgaaccttagtactgtagatattagtagctaagtttagactttagtactgcatccgtacctacgtacatagtatatgggagtgatatatgaggtactgaagtgccaaggagtgatctatgttaaacctgattaaaagcagattagcatgtgcagagaaaatttgatgcaactaggcaagtagaaccaatgaagttaactgtgcggaatggggaccgaccggagatgctgtgcaagcaggcagcggcggctggtgtccggcgtgggctcgaactgatcattagccatccctactttatctctataggagtattatcctttcttaatttatttcggtgctctcgccggttggaccaagggctccacactcgccgtgcatatgcatatggttattgataccttatctggaaattgcgaatttgtgaagaaacattcgtcctcttggactgatttaaaaatcccatctgagctggaaataggatggctatcagatcgatggctgacaataacaagtgaactgtagcaagcgtgcaaaccaaccgggcagccgcagatcatagtacacaattttggtagtaagccccttgcaagcagcagtgatcaatagcatgcatgcacagtccaggatccgagttgcatgtggtccacagtgtgatacgcacgccctttctccgcacgcaaaaatgaaagctagctagctgatgtatagctttcccggccttgtttgctgctaattgagatcaatttacacatgcgcattttcatctctctgcaaacgatcagtcgcattgtgcaacgcacgtacttcacgtgcgcgtgtatgcaacagattctgcaacctgcttggatctgtacatctcctcaaacttaagggcccctttgaatcgcaggattgagaaaatataggaataggaaaaacgtaggattttgatagaaatgtaagtgtaaaacagagaattgcaaaacgcataaaaaacacaggaataaccgtttgattgaaccacgggaaaaacacaggaactggatgagagagatagactcaaaggaaaattagcaagaggttaaaactcttgctaaatttcgtccaaaatctctataggattgtccattccataggaatttcaaaggattggataatccaatcctttgtttcaaagggcttcataagaaattttcctataaaattgaaatcatctaaaatttctattttttccttcaaatcaaatagaccttatcgtctcatcgtctcggccttgtatttgccggagcttttagtgatcgacacgcgtccggccagtgaggccgacagcgacgtcaggccggagcagacgccgttgcaccggggagctcgtagaccgtagcctttgggaatacacaaagagcagaacaagtggatataatagataccggccggtgcttttgcttggatggcgatgcattctcggatgtttatattttgggtggaccgtattgcaactggttctggtgtatctttgggggagaagtgaagcaaaaggactatacgccatctggtgcatcatctttgctagatgccgacgtcactggtctttaatcagttttagcttaacagttatgtgatgaatttatcatgggtaaaatgggtgataactgtaatatataggactggttgcgcgttaacctcagtcaagtccgaccggcttaacacctcagtcaagtgaaccagccattggtctctctcttcttacgactgaagagcgtcttgagagttagtattgatgttactatttttttttaattttttctataactatttgagtcgcatgcaattgataggtgccataacacctatcaactagctatactttttacagtgaaacaatggcatctgactggtaacatacagtgcgacgaaaaggggacaggcaagcgtgaggcaaatggaataaagcctctgcaattcacctgctaattcttgcttgaactgtacactcgaaaccagttgcaccgtcacttttctatatagaccatgaccatcccgatgaagcgagagatgtgcatgtgagacactgtttgcagacttccatcatggatgaattcctgctggtcttatcaaaatcgaaaccccctggggcctgcccagtattccagtgtggacgtgggctcggcaccttttaaccgcacacatcatgtctctgctgcatacaagcatcaacaattcgacatgacagatggcatcattcgccagcagttggcctttccattctgaaaatttgccggggccaggaaacaggttcaggttcaggtag

SEQ ID NO: 57250 - DNA, 1105 bp, Oryza sativa
gccgcgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaagatttggcggattctattgggatctgggtgggtgtccggtacttttgtacttacgtttcatgttgcgctcttcctcttcattgggcacgggcacatccaaggctacatccgtatttgaaagatggagggaatccaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacccaattccggcattcataccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactaggaaagtgctttgtatttgaggatgtgcgg

SEQ ID NO: 57251 - DNA, 1037 bp, Oryza sativa
taaacggtgcgttttttgtgaaaagtttctatgcgaaagttgcttaaaaaaatcaaattaatccatttttgaaaaaaaaatttagctaatacttaattaatcacgtgctaatggaccgtttcgttttccgtgcacactgtttgggttgggatccggctggagtgaacacagccttaatctattttagaggcaacttaagacattatattgtcatttcataaaaatacttgcaatattccccgggtttataccacagtagtttcgaagcatgtaatatcacatggtcgtagattagactctaaacttaactgtgactacgcaactgacacaaggacatgagtggcactataacttgttatctactggtactattgggcaggttgacggtgcactcaatgtggtagtagtaattgaaggagtaatcaggtaagaggaaatggccaaccaaatgtccaacatggtagatttggtgtttgcactcacaacagatctgattcactgatttgtgaaagttcgttcgccgcttacgactggccgtccaattatgtggcctgtgcaggcaactattaccaccctaatgccatctataacacggtaagtgacgctgactttaacctaatactgctctcatgtcacagataaaaaacattttgcatcaatcgccaaaattcaactgcaaaaaaatattactgcaatttttgtgaatacctcaagaaaatcctacccatatcatgtacatatcaatccaactatccaaatatgtattgacaaatgaagttgcaaagtttgttgcatttatttcaaagttaacaggcttcttgtccttaaattagaaagtggaaatgccatcaaatgccccatcttccaaacaagcaaccactcataatcattgctttaacctgcctttccattaaactgtagcttttgacaggcgatatcaatgttcattttccctcagtaattgatagcttttgcatatcatgggttaacataggccagttaaccccatgatatgcaaattcgtatacatttagctc

SEQ ID NO: 57252 - DNA, 946 bp, Oryza sativa
aactaacatatgaatttcagtcgatataacacatgaatctgtcatgtattgcaaactgaaatgctaattttgtaactccaatccaatatgaagaatcgatgtttgttggtgacaagagcgaagtggtatttaggagcaaatataaacaacttaaccgggagataagcaacaacccaagcgtagaacctatcaggaatatccttaacctttagctacatctaccttccagcacatctgaaaaagttgctcccaggttgtacactggtggatagcagagggcttcgtgcaagggagaggtggaaacaaaatgcaggaattgagaaacactgtatgaaggcagtgacctgatgttggcaagccagcgcacttgatgactgatagcatactttatggagtaaaatggacaatttccttaaaaagaagaactgatgaagaaccactactttaagtgcatcagttgttaaccaatagtattaaatttaaaagtagcaaattatcatgagttgctcatataatgctgaatgttacctgaccaacatcggcacggtagaagtaggaaggcctcgcggaatcaaagctgcatctccacgggtttctaagacccaatgcccaaacttctagttctaagtcactgtcatcagtgtatgggttgtcttttggaatggagtagttaccccacaagctggttagcaatttcactctgtcctgtaaagggaaaaaagggaacaaattatcaaatacagtacatgctgatgctccatatattgctaattgtttgtcttatgtgagaggagatttatcacaaataaatatgtgaagtcgtttgcaaaaaattcagttcgtatgtttgaagttcatcataaacatatttatgtacccaccccattacctacttacacaaatataagtagtgaatccatattactgggttgttgctatataggaa

SEQ ID NO: 57253 - DNA, 5821 bp, Oryza sativa
  unsure (1)..(5821): unsure at all n locations
caaaatcagaactcaaaaaaagcaggaattcattcagatcgtaacctggtcaaattcttgtgagcaaaaatttaccttgggcacagaggagatcggcaaaggtggccaccggtgacgatgcggacgggagagatcaacgctagcggagcagatcggtgagcgaccgtcggtggcgatgcggacgggagagatcggctcgggcggaggcgcggaggaaatcgacgacgttggtgacgctggccgacgggagagggatgggcgttgttggcgtggcggcgtctcgatggcggatggcgctggatagggcgatggagcgatgcgagagagaagaggcgacgtcccgatggctgatggcgctggatagagcgatggcggcggcgtgagggtgcaccgtctgtggcgtgcgagagaaaggaggatgcgtgtgaagagcgtgatggggggatgcgcgtgaggaaaagggaaaggaggacncncgtgangaacgcgtgcggaagggagggtccgcaacgattttgaggcgttggatcagatgattcttgaccgtcggatttgatgaatggggtttgtaggagtgtagttggtgagttatagggtanatgtgtgtcgtgcatgctgcatattactctgtgctacagtacatatagagagcccttttacaacacacaagtttgattgagtcaatggttttatgggctcgtggcctgtgtgtgggcccaatttcatttttggtccccttatcatccacatccagttgaccagtccctcctagcccatacggcctatattgtgaaggccccagaccaaagtactgatgggccatgttcccaactctgtagactgtagtctggacttccacgtcacgtccacaattcccatttcacacatttcatttgggcctctaaagtagaaaggtctcaacttttgacgttccaccggtaaacagcagcagcagcagcaaggcacctactcctaatcgtctcatgtaacacgcgagttgatcgtgatcattcctccatcacgaaatatcatctcacgcaaaagcacgaagtccacctgccacggttctggagctccgctcctttttcccaaacacagcagagtttcagacttttcagcttcggtttcccttgtttctgatctttctttctccttcatcaaggcacggaacaatgcgatctccgcgcggtgttttgcattttgcaaccgaaatctcgcgaaaacccaaacccctcccgttcaccgtgccgggactgtacacgttctgcggccacaagccatgggatttccaaatcacgaagtacaataaatggaagaaaccacaagtttgttccacgcaatgcccccgcgtgatccacgcgaccacacttgcgaggagcgcgcgagcgaaagctgccgcgatggcgagacgacgtgccgcgggtcacgtgtcctcgtggcacgctaactcgggagtgtacttaaggccgcgtctcaccaactactcggagtagtttggctgcttgacctttgtactgtgcttgtgctgtggtcgcggacgacgatggctgcgcggtgctgggtatggggcttcgtcgtcgcgctcctggctgtggcggcggcggcggatggggaggaggaaggaggggaagtgggagccgctgattcggatgccgacggaggaaggggacgacgctgaggctgctgctcccgctcctgctcctgcggcggcggattacggggggacgaggtgggcggtgctcgtcgccggctcctccggctacgggaactaccggcaccaggtgagctcgcggtgatggagttgggtgtgttagggtctaggggcgggggcggcggtagagattagagactagtagaaaggaaaggaactgcctttgggggaaaattgaagcttttggcaaattcccctttcttgtgggcgtttttgcagcttgtttggattcgcttcccgattcggagaaaaatttactgttaacattcttgctgcaatgctgcttccaatttgtggtagattttactaattcctaaggcaacccttgctccaaggctgtatgttcttctaccaaagctcctgctatctgactactgaaatcggcctatggacatgttctatttgttcagaggcatggctatccaatccgtattgctacttgcttcgcttaaattttgaaagctccatacagttatgttttcgataagagaggaacaatctctaagtcaataattaggtgggaggcatattggttggcaacatcagttttgatcgggcgaagattttttaaattgctataaatatgacgactacgacactacaaataatttattgtccttcctgcatgatttatgtttgtttatcttctaatatattgacgtgcaatccttccgcgcgttcgagaaaaaaagatttatgtttgtttagtgtgtgattgatcaaatacgaacagttcttaagataactgaacaattatatgagtgcttgtttaatggacgttggtgtttcctggtgcattgcaggccgatgtgtgccatgcgtaccagattctgcagaagggaggagtgaaggaggagaacattgtggtgtttatgtatgatgacattgcccataacattctcaatccaaggcctgggaccatcatcaaccatcctaaaggtggagatgtttatgctggtgttccaaaggtagcattttcctttaattgtagtttcaagaaaaagagggtgcaagtagttctagtttcagtcttcaaattcgatttctttttctagtcatgttgtatggatctctaatgctagttttgtatataatttgaatgtgtctgtattcatgcaaggctgatcaacttaacatgcattacaggactacactggtcaccaggtcaccactgagaacttctttgctgttctcttgggcaataaaaccgcagttactggagggagtgggaaggttatagacagcaaaccagaggatcacatcttcatctattactcagatcatgggggtcctggagttcttggtgcatactccagcatatgatatttttcttagttaattttgtatggaacttagcttacaattaacatattttaggtatgcctaacctgccgtatctttatgctggtgattttattaaagtgttacaaaagaaacatgcttccaacagctactcgaaaatggtataagatcattttccccttttcccttccattttttataatccaaaatgatgtacttagactgaaattaaaccctaatttctgcaggttatatatgtcgaagcatgtgaaagtggcagtatcttcgagggcttaatgccagaaaatcttaatatttatgtcacaacagcatccaatgcagttgagaatagttggggaacatactgccctggggaggaaccatcacctcctcctgaatatattacatgtctaggtgacatgtacaatgtttgcttggatggaggacaggtaagcttcatttagtatctcttaggtgcgacatcttgtggatttctgttcttctatataatctttttcggtgtgtcacaggtatgccttaagggcttatgtaatttacttttcagtttgcaatacttacaatagtttataccagctacagtcatgactgaacattgttggtccactctatgatgtacatgctcagtttatctttttacgccctggaaatttgtttctgcgttctgatttgggaccactctcaaaagttgtctatttgtctttcaacatctgtacaaatacacagtacatgttttaatatctgtgtggtaagaagtactgccacaaggcataatgtatcaacatgtcttcctgtaatattagtcacctgactaaacataagtaatccacaagtcactgttcttcataatggcaacaaagaaaagcctgtaaaatataggtgaagaaaagtatcaattgatagaacaaccaggtgacaaataacaagtgcatgtattgctttgctgctttacacatacttttacactgtagcaattatgctgtgatgcttgattctgaaagtttttgtccttttgacagtgagactcataatctaaagaaggaaactatcgaggatcagtatgagctggtaagtcttgagtgcactttctcgatattgattcattgttttctactcactgctttcttgggcaggttaaaaaaagaacatcaaatgcaaataagttaaatgagggctctcatgtcatggaatatggtgacaagacattcaaggatgagaagctcttcctctatcaaggttttaatcctgcaaatggcaacatcacaaatgaattgatttggccagtaccaaaggctacagtcaatcaaagagatgccgatcttcttttcatgtggaagagggtaaattctagctgtcttcagtttattcatttccgtccttcctttctttagaagtccaaattgtatgtatataatactgagttgtcgtaaactagggttcttccactactataagttggtcggcgaatattaatataaaactagcatgttaactgaaacatgatcacacacaagttacatactttggatgaaacatatagattatgatttttattttcctttttcttgctgccgaatagaatggacagaggcatggccccttgatgcattgacatatattgcattctgacattatgttgttaggataatggtgttgaatttgctagagtagtttctttcatgttgatttggttgacatcgcctgtaagaattggcatcattatctctgcatcattatctcttttattgttaactggggctctcttgtttagttctgatctttattttctactagaacaaatgcccgtgtgttgcaacgggtgaaggctattttaatcttattattgtatacggtttaactaaggtgaaattgactgtgggaatttgattggatattttcttttttaagaaaatcatgagctgcaattaggagtctgcatgcaagattttttaaagagatttcttatacgactccttatgtatttctaaaagcaaacgaacttaaaatccaactcaaacacggatttgtatttccaaaagcgaacggactttgaaaaccgactcaaacacggatgacgtactaaaataccggcaaaaacatcttcaatttttataatagtagagattgctcatgaccttggatatttattctatggacacttcaccctttcttgcctctacttgtgtatggaaataatggaatacatttcatatttgaaagggtatagtgtgatatgcttcgtatttaaaaaggccatcacatggtgtacgtgtgacagctgatagcatgatactatgtgagctccatttccgagaacaggactaagttaagatgtctgaatttttaagccagaaatattttcagagcatatgacagtttcatgctaatgtctgtatttactttttcagtatgagcagttgaatggggtgtctgaagacaagctgagggctcttagggagatagaagacaccatagcacacaggaagcatcttgacagcagtatcgatttcatcgggaagcttgtgtttggttttgaaaatgggcctttagcccttgaggctgcaagaagctctggtcaaccattagtcgacaactgggattgtttgaagaagatggtgagtacaaggctcttttttttaactctgatataagccatctataaatatttcttgagttattgtcttcttgttgcctgttggccttaattgcacaatgctatccttggttcattgccaattgtcaggtgcgaatttttgaatctcaatgtggatcactcactcagtatggcat

SEQ ID NO: 57254 - DNA, 18372 bp, Oryza sativa
  unsure (1)..(18372): unsure at all n locations
aggtgcgaatttttgaatctcaatgtggatcactcactcagtatggcatgaaatacatgagagcatttgcaaacatatgcaacaacggtgtctctgaggccaaaatgatggaagcaagtatcaacgcttgcggccgttacaactcggcgagatggagcccaatgactgaaggaggacacagtgcttgatccccggctatatacaggtaaaattgaataccaaaggccccggaggtttgcagacctcatttgtgtgaacttctgtatataccatggagacaacaatatagctagcgacccaacaatatggccccttgtgtgatggctaatcagtaggtgtcatatgcttgttgtacccaacaatatggcttgtgtgtgatgtggccctctgtaaattactcgattagcaatcgatccaagaatgattatgaccaaatatgtgcatgatgttgtcttcagacttgataataaacaagtaggccaattattagtggacgaaaaaacgatgacccaaagtaaggtagtgctgctccgatagccctaccaagatctcgcttacatatctattgctggaaaaatgatattacaagcgatatgaagctcttgccaacgtcatgcaagcgaagctctctttacaagtcattctcagtttctcacacagaatgcgaggactgaaactgaaactccttccagacatcaaacgaagctagcctgcagtttagagtgatacatcatgtttatatcaggttagtgaagcttgcatatggaatgaaagataacgtgccagaggagcagatacagagattctcctactaatttatgatctagtagtggtctctccaaagacaacaaaacagagaggatttccaagtcaaggggcttacatgattttctaaggaaagagatgaacaccacgaggatcgccagccctgccaagatgcctacgattattgccacagtccgcccgacgtcatcttgcgaataatctgcagcacaaagcctactattatcaccagaatccaaaggaaatcagacagagattagagtagcacggcacatatgtacaggactacaaaaagcagagtcacttgcagagtgcccctttccgttttgtttatcgcgaatatattcagcatgggaagtggttgagtggctaaggcgctaagctaagcttatcagccgccgctcgccgtcctaaataaatttgatatgcttagattgattggaattttgtttagtggccatcactgggtcagagaacccctttctaatcggtatatccagtacaagaaaagcagtggacaattatctagcttacggtttaagcactgtcctgtaggaagctctttgcatccctgcacaagagacgttgaaggaaatacgaatctcaggatatttaacaagtcagctctgttggatcagagagaataatttgcattgttagtttgttactgtcccttgacatcaacttttcagtactagaatcatctttattactcttcctttttctaggatcggaaagaatagccccttttgttactgccacttgatcatctggtattctgattaatgctgatgtcccaccaaagtgagtctaatgatactgtcatttgcatgcagtccaccagaaaagccgaggtgattagccgtgcaaattttattagagtaaatttacaanacaacttgtgttttatggttcaagttacagaaaaccacacatattttgacacttggcacttaagtacatatattttagtagtttaatttcacaaaatcacactatcgatgaatgaattcacctgtgagatgatgtggttgttccatctaggatgaggacgtggttgttccacactcgaagatgacatgtcctcgtcttaggtgaaacagtcacgtcatctcgcgggtgaatccattcattgatagtgtggttttgtaaaactacactaccaaaatatatgtacttaagtgccaagtgtcaaaatgtgtgtggttttctgcaacttagactataaaacgtgtagttttgtgaaatttactcttttctttattgcaggaaaatgactgaactgtgtcgttggagcttcctgcatatatgacactgacactgtaacttagatataagtctgtaagttatggggggttgttggcttacaggcagtagtctatagccagcaagctaaattttggtttgtcagtagcgtggctgccttcaatcaagtgattgctctcgtccttagctgagcaagctgagcaatttgatcgatagccataggtggctaaataaatttaactatatgtagtttacccattctaccttatctctctatcaactttggtaagtttacccattgcccatcggaatcaattcccgtcacaacttgctcagctaaggactctccatactgtactttacacggttaaacttacaccatctaaccgagatagcttaggacaattggcaacttgcaaatggtaagcttgatcacttgatcaggataggttgctggagaattggttcgggttcttgctctctgaaacgcaaggctgaaaaattcttattcgtgttgcactattgggcgtaccttgtgacgggcggaagtagaagccgttggcccagtacctgacgtagcactgcgcgaggtacacgtcggcggccagcgacgtgccgcaggtgcccttgagctggccgaccgcctgcgcaaggcacgtcgtgcagtcgccggcggcgaggtcgccgaggcactgcgacacaccctgcacgttgccggagctgctcaccttgtacccgttggcgaggccgccctggagcgcggcgaggacggcgtcccggttcttgaggaagtcgccgtcgccgctggtgctggtgctgcacttgcggtacaccatggcgttgtcgggctggccgacgaagttgctgctgtcgtagcgcacgtagcacccctccagctgcagcgacgccgcgtacgcggcggcgcacacctcgttgagctgccccacggcgtcccgcacgcacgccgcgcagtcggcgttgcccaggtcgccgcggcactggtacagcccgtacgccgccgcgccgtccccggtgccgttgctcccggccgtgaagctgttgtacccgccgttgggcgccgcgttggcgatggaggcgaggagcgagttgaggttgccctcgaacggcgtgcccggctggtacttggacggcgagcacccggcgtagatgaacgtgccggtggccgcctcggcgaccgtcgcgccgatcacgacgagcacgacgacggcgtagcaaagccggtcgagctgatgcatgactgaactgacggctctcgcgctagctagctgctggcttgaagcgcgctacgcaacgcccaggcttggctgggtcgaagcaaagcggcgaatgcttttttccgagtccctgtcgcgagagcgaagagaaggtggtggggagcacccagaataaatgcgagctttttagttaagctaacgcttcctcgatggtctgtggtggtgcgcgcgcgcggcgtctctggaatttatacgtcgactcgacacggcgatgcatcctccttgcaccggttggacctcgtagcggttggtcgggtgactctggtcagtggtctactggctttggtccctcccgataactatgctctgaatgattgcttcggtacattcagttatccttgtgctgtaccagattggggtaagacggtatgggcagtgacaggatgcaacctatcataatctgtggcatatggtctgaagataaccaatgccgtttcgacgagtgcactcgagcaataggctgtttgactgaatgctctgcctcttcagtctagactgggaatccgggatacggggatgggaacaggattttgagtatttttgcttcgccaataagcaactgccatttccacacaggcatacagctgatttcatcgcggctcctgcaggctgcggcccttttcacttgggtgcggttgcgtccgtggctggtacggatgatacctttgtaattctgtattccagccaacaagctcgcaaccctaaagttgacatgaaggggtcctttgctgcacacaaactaacgtggtagcgaacgtgtagcttccaaaagtgtaataagcgaatttgttttgggaagatttaccccctgccaagtgccaaccgagagagctagattcgtggagataaaaagaggaacgcgtgaaggtgaaactgtgaaagggcccgactttgcgcgccgaggtttcattcgggcgcgcaacagctgtgggcgagagcgaccggaccggtgtctcgcgtcaatgcgtcatatggccaccacccgcgtcttttcagctcctctactagtacctcacggctcacgctcccgaacgttctcttcaggcacagtaacggcaaggcccacctgcgtgcggcggaggatgaccagcatacgccgcggccatgcattcgctcgggcggacgcgcgagaattccggcctcgtttcggccctgccgcgcgtcgcgttgcggactagcggttatgctgccgcgcgcgccaggcgccaccaacaccgacacgggcctcatcgatcggtactgcaggtgcaacccggggatgctgcgtatgcgcgtcgttgcaaggtctcgtcgcccggtcgggggattgtctttggtcggtccaatgaagtaatgaacggccagtttcacgagagctcagcaagtctccatcaccacctagtcgtattatttggcacttcttcttgggtacttcagatgccaccacctgtacggtgcgtcggagctcggaggtgggcgcatcaaagaccgcattcggttagaaacggtggacttaggacaacctcctctacaaatactccctccgtttcaaaataagtgcagttttgcactattcacgttcaacatttgaccgtccgttttatttaaaaatcttttatgattagtatttttattgctattagatgataaaacatgaatagtactttatgtgtgactaaatgtttttaattttttcataaatttttcaaataagacggacggtcaaatgttaaacgtgaatagtgcaaaactgcacttattttgggacggaggtagtacaatgtttcgacgatctagggaaagttttatttctattaaggcccggtttagttcccaactttttctttaaaattccaacttttccaccacatcaaaagttttctacacatataaacttccaacttttttcttcaaacttctaactttagtcaaactttcaattttggcgtggaactaaacacgcccttaagcgatcgctttaagtcagggtcggatccaaaaatagattaagacacaagacgctccataaaaatgttggccaaacacaaatatacatggtgaaaaagtgaaaacatataagtccttgatgggtcttccatccttgtcttaagccaatcgcttgtggaaacaatggtataagcgtttttggcaaaagattcgatgccgtaaattctaacagctgatgttgcatcggtgcatgaatgtggacagaaataatcttggccaggctaggctcttgccctaaatcacacggttgcggtatttttctctctcggaagatgttcaatctgactctttcaactataggtcgagtctaatccatattaaaaaaaagatggatataattactcatccaagtattaaaattgtgtaaaataattttcttgtcaatattaaatggtggttttcactgatgtggcatctacatggtatgttggtatggtctgtgtgctacgtaccgcttacatgaaatcatactcaacaaaaaaaaaaaggacccacatgccccttctcacgcggctcccctcccctctccctcggctccagcatgacacccccactagcttgcagcattgacaacggcaattgcctcctccgctccgagcggctgtcttgcactacctctttcttgtcctcctctcatcgcataacgacgggtgccgtaccttaggaagaagatgtggcgcgggagaagggaggggttgtttgatgacattttgtcattctatactaagcaagcaagattatttagctaagaagctagcttgttgtttttgcatgaaatgcatgggccatgcagactgtgcacgtattggtgtatatatgcctatctagccaaccatatatatggcccatatgcattctgctatatatgcatgaaccagcaaacaatgattcgaacgatatataagcagcttatacgtgagcactcgtggccgtacgcctatagtatacgtatacgtgtatgtataccaaataatcctccctaggattaaaccaacggcaagcaaaggctagtacatgggctgtatatgggccggtggatcaatgctgcatgctcatcgtacatatgcggctggataaccacgcgtacacacgtacgtgggcaggatttctcgccaacggcaagttactgatgcggagataacgtcagtcttatccggtcatctcgatctgcagcaactgaacccggaagagccggatcgatctaacgctcggccgcggcggcgccgagggattcgtagtgtgggttagggctccctgcgcctataaaaggagaccatcactcactacacaggagacgcacacagccatttcactctcttcacacagccatctcagtcatctcgacgcagccatttcactcctctcttctcacacactcactgacgtagcctcgccggagcagccgagtgggatcggctcgacgggaggagactccgtcaggaacaggagtggtgcacgtcgacggctgctcggcggctggaaggagaactcaccggcgataggagtcggcgtcagatcgcaggcgtcaacaacttttgtacgatgggtgagaattctgtgattttcttgttgattcttcttttgcagttcacgcatgcatgagatggcgacgagacgagaatgccggagcaccgctgcacggcgcccgcacgccgtcgttgagtctgccgagtcatgcaagagctgttcgccggaccggggagcaagccgccgtccgttgtcttgtccggacgaagggcctcgtcatgctacctcgccggaatacgctgcctcaacatcgcgaacgccgcccgcagaaccatgacgcctccctcgccggagtcgccgtgccaaacgtctcgccgaccgtcttcggcggtgttgtcatcttcctcacgccgttgcgccgccggaacacgggatatcctcgtctggccggtggcgacctctacctcacagcgccttcatcggtgcgcgccgtcatcctcctcacgcgcgctgtcgtcgagtccggacgtgccatcctccacctcgtcgaggtttgctgggttaacccggagaaggccatctccgtgccgtcttgctgtcatgccccgaactagtaccgaccggaactagcccgtgacgctccaaattaacctgttgatcgataccagtcccagaaaacagtgctggtatcacagggagacagaatatcacagtaacagaggtctctttattatagagtagatgtacagtcatgttgggctgcggacagatcccgagctcacaactgcattacaaaagaaaagtggaagccaggacttggaccaaataacacaggcgcgacttgggaactaggccgaaaccctaaaactcatcgtagccggcttgctcctggaagaactcctcatcagcaggatccgcttcatcttcttcagcaactggggggggggaattatttatatagagcaagggtgagtacgggagtactcagcaagccatgggaaataagtgtttaatgcaggcttcaaggaaaggctgatgtttttgcaattaattttatttgaactcttttctgaaacaactaagtaagtgcttctcaaacgacacggatgagacagtgcgtctcgtccggtcggagtatgtgcaatgtatcagtctttagaatttaaacaaggttggcacccggccaacagcttttacaacggccacccgggccaacaacttttcaaacggccacccgggcctagctgatcccatcagctacagatttttcaaacaccgaaccccttttcacacagcaatttcacaagcagtagtcaaaccaaactacgctaggaatcacctcacatccgcccatgactgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacgggacaacagattatgtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcaaaaatgaagccctaataatgacctctaagcgtgccattagatagatctcgagatttgaggaattttggaagttgaacggagtcaaacggatctaaggttaggaagatattgaatttctaagattattagatttttgtctaaaggaaaaggatttaattaaatccttttttggaaaaaaaaagaaaagaaaagagggagggattatagacttttcctcgggcggctaaggcgcggcccaagggaattggagcggaccggccgagttaaatgggccggccggcctaaggcggcccaagtgcgcgcgcgcgcgggaggggaggagagagagagagccggtggactgggctcactacgcgtggtcccgggtgggacccgcttgtcagcggctcggctcaccgtgcggagggagcatgcggcgcggcgctagggtgaggtgtggggcgcggtgcacgcgcgcggttcgcggaggacgcggatgcggcgggcccacgtgcagccttacggcttgcggtggaccgcgcgcacggggaagggctgatcggggtcggcccgacccgatctcggccgagctggcgccgacgtggcgcctacgtggctgccacgcgggccggcgggaggtagacgacgacccggccgcgaatggacggcgggtggcggcggcgagcggcagagcgaaccacggcgatacggacaaaagcgagcacaccgggcggttgctcgtgatgaggggggacgagccaacggctcggattcgccggaggatgctcgacggcggcggattgcggtggcgtcaaccggtggggagggaagagggaaacagcggcgaggtcacgagaggtcgattcctggcggtgagagcatctacgcggcttcgggaactcgacgctagcgtcggattgggcggaactacgccgagcgaggccggcgacgagcgggtgctacggagctcgggcggcgacggcggcgagcacacggcgagcgatggcaacggtcggggcggcgccggctaactacggggagtctactcaagctactaccgaaagctagggggaggagatggagcgaggaggaagaacggagagaggcactaccgtgcgggacggggcgcagtgacgagaggccgacggcgctggagtgatctctccggcctcgggccgaggaagaggaagaagagggcgcgcccggagtccccttccgcgtccacgaacgcaccggctctcccggcgcttggcgatggacggcggaggcgaggcagagcacgggagcgacgacaacggtgaggaggcgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaggtgacgccggcgagaggggaaaaaggggagaaaaagaggaaaaggagggagagaaagggggctcacccctttgccgattccggaaaaggaggagggagcggggcgactcggcagagggagaggggctctctgcctccgccccttggaggctagcgcgcggaggggcgggggccgggcgatgaccacggcgatgacggcggggcggtttggaccggcgcgacgacacgggcgacaggcgcgggctggtgcggcaaagggtgacggcggcggcgaccgggcggtcggccactcggcacgcgcgcgcgggaaacaacgggcggcgtggctgggcagcgggaccgggcgacgcggacggcgcaaacgacgcggctcgggcgggaaaccacgcgggcgcgcgcgcgagcgacggcgcgcggggccggctttgcgagcggggagctcgcgcgagaggagggggcgctcggcgcggctctcgcacgcgcgagcagcgagcggggggggaaacgcgccggggaaagcgagagagagagagagagagagagagagagagagggagcgcccgggagagagggggccggggaagagatgggccgagcggaattcggcccatcgagccacgacaagcaagacactagacaacaagcaaagaaacaaatttcgcaattagggtttttaagagataattttttcccgctaggcgccacgacggaacgagcactacagaccaacccccctaacaagaatctcgaccccgagattcagcacctaagggagcagctccgggaactcggcgcggagaagatcttcttgctcccaggttgcctcatcttcagaatgattgctccattggactttgtagaacttgatggtcttccttcgagtttgacgttctgcctcttcaagaaccttgatcggtctttccttgtaggttagattcttttccagctcgatattacccaggggaacttgctcttctggaactcgaagacatttctttaactgggatacgtggaacacgttgtgcacatatgcgagaccttcaggtagctcaagctgataagccacttcgccacgtctggcggttatgaggtaggggccgatgtagcggggtgctaacttgccggacatcccaaaccttctcataccacggaggggtgatacccgcaggtacacatgatctcctttttcgaactcaaggtcacgccttggattgtcagcgtaatttttctgacggttctgcgctatctttaaacgtttcccgattagcttaacttgttcttctgctgccttgagtatgtcaggaccgaataccagcgcttcgcccacctcattccagcacaagggagtgcggcactttctcccgaacattgcctcattcggcgacatctgaatactggcctgataactgttgttgtatgagaactccgcatacggcaaacaacgatcccaagtgccttcgaaatccagggcacacgctcatagcatgtcttctaggatttggtttactctttctgtctgaccatcggtctgcggatggtaggctgtactaaaatttagatcggttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacatctcgcttcattccagcccaccagaagtatgccttgatatcttggtacatcttcgtacttcctgggtgaatggagtaggcggactcatgagcttcctttaggatgagatctcttaactccttcttggccggtacacagatgcgtggtccgcaccaaactgtgccttgatcgtctatggagaaatttgtgtctttcttctcctgtattctttttattaattcttttatcccttcgtcgtctttctgagcctcccggatttgcgactctagggtaggctgtactgtcaagctggcagggacacctgactgtaccacggtcagtcttaacttctccaattctctgcacagatgatcttggtcaggccgtatttgagctacattgcaataggccttgcgacttagcgcatcagcgaccacgttggctttaccaggatgataatggattccaagatcgtaatccttgattagttccaaccatcttctctgcctcatatttaactcggtctgagtgaagatgtacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacaaaagatctcgaaatcttttcggatatctggcaaggtgagaactgaggcagtggtcaaccttttcttcatttcttgaaagctgtcttcacaggctgcagaccattgaaatttcttttccttctttaacagctcggtcataggtctgactagcttagagaatccttcaatgaatcttcgataatatccagctaagccaaggaagctgcggatctctgacacattcttgggcgggttccaagcaagtacagcttcaaccttgctgggatctacttcgacaccgttggaggagatcacgtgtccaagaaatgctactcggtctaaccagaattcacatttcgagaatttagcgaatagttgatgatctctgagcttttccattatcagcctcaggtgttcagcatgttcttcctcattcttggagtatatcaggatgtcatcgatgaacaccacgacaaattggtccaggtattccataaagattttgttcattaagttcatgaagaacactggagcattggtgagtccgaaggacattactgtgaactcgtatggaccataacgcgttgagaaagcggtcttcggaatatcttcagacctgattttcagttggtggtaacctgatctcaagtcaattttagagaaaactcttgctcctttaagttgatcgaacaaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactttccagctcttcgatttgtcttttaacttctgctaactcattagctgccattcggtatggtctttttgcaattggtgcagtgcctggtgccagttctatggcgaactcaatctctcggtctggtggcatactcgttaattcttctggaaatacgtcgggatattcacagactatgggtaccgactccaaggaggtgacttgtaaacaggttaggatagaccgacttacggtaggggtgttaggggtaaagcggacttgctttcctccaggtccttgcaatgtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttgacagagaacatacccatcacaacgtctggagcatcctgagcggtttcagcttgaatgtgattcacacggcctcgaccaaagttgttggaagcacgtgaaccttgtccacttgcctgagagctaggacgagactgagttgccgctggagtaggagttctggcagtgctgccattagcatgccctgagttggtgttggtaggattctgaggacactgtctagcatagtgacccatctggttgcaccggaaacactgaactgctgacggtccctgcggtgacttgaaagaggtaacgctgttaggcgcagtattgccactaggggcacgctgctgtggctgaggtgccggacggtttatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctttcaagaatttcctgatcttcttcttgtctgtgtccacttcctcaggggcgtaccgagccaacttgttgaactgacttaggtactcattgatactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattctcccaccaatctgctgcaggtcctcttagctggtgagaggcgtagagcgtcttctcaaccggagtacactgcactaagttgagttttctatcaacatctttcagccaatcgtcagcctcgacgggctcgacggtctgagagaattctggcggacgagacctcagaaaatctgtcagcttggacctattgttgctcatgtgagggtggccatttccatgcgcattatgctgaaaaccggctacgactgcggctaatccttgcaagatttgtgtctgaactgccattaagtgttgcatgttgttttccacatgaggtggggaagggaggcgttcttctccagaattgtgactggcagtgcggtgagagcggtgagactgttccatctctgcatcacgggaagctgtgcgatgcgagcggttgctgcggcggggttgctcaacttctgcattgcgggaagcagtacggtgtgaacggttgctgtggtgagactacacattagctgactcatgatttgcttccggctcggttctaccatcttcaaaaccaaagcgggctggtgcacgagctgcacggcgggggcggctagccatctaaactcccagaaaagggcgggggaagagtcagataagcacttaggagggcaaggagcaaagtaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacgcccacaacaaactcacgcacgcactacctcgcgacgactccaaaagagttggcggcggaacaaaagggcctaacacacggacggctgctgaagactgcctcctctactcctcgtcggcctggctacctccagtagtcggctcctcagtcgaagaaacgtcgatcggctgacgcgaagggatcggcggaacctgtcgagggccggcagcagcacgggccgctggcggtaggggagctgggtagtggaaacggaacacggtggaagaaccaacaacacgcttccgcgcggtgcggataaagcgtgggccacggcgggaggaagcaagtggggtgtgtccgggggtgtaggaagggctaactgggtgcgggtagggggagtacactggtgagtacggcgcacgcgagctgggggagcgcgggccactgggagtgcgggcagagccgcgggagctgtgggaggacaggtggctggcgtggcagaggcggcctgactcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccatgcgagtcagtactggctgagactcgctgtacggacaagggtacctggcgtctgagtggccagagggaaggcgtggaagctgccggaaggcggaacctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacatagagagctcacagtgagggggaacacggtccacggagtaccccgtgtactcgggacacgacaagccaaggaaacgggcgaggtcacgaagctgagcgacgtggtgaccctcaccaaaatcgtgggaactgaagctggcgttcactgccatctacaattttgaaagagggagaaagatcagtaactgttttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagtcccgaccggaactagcccgtgacgccccaaattaacctgttaatcgataccagtcccaggaaacagtgctggtatcacagggagacagagtatcacagcaacagaggtctctttattatagagtagaagtacagtcatgttgggctgcggacagatcccaagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactaggggggttatttatatagagcaagggtgagtacgggagtactcagcaagccaggggaaataagtgtttaatgcaggcttcaaggaaaggatgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacctgggccaacaacttttcaaacggccacccgggcctagctgatcccgtcagctgctgatttttcaaacatcgaacccagtttcacacaacaatttcacaagcagtagtcaaaccaaactacgctaggaatcacctcacatccgcccatgaccgtgggcacggctgttcgaacagtttgttaacctctgcagaggggggtacactttacccacacgacattactaaccaggatcacccagcccgtggggatcagccacgtcgggagacctccaagctttcatgacaaggcatttcgaaagccgatacaggtttaccatatgccgacgagaggggtcccagaccaacaacaggttatgtcccagaccatactgtgccaggaagccca

SEQ ID NO: 57255 - DNA, 737 bp, Oryza sativa
ggggaagatgggccgagggaaaatcggcccatcgaacccgggggaggcaaaatagacttttgcggaggaatttgatttggagggaattggattcggaattgaactcgacgatagatcggggattgagatcttgagatggcacggacactagacaacaatcagagaaacaaatttcgcaattagggtttttaagagataattttttcccgctaggcgccacgacggaacgggcgctacacaagcgggtcccacccgggaccacgtgtggtgagcccagtccaccggctctctctctcctcccctcccgcgcgcgcacttgggccgccttgggccggccggcccatttaactcggccggtccgctccaattcccttgggccgcgccttagccgcccgaggaaaagtctataatccctccctcttttcttttcttttttttccaaaaaaggatttaattaaatccttttcctttagaccaaaaatccaataatcttagaaattcaatatcttcctaaccttcgatccatttgactccgttcaacttccaaaattcctcaaatctcgagatctatctaatggcacgcttagaggtcattattagggcttcattttcgccgtttgttgagttgtcccgtttcgcgtgtagtttcggagcccgaagacccgcagtgcgatgatttcgaggatcaagctccagatctcgagcaaggcaagccacctttgaacatcttgagccta

SEQ ID NO: 57256 - DNA, 983 bp, Oryza sativa
gactccaagaaggtgacttgtaaccaggttaggatagaccgactttcggtaggggtgttagaggtaaacggacttgctttcctccaggtcctggcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatacttgagttgcccttatattcctcccaggggaatgtactatcattggtaaacgtaaattttgggttttccaaccatttcttttcacaaaagcttgtgatatgaaagaataggaagctcctgaatcaaacagaactatcgcgggtacggagttgacagagaacatacccatcacaacgtctggagcatcctgagcggtttcagcttgaatgtgattcacccagccccgaccaaagttgttggaagcacgtgaaccttgtccacttgcctgagagctaggacgagatggagctaccgcgggagtaggagttctggcagtgctgccattcgcatgccctgagttggtgttggtaggattctgagggcactgtctggcatagtgacccgtctggttgcaccggaaacactgaactgttgacggtccctgcggtgacttgaaagaggtaacactgtttggcgcagtattgccactaggggcacgctgctgtggctgaggtgccggacggttcatctgaggacgaggggtatagcctggctggcggttagcttgagtgaccgactggtggtattgcatgggttgaccgtagcgagggcgaggtgcgcctcgggaggaatttccctgatggatagacttgcgtttcttgtattcttcggtagcctcttttccggcattctcaagtagaagtgcgttgttgatcatatgttgaaaagtggggaagtcatgagcaagcaagtggagt

SEQ ID NO: 57257 - DNA, 6753 bp, Oryza sativa
  unsure (1)..(6753): unsure at all n locations
taggataataataagcatgtcgtaaagaaaataaagatctacactgcatcaaatataagtacaaacccgtgtgtaatccaagtactcgagtttcagtagacagttaaatctaacttctctacaaaccccagaagtatgttcaatttttcagtggaacatgagaattattctgaaaagtctacaggaaatgaataatttctgatttgaaagttaaacatgctaatatgctatgagtgcctttcaattcaaatcctcagagggagccttggaaatcatatgatccatttgcttttgtgtagtattccaactacatatagaaatgacaacacataacataaagagtgcggactaggtatttttttacagaaatgctacaggacagtatcccgttcggacgggatgatacccggtaggtatcaggtgatacttgtgaagtatcacgtgatacttgatacctaactgatattgtaccgtctgaacgggataccgttatatagcaaccccttttttaagaaagtgcaaataatcgcattggacagctcttaatccattttttgggggttatatgtgagaatcaacaagtgcaccctctggccagttctggactgttattttccgcctaacataaactgtccccttaatattactgattaatctatgtgaaatatatggcctgtgagaaagatactgttctgtcgaaggccccaggaccctatatttaattgttggggaataggttcattggttattgtttaataaggctataaatggttgattattgttcatatttccttatagttacttcccttatgcttggacagatttaacacaaaggcaatctttagtgcaaagcaaaagaatgatttacttgctatgttttctgccacgtagtttacttttttagcgtcttaccatgttgcttaagcattgttatgggaagtactgcaatttagaaaatactatccaaatcatgaaaacaaattgtaagctggctagctaacgtctaattataatctttaatgcaaataatatgtagcacctcaaatgagtgctgctgtttggtcatgctgaaacagaggtgtgatttcgacattaacctttgttaacctctatgaggcaggctttggtaaagagactggatctccaatacaaaaggagaagtttcttcccatattggcgatcagctttaagtttcgggtttcctgtgacgatctatccatcatactcatatgatgataagcatcatcgtgatctggaaccattcatctataaacgtgaatcgagggacaaaggatcatctccagctccaaaccataacactggccttttggcaagcttgcggcaacccacaaccaattatcaattgacaaggcaatttggtactgctgcattaataaccaatcatcaaacaaagaggctatttggcacggctgcattgacgctcttgaaagtcttgaagaaagcatgaatgaaaaggtatgccatgagttctgttttctatctgcatataacataactttcgtggtgtatataactgaaaaggtatggtgttgggggacgggaagagcatcttcttctggtcttctggacagacgactggaccggatgccaattctatngcttccgatgggggttccatcctgaaccggatgccaattatatgctcttacgtcaaaaacatggaaaggacagttcactccaagtttattttatttttaaaataagatagaaaatatgtaaatttatagctgttaagccaaatatttttattgagaaaaatattatatattttactttatgcagtcaaatttgtttctaagccatccggatgtattggatctgatattattaaatacaaactctagatgtttctgtatcgtttatttaatagccgctgcaatgcgaagtaaatgaacctgtaatagaagggtaaatgaagctcacggatagaaccctcctatatgtcaaatattcttattaactgttgaggaggaaacatcatgtgtgtttttcatagtatgccaagcacaattttgcagtgtttttctttcaaaatgtagctatcgtagtcttagtgaatagaagatagttgttgtacatatgggatcttacgagggtgaaatattctttaaaaattggaaggcatgttgacatttacaatcatcacatttcaaactcatttgacatcagtgtaagtttgagttgatgttattttatttcccgttgcacgcacgggcacccaagttgatgttattttatttcccgttgcacgcacgggcacccaattagtaactaaaaaggtgtggtgttgggggacgggaagagcatcttcttgtggagagacgacttgcttccggatggaggttccatcctgaactgtgaactggacgccaaaaacaagggaaggacagtttacacagtgctgcacgaggatgctagaccggcgacatctccaagtctgggacttgatcaccaccgtcaccctgaaccctactcaaccgaatgcatactattggaagcctgctgcggatggagttttctcggtgaaaacggcctattccctcctctgtgccgcgaagatgcggtcagtggtcggaaggcttgtttgacggcggacaacctccagtggtggggttggcatctggcctcgttctgccacctctgtgggaacgatgcggaatcttgcgcccacatcttccacgcctgcgattacacgaagtaggtatgggcgtaggttagaagtcgcttgggcattgcctgtgacacatcctctggtgacatactgagctggtggtgcgaggcacgtaaatcggttcacaagacggatcgaaagccatttgatgcgggagttatcctggtgacgtggttagtttggaaggaacggaatgcacaggtgttcgatggaaaggccacttcagcggtgcatctttgtgctaccatcgctgacaagtgggaaacatggaaagccactggtttgctgtgcgcgatctattacggttagatagccgagagtccctcatgtgcctctagtgtgttcttagggtgttccgctacggcggttagttgtagcctcagccattctcggctcagggtgttctgtaaagattctcttcttcctaatatacatctcggccggttctttgccggcccggtgaaaaaaaggtatggtatcaccttgaacttatcaagatagtttaagcatagttgaattttaaagttaggaattctattgttgcgtccttttcccctcttgtcaaactgaacatgtggatgaccgtaacctcattttatgtttttgccctcccatttgcgcaggttccaagcaagttgtgctatcactgttttctgcaagttctttttttggtgcatgattgtcgagatccaacctggtctgctgggtttgtgcttttttttttttggtgtgcctgataccgcaacttcgcatgggactaaacatcggccttagcatgcatgttaagctcatgaccccctcgcgcggagcttgggcaggagccggcggtagtggcggaggtagggaggtgagcaggagacgtactaggaagaccggcgaacgacggcaacgaggacttcagcctcacccatctcggtctcgctaaaaccgaagatcattgagtatcgatgcaatttgattagtccagcgatgttggtttaggatgtccggcaatgtacattggttttataatgctaaaaaagatttttataatttagtaatcttgaaattcgtagttaataaatattgagttttagggtccgtttatttgtacgaaaaacataagaatttcggaggattttaatcatataaaaaacattcctatgaaatcttacgaaacaaacaatttaattctatcatatccttattataattctatggaatggataatcctatagaaatttcggagaatagttagtgagaggtctaaactcttggaaaaattcccttgaatctctatcatccgattcatatgtttttcaatactttattttacacatatccctaacagaatcctaatgttttttctattcctacattttctcatttctgctattttatgttttacacatatatctatcaaaatcttgtgtttaacatgttcctctatttttttcattcctgctatttaaagggacccttacttggtttggagtcttagttgtggttttaccatgttttaataagtttgaaattctaaattaataaaatttgactctattcagtttagagtctcaattataattttgacatgatttactgaatctaaaattttgtaataattaataatatcaagttgtactcggttggagtctcgattatagaccttttatgatttcataattttgaacttaataattaactagatctgggattgggaggagacggaggggattgggaagaggagacgcagcggcggcgacaatggggaggaggcacggaacgacacgtgctgtctccgcctctctccggatggaattggaaggaaaggtgatttttcctccagtaggacaaggatagggacatggaagggccttttttttaaaaaaaaaacttcttgaaggatcaaggagatgttttgtcaattgacggatcggatggctagtaactaccgaatgaagaatcagacggtccatgtgttcctgatgacatggctcattgtttttttttcactattttagatatttatgaacttgtcataagcttataacccataatggatgggcttgaaatgtagcccatgatgttaaaagtaaatctattatcatcgcactatggcatttaatcaacaagttagatttttttttaacttgaagacttctagaaaatgctttaattagaatagagatatagcagaaagttagacagagatatctacatcagtgaaaaggggatcccaagatcccaccaggatgagccacatcatcaaataaatatgaaccgttggatgcatgatttgaatgaagagaaccgttggatcaaaagagagaaaaataagttaaaaaaaaaaccaaatagtgtcttgggatgttctagtcccttcaagcacattccataaaatgtgtgataacaaatatatgagaatgaaaaatatcttcaaaattatccttaataatcaccaatgagtattcaaagtaattctactgtatcaataataaaagtatccgtgtaaatataaatagctacataatctaatactatcgattacttcactacagattaaaattaaaaaaacatgtgacatggacgatataataaattttgtaaagttgacttaaatcatatgattataagatttacgataaaatagcgtataaatacttctcaactggtgatgacagaattgcaacgcataagaaatgtgactatttacattactattacaattgacgcatttagatattgtaaaaggcaatggtcgcggtaatatatgataaattatttgtttacgatgatattcttaatgacaaatcaagatatataaatccattaatgttatagttacacttttgaaataatatgttaaaagcatattcattattaattataattaagaatttatgtccactaacataaacaatatataaatatatttaatagatggagaggtcatagtcgtcgtgtgaacccacgacttaagatgctagtatagatagatagttcatgaataactcaaccaaaagtaggtcctgcatcgccgttccggtagagaagagaagacaggcaaattagatattttgggcctggacgtttgtcagcatagccagatagtttttaaaggaatttattgactaagtgagtgtatctcaactgtttactgtttagattctggtgtaaaaccaatttatccggattcaagttttaaacttgacacaagtacttgcttttacggttaattattttttcagtgggaaacaataggcgcccgtggtgacgaccgtaatgaccgtggtgacttcattatttcaagatatggatgttcgtaaagatagggtgtagccaagtcttttagaggtgttcgtaaagatagagagtgtgtttgtgcgtttataggggtgaatgtgcacacgttgtttttattgtgttgaaaattaaaaaaagaatagcccatcttttcgcttatacttatgcttatcaatcaaaatttgaattttcaactttaaaattggagttgattttaaggtttttttttatcaaagtttattttcagcttttacttttagattgctaagaacacaaatataaaaggtttatttacaaattattatttgtttgtgaatatgttgtttgtcttatacaattagccaaacgatggggtcgtattggactgactgagctaacattggcgtgcattatttcaggtacttgtaaattaagttgaccagtgaagacaatccactcttatttgtacaacgtgtatctgacattgaacccgagcgtagatgccatccatgatctcggtcaaacttcagctattcggctacagtcgtttagtttctgaaattagggagaagtttagagaaagttggtagtttgaaaaaaaaaattgaaagtttatatgagtaagaatgttttagatgtaatgtgatgtgataaaaagttgagagtttgagaaaaatttagtggagagtattaagggatggtcggttgcaggctgctagtcaggagggaaaaagactgaagtacgtttcgtaacaagtttatttttagcatatttattattataaaataaatttattttt

SEQ ID NO: 57258 - DNA, 5572 bp, Oryza sativa
aaagtttaccaaagtatgatataattcaattgtattaagagtagataaggtgtaaaactattgtattgagatttgataaaataaagatattgtattgatatgcgtgggttggatgaacagttaaaacgatggtagcaaatgagagccaagctggaatacatgttcgcaaatgcttttacaatcccagcattgatgtgccaatagaatattgccaaccattatgcgttcgtcaggtgataaatggcctagctagagatagggttcatcactcgtgccaaaacatattactgtgcagctgcgctgagcaattcaattgattggcgttcggtacaccgtgacagctcacgcatcctggattcatctacgccgatccaatccaaacaccaacctccgcagctcacagtgaactgcactgctaggctctgtgcactgcagacagggtgctttctgtttttgagtcctagtaaatgcaaatttgagaaggaagataaatattttttgcaagcatgtgacaggctcgttatgttgattagttgatatgaatacagagtactacacccattctaaaatatagtaatatttgaatagatgaggcatatactacgactctgcaccgagcgacatcgaacctatatgttgatcagtctcgagctctgaatgcatactcactacatctaccgtatgagcacgttggttcagtgcgcctgaaggatgttagcaatgccatgatgttatactgttatacagttctgtatagtggagcgctagatttatatgaatcgttcttgttgcacaccacagtgaatctacggtttgtcaccagctgaacagtttggtagtggtggtagtatcgataggaaactggtcacatctttctttttgaaagagagcaccattgcattggaattttggatctgctttcaaatttgaagaggacttttgaagtttcaaactcaagtgtggattctccgcaacgtatctactgtatgatgcggatccttggcagtagcagagctgagcaaaggaactgttcatcttgatgacattttcaaccataccatttttttttgtcaaagttgcaaaaaaaaatatctacgtttagtttgttgccaaatttgataaatacatgaaaaatcctgtcaaatttttagtaatattgccatcttgctaaaattttagcattgccaaaatttggtaaggtttattttggctacaatctgaatatgcccaaaatctgtcttcctaggcctacacctttcctgcctgacattgcccaattagatcgtcattggtttaattatttagtattccctccgttccaaaaaaaaaatattagatatgccatatgtatgtctagattggtagtgactaggttattttttatgggatgaaagtatttaacactaggtgggatattttctagtataatgtatctggaactctctatcagatactcctacattcattatacaaaaaaatgtttcatctaagattcttactacttcctacattctataatataagcaacttaggacggaatatgacattttatagtacaataaatttagacatatatctgtctagattaattgtcatatgaaatgtttcatccagtcctaaattgttatattatgggacagaaggagtatattttagacatattttctattgttcatccacattttaagtatgatactacctccatcccaaattatatctatttctagcacagtaacttgtattaaaatgaaactatttctccacctaccctcttctctcaaccaatcacaaccattctcttcacctattttctcttctcaaccaatcataacccctccaattaatcatttctacatacttacttaatatacgtgcctaccttaaaatggttaggttatgggacggagtaagtattcggttgttcatccagattttctggatgattccagattttttttttaccacacacgtggaccacaaaactgttgtaatctctgtagcacatcgaaccttgcgctgcctttccctcaggagacaaaccccgccagctcatgctcggctcaccactccacacgtgcgcagctccccatggcccgcttgtacgccacactcatcgctcgacagctcactcatcagcggcaaagctgattaccaccaccactcgatcaatctctcaccggatcagcttgaaaattctggagtttatctgcactgcatctctcgtgcaccagtggttgatcaatgattcttgcatcaaatgtgccaaaggttcgagtttgtttactgcagtttctctgttggtagcaaaaacccgtgtggagacatgtctcgccgtccgagtcgttgccatcggttaatcgttaatcaggttccatacgggcagagcaagacagatttacaagcagaaacacgagaaacaaaacagtaacgtcgcaagaagaacaatcctacagatacatgcatggcagctaccactagtctgtactctgtacacctgagagcttaggacaaatcatactcgatcatcgtaagtccgcaccagcagctcaccggcgcgagagcgtgtcccacaggtccgtacaccggcggcgggcgaagccgacgcgaccggcgtccacgtcgtacaccacctcgaacccctgctgctggaagttgccaagcgtccctgccggaccaccaccgtcttcgccgtcgtcgttgttcccgccgacgttcatcagcatcaggcacccgacgctccgcccctcctcgctcttgaaccccatgaagtagttcctccgcggcagcgccaccgtcgcgttgccacggaagtggagcgccaccggcggcacggcgcggtccgacggggagtagtggtagcagggggcgagccctgtctgggcctccgcgccctcggcgcgcgtgaaccgcgccgcggccatcgcgcgcgcgaactcgtcggccacccgcgcgaacgtgtcgctcggcagcatggtgaacgtcgtgcccgagtccaccaccatcccgccgttgccgtcgcggtccacgtccccgagctcgggctgggcctgtatcctcttcccgcccaccgagacggcttcgagcgccaccgagtagaagtaggggtgcttcgggttgtgcagcagcggcgtgtacacgaagtccgtctcggaggcgccgatcgcggcggcgtccgtgctgcggccgaggatcagcgggcttgaccggatgagccggtcggcgcggaatgagtgggcgacgaggcagtaggaaaacctgccggagagcgacggggcgagctgggccgggagcgagagcgggccgcgcccgaacccggccaccccgacgggctcggcgagcgccgtgtgcgcgcaggcgaaggtgaagttctccacggccatggacgcggccagcccgacgcgtccgcgcctcaggttcgcgacgaggctgccgtccccgtacgcgtagtacagcggcgggcacgcgtgggacgcgcacgagtcggtctcgatcgcgtcgagcgggcaccgcgccgcggcgcacaggtcggaggtgggcgcggaggagtgcgccgcggagcagagcggcgacgcgcaggagatgcggcgggagtcgatcggtggggggagcgggctggagtggttgccaccaggcgtcgccttgccttcgcagagcatgcaggtgaacggcgcgcaggggaaccagacgaggtcgctgccggtgtcgaggaagagcgacacggagctggccgtggaaggcgggccgaccgagagcgacagcgtgtagtcgctccccggcgcgagcggcagcgagagctggcggtgccgtggaggaggaggcgcgcggcgcgtgccgtggcggcggccgcggtggcgcgcggcggaacggagggaggaggagcggaggaggcggtggatggtggcggtgtcattggctgggcggagcgaggagagggtgttggtgagcggcagaagcagcccgtggcattgcagcgaggaggagacgagaagcaagccgaagcagaggaagcagagttggaggcgcatggtgacggggcgctttcgcgcacggtggaatgctcgggtttctggcctcaggccgcgggtttagaaggggtttttgaagcggccgagccggcagcagcatcccggggcgtacgtggggacggttcaaacaaactaaactgtgtatcgcgtgggggaaatccacccggggagagcgcgagccgcacggaggacacgcatgctgcacactcgctcaggcgctcgcgcggcgcgcccgcttggttgcaacttgcaagcggctacgtgacgagacaacgtgtggatttggagtcacgggacggcgagtcactgtgcggatgtgcgcttggacgcgagcgtgtatgcgtgcacaagcgcaaaccgatcgagccggggcggatctttttttctttgcgatagagagccggggcggatcaggacggagcagtacaggcctacagctacagggtagcagagcaagcaggacaaggggacacaggaagctagcgagtggtggcctcggagtgagagtagctggagtagtgtcattgcattttcaagtaccacgagcttgcgatcgctatggttttttactggtagttgtgactttgcgattactgggagtggtgactttacgacacggctcgattgaaacttgaaaggcgcacaactcgcctgttttacaaggttacagctgcatgtttcagctctagctcttttgaagttgaagcccgatcaataagtttcaacttcacttaaaacagaattaaagataggtgaagagctctagtaaattaaagtagaaaggtaaaactaggtttcagctactccataactttacttgagattcaactcttaaaattaaatctagaagtttaaactcaaccaaacgagttttactattcatctgtcatctcatgctattgctagcctggtgcataatgcgtcccgaaaggctgaaactataggtactccctccgttcaaaaaccgtgagtttccgtgtcaacgtttgactgttcgtcttatatgaaatttttttataattattattttcattcttgttagatgataaaacatgattaatactttatgcgtggcttatctttttaatttttttcataactttttcaaataagacggacggtcaaacgttgaacacagaaatcagggtttgtcttttttttttggacggagggagtaggtgaatggactgctagtacggagtacatccaactattatgtctcctttttatcttctgtttaaaccacttcagaaagttttagtagttgaaacccctcaacataattaactacccttgaaaacgtgtgatcgttaatctgcatttagggtgttgcttccatagaccataggttaggttaggaagattgaaatcagcaaattaactattgagattaaggatagcactaattaaactgcagtctgtaggtgtctgtcaatcagaacaaagacgtgctaatcaatcttattcgaaaaaaaaacgtgctaatcaattgtaggggaccatttgcagagtgcttatcgttgcatctgtggacggatcagatccat

SEQ ID NO: 57259 - DNA, 2196 bp, Oryza sativa
tatgcaattcagtgatcgaataacgaggttggcaatggcattcacgccggtgagcaatcttgcacgtaccgctggcttggctgtaagtcaatttttcatgtctgcataggcacaggcgagttaatactactccaccatgtactctatctgactctgagatccttcattcatgcttcactggcatccacaatggtagagtatcctttaagcttctgttcaggcgtccatttcatatgtacgtacactatacgtgaggtactagtacaatatactccgtactagtacaggttaatgcatggttgtcccgttctatttatctactttaccatattattgtcataaattatttactccacacctataataaaaccaaagtagacaattatggcgaacaatctgcttcaaacgggagtgagtctttgcaaaggggtagtgaatgagaattcgaatttcaaaccacacatatccgagaagaacggtgcgcgcaacgcgacaacggttcgcgcaagcagccaaggctaacgtacaggctgcacaatgatgcaccaccgttcgcagccaacggtgagaagaaaaggcaggacaacggatggcgcgcggcagcagcggcggaacggggagtcgaggagacgaagcagcagcagaggggggctcggcttcggactccggtacagaagaaaacaagaggagacgtcgtgaaaaaggattgatggatcgaacgcctgccctgtgccctcatcgccatgatgtactattgtactcctcctagtgtgaatatgtgatgatgacgattgacagctacaggcgacgtacgatggctggccggagaacagctgtgaggggagtcgggtacgtgccgtaccgacgagggtccccgccggccgatcagtgggcaccgcctagactccatatagccgcagtgcgaagctgaaagagcgaacggccaatggcccatggccaatggaaaatacgtgctccctccatccaaaaaaaaaaaaagacaaaccctgatttccgtgtccaacgtttgaccgtccgtcttatttgaaaaaatataaaaaaaattaaaaagataagtcacacataaagtattaatcatgttttatcatctaacaacaataaaaatactaattataaaaaaatttcatataagacggacagtcaaacgttggcacgggaactcacagtttacttcttttttttttttttttgagacggagggagtatagctcaacagtactgtacatgcaattgcaatgcaagcactccagttcaggctggttctgccaatggggctcgggctcatcattggcatctctcgtactgctgtactccgagtacactatacttcgagcaggttgggccatcgctgtcgtccagtgtgtactgctggggttggcctttgtgtaggtcatagtagctgatgagacgaatgacacggattaggaacactggaacagaaaagaagcagaggcaaaatggaaagagacgcgacggccagtgaaagatttccccgtctccgcgtgcactgaaacgaacaaatgcaatggaacattgctgttgagttttaagagcaccaagtgagataaaacaggtgccagatcctttttggtgtatgtacatctgcactatgatattgagctgttgatcattcagagtgacgacaaaactaattttacaaaggcgcaagacttggcgtctactttcgaataaagtgaaagtgagaagcattccattattattcgtttgcgtacaaatgtacaatcagagagtgaccaatttattgccactttataagatgcaaaagaaccatgactgccacttttttcatgctagcttgcctcttggttgtgggggcagatacaaacggctacatactagtataaaaaaaatcaatttctaactatatatttggatattagatttcataaagaacaacttccgatatggcacatccaatatatatttgtttcatgatgatgtgtatcattccgagccgatatttattgtagcaggagagaaacagggatgtagcaggtgcaagaaaccaacagagggatgatacaaacattatatatagactaaaatacaccagcggttcttaaacttcttatcagtaggtttcacttaggtccacgaagttgtaaagcgcacatcaaggtccctaaacttggtttattgtatcatcccggtcca

SEQ ID NO: 57260 - DNA, 8306 bp, Oryza sativa
tttagaccggaatgatacaataaaccaagtttaggaatctcgatgtgcgctttgcaagttcgtggatctaagtgaaacctgctgacaagtttaaggaccgctagtgcattttactcttatatatatatatatatatataaaaagctatatgattaagcgatgcatattaaacagagggatgatacaatcattcaaaagctatgattaaagcgatgcatattaaaaggatgcaatcacaaggtcacaacaattggagagccaattgcacccagtctaacgtgcgccaaaaaaaaaaagaatctgatacggaaagaagaaaagaaaaataaaaggaaggaaaccgtgcgcaaaaagaaaaacaaaagaaaaaaaaccgcacaccgcctaggaaaccgtgcgccaaaaaaacaacaaaaaaaaagaaaccgcacggtgcttgcgcccccctctccacgcgcgacccgtgtctagtcgcgcgggggagggcgcatgcgactgatcgctcattaacattctctctccaattgtgcctactgcccactgcctgcgggtttccgtggtcatcgcgataatggcggtgatactttgtaaattgtgttcatctgcctgacaaagaaaaaaaatgtattcatctcgtaccaaagtcctagtccatatgctactccatccgggttgataatacttgtcattttggacagagacacggtcttaaaaaaataactttaaccactatttttttataatatgaatagaagtgttaacaaatatatcattttattgaaatatttttttaaaactaatctatacatatagtcaccatattgcaaagataaatattttagaaattattcgtaatcaaatattttaaagtttgacctcacttttgtccaaaacgacaagtattattagcccggagggcgtacatttcttaacgagcctaagagtaactgtaacggcgagagctaaataggagaaaatcatatcataattgcaaactgcctaaatgtttgactgctaatcaaaaggccataaaaggtccataggtggttattattcctttgtttgtaagctaaggctgtccaccatgaaaagaaattcatacagcaggcatttatcaactcaatgcagctcaacatccagaaagagtgggtctgatttagtctacaatttcagaccatgtgttgtgaatgtacaatgaatcacgtacaaatgacaatacaacaaaagttaagcaagaatagcttgtaccggtagttgtgataacggtagactatgggcgtattctttccaatagactctcagcttcaataaaccctccaaggggaccaagaggtgtatattttacttgcctccagctgttaaaatgaagtggtataaataatttccaaacggaaaaatgccacatttcaaatgaagggaaaggcgtatagcactgtaaattgagtacctgggcgtaaatggcaatgccaagcagtgaagatgaaggtgatcaacactattaaatggtggctggtgaaaaccaaatctgcaatacacaacaagtttacaagaacgcagagaggaataacgctcgataagtatattgtgacaatggaagtttccccatcaccgcatattagtgttactgcttatcagcaaatgagagagctttcaatcacatgtacaacaagaaatatagaacacataaataatatttctttttggcaatacctctgttcctccgaattgggagcatcccgattgagtaaatctcttcctactgccaacatgtgactaactgaaaaggacaaaacatgccaactggttggtttgacttagacaaagagtaatagggagccaaggttgcaagaagcgagaaggaacaaatcacccacctaactggtgatcttcggtggttctttggagattattgacagtaggtatatgttcaatgggtatgacaagatagtgcctgcaaacagcacaggataccgtaaaacaaatgttaaaggaaaaatctgacaagctctgggtcaatagttaacggtggaaaactgaaatcacatttggacacttggtgctaaaaagattacagggccaaaatcactctggcatagtggcatgtcaaagacagaaccggcataaagagctcagatcgacttgttattatgtttgcaacttttgcattgagtacagaagggtgttcatcatgtctgactgatccagttaaccatatagtacaataattgtcggtagcaatttattgatcttcaactgtaagctatgtgatattacatactccctccatactcgtaaaggaagtcgttttggacagtgacacggtctctaaaacacaactttgacttcttcatacggtttcaaaaaaaaaagaaactttgacttcttctttctataaaaatatttattgaaaagtgatatatgtatacttttatgaaagtatttttcaagacaaatctattcatataatttttacattttcaaactcaacaacttgagagttattcatgatttatattcctaaagtttgacttaaacattgtcctaaacgacttcctttacgagtatggagagagtatgttttccactatttgtaaatagagaggtgcaactgtgaagatatacaacatgttttttcattgctcttctgtataatatagaaaaacatatgcttgtgtatatgcacagtaacttgagaattgagataatcaagaacatccaagtaggcgatccacaagacttggttctccatgacctcttggtggttggtatatacccaaattcagacaacagttaagattagattggtacagaggaatcagtcgcattgctattcagctgatcaccaatattgatcggccatcaaaatacataatctcctgctaaaaaaacctaaaggatgatttctttcagcatgaaaatatagccacttatataggaacgatcaaggcataggtctgtttgttcaaaaaatatatatattaaaacataggtctctctgcaatgagaagcagagtaaaaagagataatatggtggtaaaaaagtgtccaaatatgaaaaattcgcactgaaacttataacaagctcactgcaaccaagatccacagtaaaccattatttgcactcgcaaagtagttatagctaggtaggagacataacaagacaacaaacacaagttagttaaagccttccaccttgcattagttgtatagtagaaatatagatggtaaattcaatccgagtacatgtgaacccaatcacttctaatatccgactacagctattatacgtaataacaaggaaacgccatatccatatttccagaccaatcccccccaacacgacgcagtgcgcggagacatagaagtactcctacctgaaagccgacgggttgatgtccttgaacgccatgaccctgtcatcctgcggaggaaaccaaattgacacgagttttagcgaccaacagcaccagatgaacggggattattagatcggaagcggcgacggggaggagggtacggaacggagtagaggaggacggtgttgcaagcggggtcgcggcgggcgatggggcagaacacgcaccattcagccatcggggccctctccgacctcctcgccacggtgccgccgcggaagcagaacagcttcttcatggcaccctcggcgcccgcgtggagcggttgaggttaggtgggatccccaacgcggcgtggacttggactgtttccgcacttgcgccccggacgcggcagccgtgctcgtgctcgtgctcgcgggtgggataccgccaccgccgccgccgccggtatcgatccggtggccggtggcgcactggctaatcgtccagtgattccacggcccagcgcaaccggcaaagctgtagcgtcagtttcctggtcccttggagaagcccaactcatcacaggcccaactgagatgggccatgaatttggttccaagcccaactcagcaccgcactttctcatttcttgctgggaaaaagtacacccaagttctctcaacttgtcatcgaattacaaaatcgtccctcaaccacaaaaccagatatatgacatcccttaactttacaaaaccgttccatttaggttcttcggtggttttgactccggttttgtacgacgtgactgctaagtcaacatgggacccacctgtcaggatgtcacgaaagggcactgatggagacgtcggctgcgcgccggccactgcacggcctcgcccccgcacggccgccccggaccgcgccttgcaccgaactccgcagcgtcacaccagccgtcgcccagccgtgccgccgctctggccatggccgccgcgcctccccgaccacacgaagtcaatgggaaaagaaaatgaagaaagaaaaaaaaagggaaaagggcagagcagcgagcagccctggccgccgtgctgctggcactcgccgcgccatggccgctcggccgcatcccgcgccgagccgcagcttagccgcatcccgcacccacccggccaccggcgtcaccgcaccgtgccgtgctaggccgctgcaccgcatccgccgtccacggcgtgctcgcagcaccacgccatggccgcttgatcgcccccgcgccgccccgcatggtgtggcgccatgagccgccggcccgccgcacgccggccgccacgagcccgtgtcctggccgcgccgccgccgtgcgtccgcgtcgcggccgccgcctagccgccaccgcgccccgccgtcggccgccgtcacgctcctgctcgccctcgctgcgcgccgcgtgccgccgctgcccctcgccggacctcggtgcgctaggtccccgcatggttggcaccttgttaacgtcgaatgtgattggcctgcagcaggatggcatcccccatagctgtactgcgggcactagccacagcccatctgttccaacaaaaaaaaacataaatttacgagtcgatgcaggctattagcagcaattcagcatctaatctgcaagaattctcacacacacacacacacacacacacacttacggattgtgaagaatttgagcgggtgtgaggctgtgagctgcagaaacggagaggggaagaagcaccagatgagcaaataaaatccaaaaaacaatggcggaagctagcaaagaaatggagggaaggatgggttcacaggctgttctgccggccggccgctgcccttcttcctctccgcgtgcactcgccggtcgggagggagatcggcggggagaggagcaggaggcaagccaccgctgtcctcgctcgcctcgggacatcgccggacacccaccgcctccactctgagtgcgtgcggcttttccagcccccaggagcaagcgagcggcagccccgagtcgtcgtcgtgctccaaggaggggaaagagagggatgctgacgtggcatctaacatgtggggtccatgctgattcagccgtcacgtcggacaaaaccgggatcaaaaccaccgaagaacgtaaagtgaatggttttgtaagttgggatattatatatttggttttgtggttgggggatgattttgtaattcgatgacaagttgagagaccttggatgtactttttccttcttgcttcacgctaattcttccaattttttttaaaaaaaatgggcgcttggttcttccgtgaagtttatcctgaatttatataatggtcaactgttaaaaaaaaggatgattagtgatgaagcaaagaggaagggaagttttcgaccattacgcacgttgccggtgggtgtaaaattcaattctgattttttatttccgttggcaacaaccgaacttgacacgcaaagaggccgagccgtcatccacaaggtccagagtctagacaaccgtgggccacgaatcacaagagcttgactggaccggacgcgagcagggctgcttgaacgttggacggggtagctcgaagaaatgaagaatgtttggtctgtcacgagccgcacccgcacgactgtcggatataattaaagttggtccatgtggctgaaccacgtcggaaaaacataaacgaaggtgtacacgctagagatggtaaattacttggctacgaactttctgtgtcaagcttgcacacgcagctgctggataaggtctttttcttttcttatctccgttctctctgttccttgtgcatatcagtacgtgagcttggagccttggagcatgtctagtagtactaggatttcgcttttgtctcccgtctcccgtggacaggatcgcttgaccaacgcctgatgatgataattaagacctgcctaagcaacacctgggacatccgtattatgatattatctgcactgcgggttacttctaaatgatcaccgcaccccctcgtcgttaccaggctgcctcgtgcatgctcatcacaaaaaggcgtgctttgacgtccctcgcgagacacatcgcatgcagctgcggccagtctcagtctgccatgtgcccatgttcttcctcgaatgcgtctgtctcgccggattagcctgatggaaacgaaggtgaaatttaaccgtgaacagtgcccggctttagctgtgacagaggtaggaaaattcggcagatctcgaaagcagaagaaggcattgcagaaaacgggcagcgccgccgccgattcacggcaacatgcgccgttctagagaagctgcaagtaacatgcattattgcctcctactcctagctagtactgcggtatacttatcatgggtctttatcgaccgatcaagagagctccaatgtatgcatgtgcagaaatgttgcaggtaggcgatagcgcatgttactcgcgctcaccgactagccggtttgctgtcgttggaggagatcgaccggtattaattgatcgcgtcacagtactatcatcatctccgcgggtctctgtctgcgtattaaactcctcattgctgcaaaaatgcttggagtggattccatccacgtagctagctagcgtaatgcttgaattgcgacgacgtcttcaattatttggcagtccagataatagatcggtgctagctcgatcgatcagccagttgctgttgccagtcaccggtttgacgaaccggatagtgtatatccactcaatcgatcgatcaaatgatctggggattgcgatgaatttttctccctcccatttaattctcgcgatgaatagttgaatactggatcaggtgttcgatggatttcgtgcgtacaagtctgtgatcgtgtgcgtacacatagattgattaatttatctttctttgcgtgagtttgtccacaggcacaccacatatgattattagtatatgaattgccacggtggaggttagttccggcaagcaattaacagtagtaggtctcattgaggtgcatcagtggtgacgacatggatatcaaggagagatgatgatgcaacagtggagttgagagtcgatcctggctgtgtataggaggggccaggagcctccttgatgcaccgttgaatagaaattttaaacgtcaaaaaaatcgttggtttctttccttcagaaaccaagcgagtggtgtatgaaacaaactatatatgaacattctcggaatacgcattgaacaaattaacgttcaaggtataggagctatggtttaattccacctgtcaagactatttttgggaggaaaagtacatatataaaaggttttatctcattagaaatttcgaaaaatatatatgtatgtatatatatgtgtgtgtgtgtgtttgtgtgtgtgtgtgtattaattatttggcctccttacatgtacaacatgtaaatttgtagataagtttcaagttctttttgcatttatactcttttttaaaaaatataacttatccgttatatgctatataaatttttgttattgttattaatgtaaatcatatttcatacgcaacatccgatatttttgtgttttgtgatattatctattttaagcaatttctctgctcgtataccacacaaaataattttataaaataaatataacaaaaaaactttaatctgtaataaaagattaccacttactgtacaatcgttttgtacataggccatacaacaattttcatttttattgaaacttttaatgaaataaattagggattgtttacattgtatatctctaagagtattttgggtattcttataagggtgatcaacccactggtatattgtaaaacattgttaatgtcaccggtatataatagaaattaagagacactgttagtgaaatcgttgagctgaaccaaactcagtggcatggagtcgattctctctt

SEQ ID NO: 57261 - DNA, 2107 bp, Oryza sativa
  unsure (1)..(2107): unsure at all n locations
atttcgagcaaaatagtgaaaaaaaaatgggcttcctagagtccctactggccggaaaggtccggtcacagtaatgaaatcataagaatttaaaatatcttaagtaccaacagttgagaaataacatatggaacattcttgtaagttgtaacaaccaataatttagcaaatcctggaataacttcttgcatgggattttaacattcagtagactattaggatcagcatgtgatcataaaatggtcggcccagtaacaagggagcaaaagatacataactttagctggaaacttgggatataaggaaatattcaaacaatacattcgcacagcctccagtagcaccatttattcctcctcctcggcctcctccagccatttaacaaaaggttccagtgctttgacgaagatggctgacataaaatgcaaatattatagcagtttcaaacataactgaaactctacaacatctacatgaaacaaatattatccactagtgattgcaatctaaagttcgcattggtagttagtttctacttaacatgaagattgaagttagggcacggaaaacaagaaaaacagaaagccattagcgtatgactaatcaagttataattattattataaacttgaaaaatggatttttctgatattttaaagcaacttttatatagaaagtttccacataaaatgcgttgtttaacagcttgaaatcgtattaacaaaaacctaggtaaaatcagtatcttgtacaaaagtggacctacgtaaggcaattacctgccctttgggtttgaacccttgcggaaccaaaggaggatggtatcttcagctaggacatcttggtcatacagcgttctgattatttcaggaaatagcttcatcagcttagcatcctcatagcactgtgtctgaactttgtatatgagttcgagttcaagcctgccacttgtgcagaatgcattcaaaaggccagcccatgctttcacctgtaaagggaatatttttagatataataaatgatacccatcataacaaagagaacctagaaagatcaaaatggtctttagaggttaatcctaatctccacaagcataactaatagaacgtgcttcttcctatttgggatctagacaacgcagcatctagagttttccctttcagcaaactgcaaaattaataatacacttattcatggatatcttcaagtaatttgtccaaaatagacccattccaaagtagagttcaagctcttaaattggatacctaatagaccatccatcattggganatgtgacacttacacaactgtagtgaacatacattatgaaagcagccctcatctaccaatttatttgaatgcattccacactattagagttcacacattcaaatactcacacatcacctaagcagttaaaaggtaatcttcccatcaagaggatatactgtccagtgtagtaatagttggaattcgtacaaccaagggaccaccaagtggttaattgacatgcaaataattgatcaggattatactgataatctggtagtcatattaatacatatatatacatttgattatgatctcctttttcttttgtgaggatagttgtgaaattttagggtgcgttcggcaccccaagttcccaacccctctccctcgttttccgcgcacatgcttttcaaactgctaaacggtgcgttttttgtaaaaagtttctatgcgaaagttgcttaaaaaaatcaaattaatccatttttgaaaaaaaaatttagctaatacttaattaatcacgtgctaatggaccgcttcgttttccgtgcacactgtttgggttgggatccggctggagtgaacacagccttaatctattttagaggcaacttaagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57262 - DNA, 2181 bp, Oryza sativa
caaaacaatgttgtacacttgctgactatcctcacctatgctagtaggcaaaagtagaatttcagaagctgaactaagatatacacattccaagtatcccacaactgctttaaaatcaatgccaaaataaaaagatttacctgccgaagtgctgaattagaattttgttgctggttcttcccagaccactgaacagcctccatcagcacatcccatagcatgcgaacaacctctatatcaggaaatttagcatctttcacctgttgcttgacagcttctgtgacttcagatatttcagcctcttcattgatcattgttgtcagtgttaactttatctccttaagtttaacctcaaacatcttcttttcattgtactcaacaagacttgtcagaccttctttactgaagagagcataatgaaacactagaactcagaatatcatttaactacttctgttcagcaaaaaatcatgataacaacttacgtgaaatgttcagataaagcctcggaggttctttttgccgatgggaaaaattccagcaaattgtcctccattttgcctttcttcaaaagtgcaataagatcatctaaagtgttctccttcagatattctttgaaaaactcagtaatgaacgaaagcactatccctttggaaacaagattatccttgagcagtggctggaagacagtttcaggtggaagacctgataacttctgagaaaaggcaagtgctgtgaaaatggcaaagttcttcttctcattttcttcgaagaactcaagtgactgaaggaatttgcgcataacattttcaagattctttatcaagaaaggccttctgcgcaatgttttctgaatgtagagaacagaaggcaaaattgcttcacgctgcgctgcacaatcaagtacagaataggggtgacgctctccttctttctcaggttttattgtgccaggctgagtgcgccctccaatgaatacaacctgcagtttttcaaatatttacatttaagtgttcgttgacaacaagggttattcaaggaaattgaaactccagtacttaattcattttgcacatctttcaaaggcacaatactatttgtagttttacttttgttcaaaataaacacaaaagaattaaatcacaaatagctcaaaaataactgtgtatctatactcttttaatcaggtagtggtggtggcacctactcccattttaaatgtttgcatgttacctcttcttgaacttcttaatattaaaaaggatcaaaactaaatggatagccacataaaaaaatagttcaagatgaatattccgtaacacattaatacattttgtttaatccattgcaaagcaccggcatttagctaatagtataaaaatagcttgacaaatggcagtttggtgccacagagtacagcatccaagcaagcaagcaagctaaaactccaaactaattacaatataagctagaagagaactgtaataatatcttagttaactataaatatagatgtagactattaaaggtcataaccacaaatgcaacatccaagagaattctacatacatataattctatggaaatacctcaaaaaaggtgtcaccgtaacgtgagaagttgagatccgaggactcgatacttttggcaacaagttcctgtcagtgaaaggtctttataagaattgattgcacaggataaaatacaagtaaaacatatgtatgtgaaggtcggcaagatagttttacatataaatataatgttagcttgtatgtcgatattctagcactccaaataatgttcaacatgattacaagaataaaaaaattaaaatttactatgaagtcataattgttgtatagcatgtaatgctttggattgaatacactaagagatgaaaatgataacattattcactaaatatgttgagtacggggctgaaatggcaatacatatctgtgaaataaattgatttatcagtgtaatgcgtaggttttatttttgttcaactgacctcttaaaaaaaagtactagcaaagaatgataggcagactgctaagaatattttcaagaataattgcatgtcccttatgagcaaaaagtatagacaacaataaatattttatcagaacacccaactgaagataaatgagacgaaagttaggtgacatgtcaaggatg

SEQ ID NO: 57263 - DNA, 8159 bp, Oryza sativa
ccacatgacagctcattcccttactgtatgatcacacagtgcgtagttaaggtaataatgagaaaagacaagataaatatatcttaaaagcaagaacatcatgcaaaagaaacatgcaacattatctctactattgctaggtcagataagacagattacaaacacaatcataaggactaagtaagcaacacggactaacaaaatttaaagcacagcacttgaacaagtttgcgcctcatagatacttaaacaaggaaagctctatcaaaatgaaatcaaagttgaaattatgcccatacattttgtgagcttaagttgcagtacaagggcatttaggaaaagcatgtctatatgttactacttgcaatacgaacaaaacagaaaagttctacatatgactcaatcaaaatatctgtatgtgcagttgtgcatattgatctagcatacacaaatttataggagtaacatcagtgatagctctagctgtgcagattcattcgtaatgttgcattccaatatagtgcttaaatgatatgaacacccagtacaacagcaccagaagaaagtaaacaagaaatatctaaaagaactagctaatacccatgctttgctacggataaaaatgaattatatgtgggctaataatatttggaacaagttaattataaggtttttgggacaatttcatccctgattcgctgtggatgtatttgcgtgataaacctaaattctagagaaaaagtacaacagagttagtggtgcagattcactggcacaccattgcgagaccaagagccttacccaagagtgggcttctccttcgagctgcagacaaaaaataggtaaaagagaaattggatcagacaacaagaaagcatcatctccaatttggatgaaatacaagtgatcatggcatacggcgtataaaatgttaaacaacaaagcagggactgctaataattcaataacccgttacccctgcatacttaaaatggatcaagtgtccctatgtgtctaaaacataagtcacctatcaaaagaaaattgaacttaaataggacaaaaggtaaaataatggtatgcactaaatggccaaaaaaaaaatcaaatgttttattgccattgttgcagaaatcacgaaaggttttttgtacgaggctccccatgctttatggtcctaacacattcatagaacccctcccttaaccagatgttattttattggcactggaaaaggccatcgggacattccaaaacatgtcaaaaaaaatgtgtaaggtaagtaaaaaaaatgtgtaaagaatgtgtaagtaaaaaagaacttggttatgatggagtatccagactctggccgagaaacctttatgcagctacagtcataaaacataacatactgatatgtggttttgtgaaactttctaaaaatatcgacggagaattccagaatcttcataaataacaacggacaactcaagaatcttcatgctcatctcagggtaaaattcacagaacttactaatcaagaaaaactcaaacatctgacaaccgccaaatctgtgaggaatcaaggaacctaactgactaaaagcagaaaaggcagctccatcaaacccatcaaatcattgaagatttaagaaaagactatcaaattacccaaacaacgaaaatattgacacgataaacgtctggataaacatagctaattccttataccatttcaatgagacgaacaaatcggacaaatctaccagtacgcaacgaatttgatagacctacaacgcaggaatcaaaccaaggcacatcaaagggaacctcgcttactcacagctaccagatccgatcatactgagcgctcggaatccccaagcttcaaccatcaaaactcgccggaaaatcgcacatccaagattacccaaatcaagagcgcgtcaccaagaatcaccaaacgaaaatccagcttccaaacaagaaagcagcaaacagcagctcgaaccccctcccactccgatccagcacccctacaaccgacagcccacagatccgccgccatacaggcaacaaagggaaggaagaaagcgagatctaaggctaccgcagaagcgggacgacggcaagtacctcataaacacaacgatctggcgcggagggggaggggggttgagtggatccggggcttcagggaaagttgcgcgcgtccgccgacgcgagggagagtgaggagggtaaaaaacctagctcttctcagggtaggggttggtgcggcggtggcgatcggggaaagagggggtgataaagcgtgtgtgcggggcttcgggcggaaacggggaggcggcggcggagaacgagtggttgggatcgaccagaggtcccgtgtgggctgagtgatgggtcggccgaagttcgggcatgggctcaataagctggcgtctatctgtgggccgatacgtggccattggctgaaggaataagattcactttgactccctcgactgaccagctaatctaaatcgtattcctcaaccgcaataccagaaatcttaacccccgagctgttaaaaccggtacaaatttgactcccttggtgattttggatgacgattttgctgatgtggcgcacacgcagcagtgttgacttggtcttcgtcccacgtggcattgacaagacgactccggcggcgtaacaccgagctccaccaacctagatccagagctccgaatcggccacgacagacggctagaggacgagatgtggtagcagggcggcagcggcggcggctggagaccactcctcgctttgcgtcgccgcctcgaggccgagacgcgcccaccgccgccgcaaaatcggaggcggcgcgcagcatccgctctgcatccgcaagaaggagctgcttccgcgggagttaaattgggcccacatgtcagtgggcccacatttttttgtgtgtgtggatgacaaatggcccagcatatattttttaattttaatgccacataagcgccacttcaatgccacgtggaacgaagatcaagtcaacactgtcatgtgtgcaccaccacgtcagcgaaaccgtcctccaaaaccaccaagagagttaaattgtaccggtttagatagttcgggggttaagatttctagtattgtggttgagggatatgatttatattcggcggtcagttgagggagtcaaagtgatcttattccttggctgaattagtttttactagtagaagcagagagcaaggttaatagtacagctcgctagtggctataaaaataacacatcatcctgtttatagcttgtttcaaaagctaataaatacagtaatgatctctacatatttctcatgcacagcattttattttttttaatctcaaatagtatcctttgattgactgctaataaatgatgcacaaagttacacacatgcagggaaaaaaaactgggcctacagcacggggagccgcgtgcagcctggctgcaaaatagtagcccgcgtctctctctcctacccttctctctctttcaaccaggcaaaaatctgctatatgaaacattatagcatgctgatttagacttattgtacctgttctaagagatccatcggctgcctaaaaaataagctaaagcaaaatttaaattttaaaacaattttaacatattttcaacatagttttttttcagtgttaacttttaagtcactaaaaacacatatataaaagttttgcacacaaactattttttgtttaagttggcaacttttctagcaagaagacaatcacgatcaggacacctaaatgcgtggtggtgatttagagtcgccaaccacctcaacctagcaaaagctagatcaagatggttttgatatattaaaccgactagcagagccgatttagatggaacaagcgataaacacccgtcttgtgggtgaacggaaggtttacgggacaaacctacagagggatttcgcactctcgcgacgaaagtggatgatttacagtgcaaatcgataaagactgacaaactaagctagaactaggcgacaatactcttgactctacctgcaacaatgctctaccttctctcatatcaccagtcatcttgccaagtgaaaataatttttttcctagctgtcacatcatagactccccaagaccatattcacctccatcttttgtcttaaatttgatttaatctaatccatgaccagataactgatgtcatcaccaaatagataaaacaaactcaccagacatgaagaactaaatattttcttccttgtcgtcttatgaaccaagctaataaatctaacatccacgctttcccgtatccgtagactgaattcctgataatttgaaaaaattcaccattgccttgaatccccgaagaaattatcactacagtgctcgctctacttcttcagtgacgcagattccgtatacctctatcgtgcaaaccctgcatatcttggatatatcatgtactgccaaacagacccgttgacgtccttttgctcgggtccatatcccgccaactccaccgcagctccacgctctagaagccgtctgtggagattatggataccccatacctacacgacatgtatagtccgactgggtatggggtgccatgtatagatagaatatttttaaagggactcgggttaaattccaaactcgtatgtcaaggaaatacccgagatcctagtcggttacgattgtatcttatcagtaactacctattccgttagggatatggattgtgctttgtaatacggacccctttccctatataaggaggggttcgggtgcctctaggggcacgattttctcccagatcaaacgatcaataatacactcggcggatcaatccccggacaggagtagggtattacttcttgattaagaaggcctgaacctgtataaaattccttgtctttcaacccatccacttttccagcttgatagccacccccttttagtattgccgaaatcttgtttcgacagttgccgcgccaggtaggggtagcatcaagttcttcgccgactagtgcgatgggtttcgtctccggcattgacgacttcgtcttcccacctgggcaggcgtttcggtttggcagcctcgacttcatcaccaacgacttcggcaagatttctctcctcgactcggattcgaaccagtcgggaagaggccaggtccccgccccgttcggtatcccgaaatcggccgggatctaccccaagatcatctcagccgagttggccccaaaccactcggacgagatccaatctactccaacacgacccgatcaagatgatggagcctatccgctaatcctgatgaaactccgcgatgacttggctgccgtcttcaccaaaagggcgtcctctccccgtaggtctaggcgggatccggccccgtccccgatccagtctagttccagggaagtcggcgtcatactccagcctctcggcacggtctcgacggaacaattggacggctacctcagctctcccagtgtcgactcacgactgacggagatcgtagagtacgacgacttcggctaccgctacgactaccgcaacctcgacgacttcgacgaaggctatgaagataactacacgcccctttacttcggcattttcatggccaacaacgagacggaagaacagtgtcaagcccgacaagcagaagaacagcgcgtgcgacaagaagccgaacgtcgccgactggaggaggagcgccaagcacaagagtgagaaaggctgcagcgtgagcaacaggagcgcgagcgggctgcaaaggaggctgaggaccggtgacagcgcgccttggaggctgggcgacgagcacgagaactcatcgggcagcaagatgtcgaggggacggcggtttttcacatccctttacagaacgcggttgcagcgatcaccctcctcgacaccctccttaagggagacgcactcaatcaggccaatcacgtcgtcaacatcttgaacaagaccaagaccatgatcgcagcttcggtcccggttaattccgcaagcgtccgcacgccgactggcagccgagttcctcctcttcgatctcaagactatcaccatccaagcctcagcatcgtcggcgctgggtcaagtcgcaagagcagggatcacggcaaacgatctgtctactcgcctcctcaccggcaaagggagcgtcgagctaaacgtccccactccccacatcataggcgtcccatcgatcttcgcgagaccattaaccagcgcgcgcggcgagaggctacattccccaccattcaccagatcgctacgacgacgacgtggatggagttgctgccttcacaagtgacctgcgtcgagtggattggccagccagcttcaagctgactggaatcgagaagtatgactgctccaccaaccctgagtcttagctcaccgtctacagtctcgcaattcgcgcaccaggaggagacagcaaagctatggcaaattatctgcccgtggccctagcggattctgcccggtcctagcttcacgggctaccccgtggcacaatcgaatcttgggcggaacttcgcgaccacttcatcgctaatttctagggtacctttgaacgccctagcacccagtttgatctttacaacgttgtccagaagtccggagaatcccttcgagattagatctgacgtttttccgagcaacgcaacaagatctccgacatcatcgacgacgtcatcatcaccgccttcaccaagggcattcgccacgatctcttagtcggcaagtttggacgcaagcctcccaggatagtcaagcagatgttcgaaaaagccaatgagtacgccaaagccgaagatgccgtcaccgcatccaagcagtcgggcaccacttggaagccgaagaaagatacgccgactacagggggagtggaagtaccaatcacaaggatcgcaagcgtaagcccgaagaacttgtggcaaccactacaccatgctcccgacaacgttcacgcgtcaacacttttgacaagatcatgaactcccaatgttcgcatcatccaaattccaatcacgcagccaaagattgcttcgtctacaaacagttcgtagagcaatacgctaagaactcacgcaagacgactaacggagatcaaagcacgtcaaagaagaaggatgacgaagatgatgccccgactggttttcaagaccatcgcaaggaactcaaccacatctttggcggacccctagcttatgaatccaagcgaaagcaaaagctgattgaacgggagatcaatgctgttcagcccgacacaccccaatatcttcggtggtcagagacagctatcaagtttgaccactcggatcatcctgaccgagtggtctacccgggacggtaccccctggtactagacccagtggttcgcaacgtcaagctccgaagatccctcatcgatggtggtagcgcactcaacatccttttcgccaagatgctggacgacatgcagatccctcgcacggaattgaagccgagtaatgcgccctttcacggagtcatccccgggctgtcttctactccactcagccagatcactctgccggttgctttcggcactcgggagaattttcgcacagagaatatttgcttcgaagttgttgatttcgagacagcgtaccatgccatactcggacgaccggcattagccaagttcatggctgtcccgtactacacctacatgatgatgaagatgccaggtccccgaggagtcatatccctgcggagcgatattaagcaagccgtcacttgcgacaaggaaagctgcgagatggatcagacccgcgagatcacgctcgcccgagaagaaatccgactagatgcgtccacagcaaccgaaggagaagtgcatgcgaccaagatgacaaagaacggagaaagcaacgccaagaccaagaaaattcctctagatccttccgatcctactaagactgttgtaataggcgctaagttagtgtaacatcctaaaaattcctgccaataaaaatcactaaaatttcgcacaccgtagaacgtcggcaaagcaacgcagagaacgtacgcgtgattttgacacatgcacacatgatgtgtcatacatttatgaaaaaatagtgtgccatacaca

SEQ ID NO: 57264 - DNA, 1322 bp, Oryza sativa
ttttcgcacagagaatatttgcttcgaagttgttgatttcgagacagcgtaccatgccatactcggacgaccggcattagccaagttcatggctgtcccgtactacacctacatgatgatgaagatgccaggtccccgaggagtcatatccctgcggagcgatattaagcaagccgtcacttgcgacaaggaaagctgcgagatggctcagacccgcgagatcacgctcgcccgagaagaaatccgactagctgcgtccacagcaaccgaaggagaagtgcctgcgaccaagatgacaaagagcggagaaagcaacgccaagaccaagaaaattcctctagatccttccgatcctactaagactgttgtaataggcgctgagttagtgtaacatcctaaaaattcctgacaataaaaatcactaaaatttcgaactttttaaaacttttgcatcatgctggttgttatgattgctattgcttgccaaaccataaatgatcacaaagaaagtaaagaaaagatcgacatttaagcaatagatataatttacgagaatatattattgttaaccctaccaatatttatgcacaagatagtaaagtcaaatattaatttctattataaattaaaaatcagatattaaatattcgaaccatgagtgatagcttgatgtcacaattagctaaagaaatagtaagattaaatctaatttatttggatctactctcatatgaaatataagtacacatgaaataatgaacacatcaatggccccatctataatagagtatctcactagaatatataattaatatttgaaacaccttatcaagctcctcataacatgaaaatcactcatataaaataatggtcatataaataaattaagctttatatataaataagattatgtgagttttaattaaacaattagattaatattgtaccgagtctcaatttactatttatagaataaatggattaaacctatctgtgtaaaatatattgctatacaaataaactcgaccaatctaccattgtattattaaggacacatcgttatattaaatataatattacccccaaagtcttcaaaaatatataagttcactttagggccaataatttaaattaatctaaaaagaatttatttgtgtgataaataaataaatatgggtggtaataattttggataaatttcataacgagttagtgcttaaatttagttaacatttaactaagtaaattagggcttatagttaaaattgtataggagataggctaagaaatgaataataggaaaggccagtgttcattgcccc

SEQ ID NO: 57265 - DNA, 17154 bp, Oryza sativa
atagatgaatatttaacttgtttagaagagtaatcacggagctagttggatttggaacacttaaaaattaatccaatacaatgtcatgtgaagtagaatatatatatatagtcggttgatatccattagttaaccaaacagagccatcttaaaatcaacatgtattgtatagcttacagtaaaaagcaactactcaaatatatgatccaataataagatattgttgcttacacatatactatacatcccattatagttgtacggtatagtattaatttgcgtgttgcatatattaaattagagggagtatatgacaaacatgtatattagataaatactagttataaatcttgacctcatataattataattatagttcaactgtaaattaggattattcattgtaaaattatgtgatgggataatctgtaaccataatatgattaacctaaacaactctaacatacaaagcatggataattattaaccttttataatttattgtgacaagtaaaatatgttcataattaaagtaaagcctccatcaattaaataataataaatccatctaacaacagaacctctggtatgtaaccgtgctatttagatagatgcatatatagtcataatccttccatagccatttgatagactaaaccaccgattagccaaatatatatgtataccataaatgccatgttggttaactcctaaatagaccacgatgacaatagaaagattaagaaactttagcccttagcatgattggaatccattagcaaacacgaatagtatattttgttgcgcatatttgattgttgtttgaatattggtttttctcgcgtattatagaccttgtgtatcggttagtcgtgaggcaacgtttgcaatttccaggaggtgaaggttgatcaagattatatcaataataaggattattctgagcaggcaagtcatcactattccttgaacatgttgatcccaattgcgaaattatttttatttacaaataagattgcatgcaatgatgaacatcctatttttgaatatgccatgccttgattattgtttacccttattcccttgtaaccatgattacgtatgagtccctagtcaactatgacaaatgcttagaaatgctactctagaatcatgcatactcatatttatcaaatgctatatgcttgggcaattacctttgggaaggtattgagatgcggcatgtggagacatgagcgccacattgccatgatgttgatgatatgatttgtgaaaggagaaataaaattaaacaattgttttcgactggggcagacggaggatttgggtggtatccggaaaaggctagtaccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtggggcatccattggtagaaccgcgaggcgggtatctacagtggtgtcgccatcggtaggactgccatgtgagaatttaaacataattataacttaatgcatgtatgagtctttccttcccgggtgcgccagaactcctctcactgctagaaaccgtgtacgcctatagtgcatgaggatataaagttcatggagcgggtactgccaatgcgaggttatcgaaaagctttgccgtaatgcgtctcatgtgtagggacgaggctcatgtgttgggcagtcgcggagcgcgggtaaagtgtacatccactgcagtgtgagtaaaccaaatctattcgaatagccgtgctcgcggttattgagcaccgggacgtgtattacacttggctagactcaaaattcttaacttgtgtgggatgggataatgcatgatgatttttatgctgttggacccacttcctgagaggcgggaaggtggacgtcctcagaaaaccatgactactcaatggcgggaagctatccttgggatcacaatggatggtggacagaaccgtcgttgtttaatgtgaacactggtattaaaatttgatcagtctatgctaggtcttagacttgtgaaaagatttgcaaaacttgctttgcgcaaaggaacctgaagccattccttgacataccctctatcatatgcatcgttactgtggtggcttgctgagtacggttggtactcacccttgctatttatatatcttttaggcgagtgttgaagagaagcccttgtcgatacgcttgcgtatccaacaagatgatcggagtgcggtcttgttctaggtctcgttccccagtcgactgcctgtggcatgttaaccgggcccttatattattttgtcttccgcagttgttctctgatagttgttggcctacctagccctaatgtaagtatttaactcttttagcttgaattcattcatgatatgttgtgattcaactatgtatgtgtgtaccaactactgatccagggattggtacgaataaacacagatgatttccgatttccaaaatcgggggtctacagttagattgtaaataggaaagcatgctcatcacctttcttcaaaataataaagatatctttgcgtggaaaccatctaatattttcacgcccagaaattcacgaaccagaatttctaagctgaatgtgtattagacccctatccaggactagccagggtacacaaacgacaattgttgacatacagatccacgtcttacaaaaatagaaaagattacaaatgctgcagaaaagataaaagcgagctaagcctaaagacttgactcctgcagcgagcgattccattccacaggcatccttgacagcagcgacgaaaccaacttcttcgagacatctccaactgagaaggacttcaactctggtgttgggggaaaagagagcaagactgagtactacccactgtactcagcaagtcatactggaagagaaggtatgatgcagggtataaccaaaggaggctagaggttcatttgcacaaagcaggcatttaaaagcagtagttaaaagcagtaaaacaattgtagtaatagatcaatattaaccaatcactgtccaacgctacaccacgttgcaacaggcccaaccaaccacctgaactacaccagttcaatagctaactaggggtgagactaatcacggtgaatctggtcgaccgcccataaccgcgggcacggctattcgaatagttttactctgatcagaggtgtacaactgtacccacaagacacagccccatgacacgtttccgtgcaccgacatgccaccacaacataccggaaagaggccgtgacaggacccttcgcataaccccctctaaccgatcgcaccacacctcagggttcgcccccgttcccagcaggcaacgggcagcccctctctcgtgccgcggtgaatccggaagccgatcaaccggacaccccggccgacccaactccatcacacccaccctcgcctgggtacgtcggccacaggaaagctacactacaagcccagccgttgcccacgctggcttgtggtaagtacgataagttcttccagggcattccgcgaaccggtccttaatcgccatgggcatgactagcaaaaccatgcacccacagtccactaggtagtgtattttaattaactaacaccattgcggtggcactaatctaaagctatgccaataatcaatgtctatgctttaatgtgatcccgctttgtggtctagtagaactaagcatggctaagcatttcctaaaccatctagtcattttaatacccaagttaaacaatatatggctgagtagtaggacccatcaaacatgatattgtaaaagaatgcaacatttaatagaaatgcgggacatttgtaaattgggtacaatatgatcaattgtaatgcatgacttgccttgctcttgcactagtgagaccacaacgacgtcttcgagaaaccgcggatcgacggaacggtcgaaatctacgcgacaaacaaagcacacaagcaaaacatgctataagtctactgaaacaggaaacaaaaccatttttaatggattctatacatttttatgaatttactgagacttgaatggacttaaacggagctcggatgaattagatatgaattttagaagattatctgtgtttctactattaaagaaaagtcttattgatttattgcgcaataaagcatcccaggctgacgtcacccaaggggggggtggcgccgacatgcgggacccacgggtcagtgacacaagaggaggaggaggtgacctggcgggtgggtcccaccaggcagcggtccaagggaggggaggtggcgcctggctcggctcggctcggctccaaaccggcaggccatggaggggcggcggcgcgcgcagagctggcggcggcatgcggttgccggcgacggcgaccgtcggcgggaggcagcggcggccggcacgaaggcggcggcgcggcaaagagagagagagagggagggaaagggagggagaccgatcctcaccgaggggctcggccggcgcgggggaggagcgacggtgaacgatgacgatgagtgacgggaggacgacgacgatgggcggacgtgcttcgggaccacctaggggacaaaatgggagggattagagggagaagggtggtctacggcgagcggattcgcccggcgaaggcggcggccatggtggtgctcaccggcacgcgaggagaacggagctatggcgacgatttgcgtcaaccgagtgttggacggggtagccctcgcaacggcgaagctagtggcggtggttgcgcggcgtggcgacaatgctagcggtggcggcgcgcggccggagagtggcggcagcggcggcgctaggggagagcggcgcggcggcgatagaggcctcgggagagagcggcgacaaaaggaaaaagatagaggggggtgcggaggacctttataggggctcggtaggagcggacgtggccggggggcacccgattttcgccggcaacgtgggaggcggagagagagagagagtagggggattcaaaccgaatctcgccctttttgggtgcacggcgcgggcgggaaggcgaggccgtgggcggcgacgtggcgtggggtggggcgcggggtggagcgccagaaaagcggcgaaagcggcgatgtgggcggcggttttggcggcggttgccgccgggctggaggtaggggaaaggactgacaggtgagccccacctgtcagagcccgggggagtgaggggaggcggcctggactttgggagggagcggtagagataggccggcggcccatgatgaaaggagagggagggaaaaaaaaggagaaaaagaaggggaaaaggaaaaaggggattttctggggattctttaatgcttgtgctcctttttaattggttaaaattatttcttgggctctgaaaattccactaaagatcctgttagcatattctgacatgtagaatccaagaaaaattcaacaagccaattccgattattatttgcatttattaatttagggattcaactctaggttaaattaaacaatttcttcggacgatttattttatgaactttaaagcaaggaggagaatttcagagcgtgacagatatgcctggcattcctagagaggtgattgaacactctttacatgttaaggaagatgctaaacctatcaagcaatgactccaccattttgcacaagataggaaggacgcgatcaaggaggaattgaccaagctgttagcagcaggcttcatcaaggaagtccttcatcttgactggctggccaacccagtcctagttcggaagaagacgggacaatggcgcatgtgtgttgattacaccgacctcaacaaatcttgtcccaaggatcccttcgggttacctcgtattgaccaggtagttgactcaacggccggctgcgagctactcagttttttggattgctactcaggatatcatcagatccgactaaaggagtccgactgcttaaagacttcatttattacacccttcggggcctattgctacatcaccatcccttttggattaaagaatgcaggggcaacttatcaacacatgatccagagatgcttttcaacttagataggtcgtaacgttgaagcttatgttgatgatgtagtcgtcaagaccaagcagaaggatgatttgattacggatctagaagagacctttgcgagcatccgcgccttcaggatgaaattaaaccctgaaaagtgcactttcggagtaccgtcagggaagttgcttggctttatggtatcccatatgggcatgcaagccaacccggagaaaatcaacgccatcctcaacatgaaaccgccgagctcccagaaagacgttcaaaagttaactggttgcatggcggcgctcagccagttcgtctcacgactcggcgagcgggggttgccctttttcaagctgctaaagaaaaccgacaatttccagtggggacccgaagcacaaaaagcctttgaagacttcaagaaacttctcaccactccaccggtcttagcttcgccacattcgcaagagccgctgttgttatacgtgtcggcaacttcccaggttgtgagcacggttctggttgttgagcgtgaggaggaaggccacgttcaaaaagtccaacgaccaatttatttcgttagcgaagttttggccgactccaagacaagatatcctcaggttcaaaagctgttgtatggcgttttgattactgttaggaaattatctcagtattttcaaggtcactcggttacggtggttacatcgtttccactcagggatatacttcacaatcgcaaagcaaatgggtggatcgcaaagtgggccttagagttgatgtctttagatctatccttcaagccgcgaactttgatcaagtcccaagctttagcagacttcgtcgccgagtggaccgagtgccaagaagacatgcctgtggagaagatggagtattggactatgcattttgacgggtcaaagaggctttcaggcaccagagcgggggttgttctaatttccctgactggagaaaggctgagctacgtattgtggatacatttttctacgtctcacaacgtggcagaatatgagacgcttcttcacggattaaggattgcgatctccttgggaattcggcgtctgatagttcgtggagattcttagttggttgttaatcaagtcatgaaagagtggtcctgccttgatgataacatgaccgcctatcggcagtaggtacgcaagttagaagataaattcgatggccttgagctaacccacgttcttcgacataataatgaggtagccgacagactggctatttttgttcaaaacgagaggcaactccttccgacatgttcgttgaacatctttatgagccacccgtaccaaggaaaaaaataatcgaggccccggacactcaagaagtaagcatgattaagccgactggagagagcccctcatgagatttttgaccaaacaagaactccctcaagataaaaacgaagtcgagcggatctccaggcgcagcaaactttatgtcatacatgagaccgagctgtacaagaaaaatccatcagggatcctgcaacgctatgtgtctttggaggaaggaagacaattgctaagggatatatattcaggcatatgtggcaatcatgctatcgcacgaaccattgttgacaaggcctatcggcagggttttttctggcccacagctgtatccgatgctgacaaaatcgtgcgaacatgtgagggttgccaatttttcgcccgacagactcatctaccagctcaagagttgcaaaccatcccgttatcttggccgttcacggtttgggggctcgacatggtcggcccgtttaaaaaggctatcagtggttatactcatgtctttgtagctgttgacaaattttccaagtggatcgaagccaaaccggtcgtcacaatcacgacagacaaggctagagattttttcatcaacattgtgcaccggtttggggtacccaatcggatcatcactgataacggcactcaattcactggcggagtatttaaagatttttgtcaagacttcggcatcaaaatttgttatgcccctgtagcgcatcccatgagtaatggacaagttgaacgcgccaatggtatggtacttcaaggaataaaagcacgagtttttgtccgattgcagtcctctactgctgcgcaaaatgcggtagaacaactttgccatgctgtccctttgcgtccgtcgcgcaacaaacacccagtcgggctacgggacagtcaccgttctttctagtctatggtgcagaaccaatgctgccaagtgaagtagaattcgaatctttgcgatttcgtaacttcagcgaggagcgctatggagaagaccgagtagatgatctcaaccgactggaagaagcccgtgaagcaaccttaattcagtcggctcggtatttacaagggatgcgccgttatcacaatcgcaatgttcgatcacgagctttcttagtcggcgacctggttctgaggaaaattcaaactacacgagatcggcacaagttatctcccttgtgggaaggactgttcatagtttctgaagttactcggccaggttcttattgactcaaacgtgaagacggtactcatatcgacaactcttggaatatcgaacatcttcgtcgtttttatgcttaggcattattttttgtatcttcttctttgactgttaacatcaagttcttacttgagttatcagtcgggggctactataataataatggagtgtgatttttatcaattcaatttgcttacttgatttatcattgccttgtttgattttttggcttagttaatgaggactgaaagtttttaacagcttttgcgggttctaggctcagtaaggtttgacaaaaacttttaagaaatcaggagctgagtttaaatcatcaagcacaacataaattcatcagtattgtacaaattgtgcctccatcatcatcatcattgtcagaatacaatatcaatcagtttcagtcttttcatcgtcagagttattagatctagtcggccagaggtcgttgtcctggaatctctcaacaacatcagcagctatcttgtcggcagctttctgcgtgtcattgatgaggtcaagagtggcttcttcgcttgtcccgtctgcaaagccatcaatggcatcaatatcaatcttcgggtacaaggacttggtcattgccaacgccaggcctgctcccatacttccagcttccttgatattcttaaaatatgtatccggagcaattctcagcttgtcgaagatttcggcagcaacaaatgagctcggaccattgttgttataaaaaacatggcttggacgagtggtgtagcggcgttggcgacctcatctctagctccctcaagcctcttgattttgttaagcaagacgtcgaactgagcttgggatttgattttgcgatctgcacaagtagattcacatcaacgagtgggcatgaagataagagtggttttttgatgttccagctacaagtatcttcgacatcttttagagctgagtccctctgcttcgttagttcgcccttatttttttctagagccttgattcgcctttccagctcggatatcttggcagcttgcactgtattgcttctcattggttagttgcacatggatagcggtacgaaacaagtcagataaggatgagatttaccttttaatgaaccgctcagctcaaagttggagtcttgaagctcggcagtccgatctctgaggtcatgctcagtcttcctggcaagctctttggcttcacgcagctggtctctggttgcttcaagggttccaaggtggggaactaatttttcgagggttgcggtcttcgcctcattcctaagatggattctctgcaccgcaaatttatctttgttcaagtaaagtggccgacaggatgattgaggctgcgtatagggagagttacatttacaagatgagtagattggccgagtgtctttttcagcagacatacttcctcgtcttccttttgtttatttatcacgattccctgtggttgcatttcatcatcccaccacttgactaatatgggtgggcgagaatcttcacctgatcgtatctggaggacctcttcttcattaccgatcattggcccttatatattcatgaataatggtgaagcaattgaagaaagtttgtcggatcaagacagatttggaggacttgtttacccattataatttccggtcggggacgagcaggtccttgcaccctaacaggagagttagttccagggtcagcagcagcgtccgtcttgggagggctgttggcttgagcttccacttctgggatatctctattttgttctgtacccaactggtttccagtcgggggctcttgatcagcaccgacttcagcttcggctgactggtttccagtcgggggctcgttgctagtatctatattgccggttgccggttgattattacctgggcggtcttcagcagttggcccagtttctgctgaaggactagtctctgtgccagtcggcatggggtcttttccagagggatctatgtcagatggtttcctacaaatttgagacatgctatcagctttgcttcaatagtgagtgactagcgaaacaggggaaattgctagatgacacatacctggatgacttccttatttttggcatgggacgactggacgttttcttcttcggattggcttgctttggctgtttcccaatcacccctttgttgtccgtcttttccgcgtcatcaccttcatcgtcacttgaaaccaacttcctcttacgagaatctgactggttagttgacctcgaggtgttgggttggacgtccgactggatcttcggccctccactggcttggccagtgtgccggcgaggtgagcggcgttgagcaattggagtatcggatttcatcaaagcgaattcctgtgcatggtattccaagttttcagtcgaccttacagaagataaaagcatgctttgagaaaggctaaggtgtataatacataccggtggaggagggttgaacgtattgtatggcacgactagcaataagtgtgaatagctgaccacaatggcattcgagaagattttgtacattctctcctacataattttgaactcaagagactctgggttctctcggttggggtcatgcttgccatcaaactcaaaagctgtgcgggatctctccttgattggcgccagccggctcttgataaagtgccgggtgatttgctctccttgcagaccctgttctttaagcttcagcatgcgatccaataagtcaagcgcttgggcagcctcttctcccatagaaagtgagttccaggtatcgcgatatactggaggcagacaggagtatccgggaagcgctggcttggggttttgcacatagaaccagttcgcgtgccaacctttgttcgaggtcttgaagggcatggagaagtatttttggctcaaggtccccctcagttgaaatccggctcccccaactacgcacggtttgctcttatttggctggggcttgaggaagaagatgcggcgaaatagagcaaaatgtggcctaatccccagaaaagcctcgcaagcgtggatgaaattggcgatgtggactatggagttggggtttaggtgatgcaaactgatcccatagaaatccaaaatcgcccgaaagaaacttgaggttggaacagaaaacccgccgtagaagaaatgggagaacagcaccacctcgtgtgtgtcgggggtcggaaatgtttcaccgcatgctggacgccacccgatgatctcctttgccggaagaacgccgtgcgccaccatctccttcaggttttcctccgttacatcggagggcgcccactgactctcaaagctttctctctcttccgccatggatgcgaactggatgatgtgatttggttcgaaatgtggctgggaatggatgggagattgatgcggtggttgcgtgggagattcttgtggagttttggaggatggattggagcgaatctgtgaaccctagcttcgcgggcgcggtttcacaccgtagcagagaattgggaaagtggcaagagtttcggcggggaagacgaaccgacgctttgctttcggtgttatttcattagggtatcgggagtactaatgggcctaggcctaaacagtacttcagcccaattttgctatctcgtcgtgtctaagttgtgatccttagggacttaggcattttgcttcggcaacacttgctcacaacagtatagcccaatgctgttaaaatcctttttgacgtagttagataattctttggaattactacgatgcaaataaaaaggtgcccgacagaaaagtgttatactaattttgtaagcctttttaggctgcaaaagctgttcgggttttgttgagatgactggtttttgaatggtcattctcttggcatgttatatgcttattttgatatggtgtgagtcatagcttaggcaatttagattcacctattgtcatgatttataccacatttgatggatctttttcgagagtttttactaggattcttatcatatgtgttgatttataaacctttagagtgtttctcactcgggactttttatatctccttttctggtgtatcaaagctaaagcagtcggctggatgttttattaaacgtcgcatatgcttggctgtgtgataccatggatgatccggttgtaaaaccactcggttggatgttatttgcaccttggctatatgcttagtttttaactaatcacatagtcggaggctacacctaattaggtgcatctaattgatgcacctgattgtttctatttctagcccttcacagtctttgatcttagtactcgggaggccaaagcagaagaagttggagcactcgcattatccttttggattacgagagaagactatttcatcgactgtaaaggtctcaggggctactatggagattatggataccccatacctacacggcatgtatagtccgactaggtatggggtgccatgtgtagatagaatatctttaaagggactcgggttaaattccaaacttgtacgtcaaggaaatgcgcgtgatcctagtcggttacgattgtatcttatctgtaactacctattccgttagggatatggattgtgttttgtaatacggaccacttcccctatataaggaggggtccgggtgcctctaggggcacgattttctcccagatcatacgatcaataatatactcggcggatcaatccccggacaggagtagggtattacttcttgattaagaaggcctgaacctgtataaaattccttgtctttcaacccatcaacttttctagcttgatagccacccccttttagtattgctgaaatcttgtttcgacaccgtcgttgccgtgccggaagatccagccacccgaatgagaggtatgctagccgtcaccgccctcttcttccctttcatctccatgtggccaccgcttccctctcctttacgctctccattccgctcggtgaggtgcggcgatggtctaggcctccccaccgatggatccgactgccctcgctctgggctccagcgtcgaggatgtcctgcctagcacgcgttcgtgcccacgctccctcggcttctccatacacccgttgatctcgtgcctaccctaacgactagatgacgagttggcatctccttggtcttcattgcgtcccttgcatgcgattctgcagccaaacggtgggctcgacactagcaaggtcgtgctcgtgccgtcacttcctctggtacctccaatctctcctctagctcttacctcctctcttatgccaaaggcttcctcccgattgacaacccttctttcgcagaggcaacaaggatgccccgtatggttctttgctcgcagttggggctttcgttcattatatcaagcttaggatacctttgaaatgtatgcaatgattctctttggttgctaaggtaaagttctttttgggctgattcagttcatattatgtacacaagaaacataatagtgctgatctagctcaaagccttttagaccatactataaatgtcctactgttcgttgtttatttatcagtgcttattaagcttctctaaatgcaagtatccctcccagtgcatatgaagtggaacatgtctatgtaagttctgttttgcctcgatacgaatcaattacgttgtttgaacatcatatgaagtcattgtaacctatttagaactggaattttaacaaagattgtcatatgaggtgcatgataaagtctttgtcccctaatttggttcctcttcttagctagaggtatactaagaaatactagctaggttctctctttacgagcactaatgcatttttgggaagtatgatatctcatctgaggtgtgtgaattcaggcaataaagaaaaacatatactactgttatagtttttgtttacaattgaaatagttattgataacagaaatatgcttaacatgctacaagcatagtcatattgctaaaatgtgacatttcatattgaagactatggccctgtttagatcccaccccaaaatttttcaccctgtcacatcgaacgtttaaacacctgtatgaagcattaaatataggctaaaaaaataactaattgcacagattgcgactaatttgcgagacgaatcttttaagcttgattgctccattatttgacaatgtggtgctaaagtaaacatttgctaatgacgcattaattaggcttaatatatttgtttcgtggtttgctgacggattctgtaattagtttttttgctagtgcccgaacaccccatgcgacaccctatataatacgcaatgtgatatgccaaaactttacacccctggatctaaacactccctatatattatttgagcaactacctgtgttccaaaactatcaaatatttcatttcaaatggtcaggtaggctttcagttatttacagctagttgggatagtaggatattggatgaggtagttcttataatgtaggaactacaatccattgataatgtttggaacttactgacaatgatagtggacatactgatatttgaatagtgtcccatgtgttttattgctaatttttgtttacacaaatcattcataatagttgggaaatactgctagcccaatgcgttatggggaacaaaagcaattgttgctttctcatgaaaatgatgtaattatttggaaccaatgtggaatatttattctccttcaagttttgtctgaatatacaacagatggatataaagttgaaaccactttctatgcatgaaacacttatttttcttctttttaggcaagtttatggaggaagctacactttgtcgtgaagatcagagtttagtttatttgcttatttccactgcgtttgtaagaattatttattatttttgtatgatgtggatctctgtatcaatttgtcgtttgtgtactctggctggtcctggacagagattttaatacacattctgcttgaaattcgggttagcgaatttctaggcgtgacactgaccgggcccaccagggttcggccgaactaggacagcgcccaatcgcccccaaaatttgaacactcgatctgcctactctgtcaacagtagaaactgaatcattcgtgcggtagctcgttggatcgacccagttcattaaaatctctctcttgttcatctccctgtccactccaccttatccattcaagccactactctctttagctcgaatccataagtccagtccatacccaagatcttcaatggctgggaaatccttgattccgtatggtgctacatgctgaaacgcatttgatctcaatggagagccctctccggcgaatcaattggtttcgggagaaaactgggcgatggaagaggcaaatgcgatcttcatagaccccctggacaccatcgcggtggactccatgagtatgcggccgatcggcgctgctcctagtttagccgaacctaggtcggccgaaccctggtcggcctcgatcaaccccctgtttggccgctcgcccagtctcgccacgctacaaaactccgactaaagtacggggtgtttcccaagcgcagaggccgacgacaggagaattgggtctactaaagcgagcacgatgactttttgaagacaaggagaaggccacatctcccgccagcgagcattatgtgggatctcttgatgtgactgtcacaccccgaagttctcctcccaagccaaaaatttaatttataagcgaccctaagaaaaaaaccggtgcaaagcaagagtaaacccttttaaatcaatgcaaataataatcgaatctgacatgtggaattttttcttgagttctacatgtcgaaattcactaacaggatttttagtggaattttcagagccctagaaataattttaaccaattaaaattgggcaagcaatattctaattccaggaaaatccttttctcctttttctttttctttgtccctccctttttcggatgggccgccggcccattctctccttttctctccctcctccctactgggccgaccgcaggccgagacccagccaagccgcccctccctctctccccgggacgccgacaggtgggccccacctgtcggacccgtccccttcctccagccgcgcccgcaaccgccgcaaacgcctccgccttctccgggccacgtcagccacgtccgcgcgtgcgccgcatctcccacgcccactcccctttctctcccgcccgcgcccgcgcccgagatggccgggattcgattttcgaatcccgcctctttctccttcctcactccccacgttggccggcgaaatcccgcctctcccggccacgtccggcccttccctcccctatttaaccttccccgtcactccctcttgctttttccccatttagccgaactttcccgagctccccatcgctcctgcgccgtgcaaccacc

SEQ ID NO: 57266 - DNA, 1330 bp, Oryza sativa
ccgtcggttccgtggactggcggtggaccacccgcgtggtcccggtccacggtgaaccgccctcccccttgagtcgctgaccggtgggtcccgcttgccggcgccccttcctccctctcccgagccgctgaccggtggggcccgcttgccggcgccgcgccccgccttgatgacgtcagccctgggatttattgcgcaataaatgatttaaggtttttcttttatagtaataaacacagtgaatcttctaaaattcataactaattcatccgagctccgtttaagcccattcaagtctcagtaaatcaagaaaaatgtgtagaatccattaaaaatagttttgttccctgtttcagtagtcttatagcctgtttgcaatgtttgctttgtatgtcgctagattccggttcctccgacactccggtgtacttcgaaatagtcgccgaggttcctccagcagcagagcaaggcaagtcatgcttgtcacttgaacatgttgatcctatattgcaaatgctctattgtttttcttcaaatattgcattgttttataatgttactatgggatgtttacctattgtcatagccatgctattgttgtaccatgtccctttgtaaccttggggttataacatgactagagattggactagggattgcttagccatgcttagttcaactagtgcacaatggggaaaattctattaatgtttagactgctggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggggtttggatgggccctgcgacggcctatacggcttccggattcacctaggcacgagaggggactgcccgttgccttgcgaggagtgggggtgaaacctgaggtatgatgtgcttggttagagggggttatgcgaagggtcctgtcatggcctctttccggtatgtcgtggtggcatgtcggcgcacggaaacgtgtcgtggggctgtgtcttgtgggtacagttgtacacctctgatcagagtaaagctattcgaatagccgtgcccgcggttatgggcggtcaaccagattcaccgtgattagtctcaccctagtttagtcttttgaaatttgatagtataggtggatggttgggcctgtcgcaacgtgg

SEQ ID NO: 57267 - DNA, 3427 bp, Oryza sativa
atcagccggctgattttttttattgcgtttacagcaggatttgtaactgtaggattgtacacatgtcaggatcagccgcctcccctcgtgcacgcggtgcgcgcgcctcactcgcatcacgtgcttcctctatgtcgaattgtatcaccagtccatttgtattttgtccgttaaaaagggccatgaaacaaacgagcttgaaaatgcatgtgaaacctgtcctaaaagaagagacacactcattcatgcattcgtaagacaacatgtatgtgtcacaaatcaaacaagccatgacacgtaatatcaagtttgctacatgtccctgcgtaacccacccagacttgaattgaggttgctcagtgccacatgacagacttgaattgaagttgctcagtgccacataaggaaagaaataaagaaaacaaagtgaagaaaagagaaggccatatgtgtgtactaccaagcatttgcagcattcaaggatcaagccacaattatttacttaacactcatcagcatttcagattagtacgcaaacccaatacacacgcgcgcgcgcgcgcgcgcgcgcacacacacatatatatatatatatatatatatatatatatcggagaagcaactattataattagcatttcagagcagatacatattaagagctagagtgttcttccatgtttcccctactttggtagagcaaggggatcagaaactatactggtgctatctactccgcacttaagatcactcagtgatgtcttttttgaccaatgcttcaaaaagcaaaccgtttgagaataacaaaacattggggctgtaagaaatacaaaattgtgggtcaagtcagttgtgctaaaattgacacattcatccttgttaacatcacacatacacgccaaaaaaaaaaacatccactacagttggttcaggagtttatgagattgtaatagtacaacatagatcaaaattaccttgagaaaaagatatcattcaacgatattgctagcttgaaacctggattttgataaataaaacagttacaactattcttgttagttttgggacattaactaacaaaaaggctgatggagagctacaattggagtgctatatgctaacatcaaaatatattaattcctgacaaaactccccatctatcctcattttgactaaactaattgcatcttataagtattatttgctataagactgtttctaacaaaaacatagacggtagaattgatatatttttatggaaagtaaatagcggcattaagaacgatttccagtggttaggatatgacctaaatatgcgataaactgattaatatgtaccaaaattataaaaatataacaaagacaaaaacaaaaacacatactttctgaaacttttctgaaacacatactcaggatcgaattctgccggtttgaccggccggtccacaagcaacgttatgaccgaccaacatataacggtcagaccggctccgtgaaggaaatcgacactaggtgcaaaatttggatgtaaacacatgccccctgcctttttggtgaacatcgtgaacctaaagacttgggaacttgccaaacactcgggaagtatttcttcaagtatttcccattaattgctctttgaaatcgttctgcttgtaacgtctcaagaaaataaaatatgcattccctgaaacgattccacatatccaataaggacattcccaactatgtgaccacttacggaactccataaatcgagaacccaaaggcaaaatcgtcttccataccaagtctcctgcttgaaagatttttctttcactcttttattgtaggatttagctactctccttttctccttctctatcacttccaaagccttcaaacacttatcggtcacatcataaagattgtctcccataaatgttttctattcttcaaccaataagtcatcttgctttatgtatctaagagagccatgattcacctctatcggtaaaacggcttcttgtccataagcctactcaaaattaaggagtaactttagtagcaccatgttcagatatcctatcatcccataatgcttccgaaagcacctcatgccacctctttggatgttcttcgatctttttcttgactaatttcaacgacatcttattactcaactcggcttgtccattagcctgagcgtagtaaagagatgaacttaacaatttaataccataaaatttggaaaaacttcttacctccttagacataaaagtttgaggaatgccaaatttatgagcaatatgcttttaaaataaagtcaattacctccgtgtaagtcatagcagcatgagtttggcccatttggtgaaataatccattacaactggcacgaactgatgcattgggatgacgaaggataaatttgacctatgaaatctaaagcccaacttcggaacggcgatggtttaataataggattgaacactgcggcgggcaccaattgaacattaacgaactgttgacaagcttcacatcccgtataatgcctaaaataatcattaatcattttcggccaataaaaccccactctcttaagcaaccaattcatcttatgggaaacttggaccgatcattatctaagcatttcagtaataccccatctatatttcggtgatataactccccatcaagcaaagtatatttaaatgcttgccgctgaatttcccgatcaaccctaagactaggatctttcgaatattctattaaacggattatccaatccttttccaactcctgggcacaaatgtctgaatttacagtcatatcggcctctaaatcaaacatctcatgccccccagctctttgctgagatcgggtcagaccggccacactaggccggtcagaccgatcatggtccccggtcagaccagtcatgctgcgccggtcctcttgttgcttcactacaaggttttcgggctaatgccacgaaattttgggcaacgacgtgattttcgttgcaatacataggggttatgtcacgtcccaaaacgaccctaaaatatatcctttaaattatgcctagaataattaaaatccgtgtgaaagcctccaaaaattaaaatgtgcaaagtaaaagtcaaacaaggcttagaggatttttgtatatttcctaaaagcctaaaatgtgtaaataaattttagtggaattttcagagcacaaaaaaaaataattaagaagaaataaacaaagttaaaaaggttttataaaaaagaaaaaccctaaaagtcccccttccctcctttgggccggctcggcccatctccctctcccccactctctctctctcctctcccccgcggcccattcggcctccctccccgcgcgcgcgccgttgacgggcgggcccgcccgccaccctcgctgacgggtggggcccacccg

SEQ ID NO: 57268 - DNA, 7983 bp, Oryza sativa
ggcatggccgccttcgggcgcaccgagtggctgccgcgtggggcccagccgtcagccgcccgcgccctcgggtgcggctgacgtgtggggcccacggcgtcggcaggtgtgagcccgggtgcacctggtccaccgtggaccgtgaggctgccgcgtgggtcccactcccatggacccggtccgcgcgcccctccccctcggctgatgcaataaaccctttttaaattaaaatttaaatgaagaaattcgcaaatattcatttaaagagcatataaacttcaaatggccataacttggccatttgaactcggaattggaccgttcaagtctctaattattccttaagaagtcaagaacccatttttgtgctttgttcctgcttgttatatggagtttattagagtaaaagccttttcttttccgttggtcatgtagacgctgcagcttcggaagatccgctcttcgtggaggttgaagccgacgttttggaaagcgagcaaggcaagtcacatcatccttgaacatattgaatcccaatttataaaattattttgatttaaattattgcattatcgctttatttaaattcccgtgttatcactgttttatttagccatgcctatttacctttgttatgaccttattattattgctattgttattattaccttgttcaccctagaataaacaaaaccccaactagtggacactctactcatggtaccactagtatgaatttaggtagatgtttcgccgcttaattaggcaacattaggtggttttacaactctagactttgggaatattcatatcacctggacattatggaatggttggattattgtggaattggattcacacctccccctctattcaaaaccctcaaaatggttttaggctgggctcggggtgcatggttttgatagtagcacctcggccatataaggaccggtcttcgggcctctgttgcaaagcactaccatacttccacatttctagtgggtaaggcttagtttgtggctcagtctggttataaacaaaagtacacgagtggagatggacgaagtcgggggtcgatggacatctctagggcaaatgaaggctacacgagctgcggcccggtagtcgagatgtcatggcacagggccgatgtcctgctgctaggggctcagtcctgcctacctgtcccggaggttccggccgtaggtggggttgggtcggtactcttgtgtatggctaggatgggttggaaactatgtcacgtcttccatccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacaagctgggacccagggtcgggttgccagttcggtctgattcatcgtaggccttgggttaaggcaggttcgtgtgggttcacggccttgattaataatattgtatagctctagggtcgtatttacaaaatagctttgagcaactaagtgtcttttaatgctgtttactgcaaaccctaacccctatattatggctcccttgtactcccttgcatttattctgcacttatgggtgtgtcttattgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttttcttttgtcttcttgtgtgctaggcctttgccgcccatgtaataaattaactatttacgcttccgcttgataaactctgaaatgtatcaacttttggtgtaccttgcctcctgggacaaggaataatacacgcacgtaaggaactcccgttgggttatttccggtcgtgacaagttggtatcagagcctccttgaccctaggatgagctttagatcccaagtcttagcaatattttcgaaataaaaatccttccttatttgttaaaatcctctagtctctctctgtcctgctgcttcatttatcgtcaaaatctgatctgtaaaatgttgcttttctcttttgtttttgtttgtagatggccggtagcatcaaccgtcgtggcctggacctgactggcttcgttttggagctgcggggcatgtgcgttgtcctggggtatccgcatggagtggactaccaaggcaagcagctcccggagcaggagggtgacgatgcagagccccacgctgcttgggaggtcactgcagtgatcctcactggctcacccgagaggacttcgttggcagtcaccgcgggtggagattctttctccgctgcttgccagaacgccgcactcctcgccattggcactcttcaccagtgctacccggacgagttgcagcactcgccctaccgctaccaccctcgtcgcggaggagcccgtgactacgccaccttcagggatgctagctcggaggatgacgctaccatcatgcacttggcgcgcatggtggaggcgtacgacgcagcccgtatcgacttccatcatatggtgcgccgtgggttggtcgagaacaacatgaagatcctggagctgcgtcaggagaatctgcagctgaagaaggacttggacacggtggaggcgcagctgtgtcagctcaagatcgcccagggagaggtctgtcgccccaagcgccgccgcgtctgccgcagtatgaagatcaccgcccgcaagagtacctccaggcccgagcttgttcgtcagtccttggcatggacctgcttcgtcgagacccctcgcgccgagcccgcaccctcggttcctcaggaggagggagcctctggcgttggcagcacggaggatgcgctgctgctcaccttccgccctggctcgtcgcagaagtagacgagcagttagtaggctcgcgcgtgtgttcttttcgtttgttttcctgctagagtcgtgtggggcatggttataccggtgtgtggtataactgtgtcggagcctgtctttattttatttgcttaagcaacttgaaccttaatgaacgaatttaatagcagtaataaattcaagaattatggtagtcgtgggtggttagttttaatagtcagctctctctgtttgccggttctgtgtgggattttcagatggtgacaaccaggagaagtgctgctaccggtgaaggcagtcaccccgaaggcagcaaccacaacaagcatggcagcccacctccaccttctcccccgccaccaccaccaccaccagacaccaactccatcctcacccaaatcctcgcccagcaggccaacatgatggctgctttcctccatcacatccaaaatccgccacagcataatgctccacctccaccaccacccccgcaacattctaaactcgctgagttcctccgcatccgtccgcctaccttctctagttccaataaccccgtggatgccttggattggttgcatgccgtggggaaaaagttggataccgtgcagtgcaacgatgaggagaaagtcatctttgctgctcaccaactgcagggacccgcatctctatggtgggaccacttccaggctacgcagccaaaaggacagcctattacttgggcccgcttcaccgccgctttccggaggacccatgtgcccgccggagtcatggcccttaagaaaagggaattccgggagttgaagcaaggcaaccgttccgtgatggagtatttgcatgagtttaacaacttggcccggtacaccccggaggatgttcgggaagatgaggaaaagcaggagaagttcttggcaggaatggaccctgagctgtccgtgcgtctggtctccggggattatcctgatttccagcgtctggtggacaagagcatccgcttggaagccaagcacaaggaactggagtcgcacaagcgtcgcttggcgaatttccgcaatcaacagggggctaaccaaagggtccgctacaccaatccctacccagggggatcctcctcgtagcagcagcagcagcaacctcgctccgcgccccgacctcaattcgtggtgcgcgtcccacagccgcagcaatagcagagtcagcaagggacccgtgcgccccgtcctcctacgcccgttgtgcagcctagtcaaggccgcaaagacgctcaaggtcagcagcgtctgtgcttcaattgcttcgagcccgggcactttgtggataaatgcccgaagccgcggcgccagcaaggccaagcgcctccccgccccaacaacggtggtaaggatgtcattcggggtcgtgtgaaccacgtgactgccgaggatgtgctgacgactccggacgtcatcgttggtacgttcctcattcattctattcctgctaccattttgttcgactctggagcttcccactcatttatatctgtgcccttcatggggagaaatcagttgggggtagaaaggcttaggaaccctctgctcatcaccacccctggaggggttatgacagcaaagtattatagccctgccgttcctatagaaatccagggaatcccttttcccttggatttgattcttctggacaccaataacttggatgtgatccttgggatgaattggttggctcaattccaaggagtagtggattgcgcaaggcgcactgtcactctgtatcgggggccggaacaaccggttgttttctttgcaccctcaacctctgtcggcagttcagaacttcatcagataggactgtcagaaatacccatcgtcagagagttcggagatgtgtttccggaagaactacccggtatgctgcccaagcgagagattgagttccggatagatcttgctccaggaaccactcctctatacaagcggccctaccgtatggccgcgaatgaactggccgaagtcaagaagtagttggaagagctgaaggaaaaggggtacatacggccgagcacttccccctagggtgctctcgtgatttttgtgggaaagaaggacaagacaaagaggatgtgtgttgactacagagctctcaatgaagttactataaaaaacaagtaccctcttccccggatcgatgatctgttcgatcagcttaaagctgccactatcttttctaaaatcaatcttcgctccggatatcaccaattgcgtattcgtgaagaagatatcccgaagaccgcattcaccacgcgttatgggctgtatgaattcacggtgatgtcgttcggtctgaccaatgctcctaccttggataagtttgttgtggttttcatcgacgacattctggtgtactcacaatcagaggaagaccatcagcagcatctccgtctagtgttgggaaagctgcgggaacatcaactttatgccaagtttagcaagtgtgagttctggttgtccgaagtcaagttcttagggcacgtgatatctgctaaaggagttgctgtggaccccgaaacagtgaccgccgtcactgattggaagcaacccaagacagtcactcaagtccgcagctttttgggtttggccgggtactatcggaggttcatcgagaacttctccaaaatcgctcgacccatgacacagttgctgaagaaagaagaaaaatttgtgtggagcccgcaatgcgagaaggcattccaaactctcaaggaaaagctggtttcctagccagttttaatcttaccagatactcacaaggacttcctggtgtactgtgacgcttcgcgccaaggattggggtgcgtgctcatgcaggaaggtcatgtggtagcctatgcctcacgccagctacggtcccatgaaggcaactaccctacccatgatttggagttggccgctgtagttcatgctctaaagatctggcggcactatctcattgggaatcgctgtgaaatatatactgatcataagagtttgaaatacatcttcactcagtcggatctgaatcttcagcagaggagatagttagaactcatcaaggattatgatgtgggaattcactatcatcctggtaaggccaacgtggtcgccgacgctctaagtcgaaaaagccgttgcaacactctcggcgtctgtggcattccaccggaacttaatcaacagatggaagccctgaacctaagcatagttggtcgtggattcttggctacgctggaagccaagcctaccttactcgatcaaatccgcgaggctcagaagaatgatccagatatgcatggactcctcaagaatatgaaacagggtaaagccgctggtttcacagaggatgaacacggaatcctatggaacggaaatcgggtatgcgttccagacgacagggaacttaaacagttgatacttcaggaagctcacgaaagtccttattccatccaccctggctgtacgaagatgtacttggacttgaaagagaaatattggtgggttagtatgaagcgggagattgcagagttcgtggccctttgtgatgtgtgccagcgtgtcaaggcagagcaccaatgaccggccggacttctccaacctctccaagtaccagaatggaaatgggatgaaattgggatggatttcatcaccggacttccaaaaacccagggcggttatgattctatatgggtagtcgtggatcgactaaccaaggtagctcggtttattcctgtgaagaccacctatggagggaacaaactagccgaactctacttcgctaggatcgtaagtctccatggcattcctaagaaaattgtatctgatcggggaagccaattcacctctcatttctggaagaagctccaagaagagttgggtacccgattaaatttcagcaccgcgtatcacccgcagacagatggacagaccgagcgtctaaatcagatcctagaagatatgcttcgcgcatgtgtcctagatttcaggaagacctgggataagagtctcccctatgccgagttctcctacaataacagctaccaagccagcatacaaatggcaccctacgaagcgttgtatggccgcaaatgccggacaccgctattgtgggaccaagttggggaaagccaagtgttcgggactgatatcctgagagaagctgaagctaaagtcagaaccattcgggataatctaaaggtggcacagtcccggcaaaagagttatgcagataaccgacgccgtaacctagaattcacagtggacgattttgtgtacctacgggtcacgccattgcgaggagtacacaggtttcagacgaaagggaagctcgcacctcggttcatgggtcctttccgtatcattgctcgacgcggagaagtcgcttaccagttggagctgcccgcatccttgggcaacgtgcatgatgtgttccatgtgtcgcaactcaagaaatgtcttcgagtgccatcggagcaggccgattcagagcaaattgaagttcgcgaagacttgacctacgtggagaggccagtgaaaatcctggacaccatggagcgcaggaccaggaaccgggtaatccgtttttgcaaggtccaatggagcaaccacgctgaggaagaagctacttgggaacgtgaagacgagctgaaggcagcccatcccgatctcttcgccagttcttccgaatctcggggtcgagattccgtttaaggggggtaggtttgtcacgtcccaaaacgaccctaaaatatatcctttaaattatgcctagaataattaaaatccgtgtgaaagcctccaaaaattaaaatgtgcaaagtaaaagttaaacaaggcttagaggatttttgtatatttcctaaaagcctaaaatgtgtaaataaattttagtggaattttcggagcacaaaaaaaataattaagaagaaataa

SEQ ID NO: 57269 - DNA, 24512 bp, Oryza sativa
  unsure (1)..(24512): unsure at all n locations
ggcaacccgagcaatgtacccaagttagtgttttaattcttaaaacctgcttaacaactaaaatgtggaatggttggcctgggttggcttgggacaagctgggacccagggtcgggttgccagttcggtctgaatcatcgtaggccttgggttaaggcaggttcgtgtgggttcacggccttgattaataatattgtatagctctagggtcgtatttacaaaatagctttgagcaactaagtgtcttttaatgctgtttactgcaaaccctaacccctatattatggctcccttgtactcccttgcatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcctccgctgtttttcgtttgtcttcttgtgtgctgggccttcgccgcccaggtaataaattaactatttacgcttccgcttgataagctctaaaatgtatcaacttttggtataccttgcctcctgggacatggaataatacacgcacgtaaggaacgcccgttgggttatttccggtcgtgacaggttattgctaccgaagtctaatttggttccgagaggggggcatattaccactaattgcatagtgtgcgattgtaatttttttgttgcaataagtaggaagtatcgcaacaaataaatttgcgttaaaattagggtgacgatattgccgcgctttttgttatcgttgcaatagttatccatgtcgcaacgaatttagagcgttgttattagagtcatgtatatagcaacgcgaaactactttgttgcaaatgagtctgtagatattgcaacgcaaacctaaatcattgaaaattagtctataggtattgcaacgcaaacctaaatcgttgcaaccattcttagatattgcaacaaccaccggaaatcgttgcaactaacaagattctctcgcaacaatatttcgtcattgctatagtttaacgaatcgttgcaataggtgaaattggtggtgccacctacagattgttcatgggcctttgtattgttaaactttaacttgtttgcatcattgtggcccgggtcggggtcatgacttacgtaattaagtcggcccggccaattagctgggctgtatcgtgtaataaaaacaggtacgattaaccctacccttagcagtcgatagatagatccctgatcatagactagctggcgccagcgacccttttatatcttgcacaattgccggcgacaccgaagcactcgacgctagcgagaccacaccctgtccctatctcccaactcgatatctcgacgccgttcgaatcgatccctatatttatatatattcaggtacctcttcgatcacgagtgcaatgaaaactattgattctttattttctatatatctatgtaattaaaaattggcttatttcattgcataccaccccttaggcaaatttggtaacaaattttctcaattggaatatggcacgtgatgatgatcatagttggatgctattgtctcagtcagattgtgtgtggcaagttggatttgaaaaattcatttaacatacatttgaaggtacccatccaggagggactgcggcctgtccatgtactaggtgtcgttgcatggcatacagaacgaaaattgaggttcaacaacactttgcttggtagagggtttgataaggatttcataaaatagaaacattctgttagtaaacctatggttgtggatgatcaggagattagtgaagccgaagttgatgatggcggctctatcgataatcggctttcttcgctaatcagagatagtaatattgaggtgccaaatgagtcagcaaagaattttttcaaattaatggaagaagatcggaaagaattatacccagggtgcaaggaggctaccatggtatctttcattgtcaggctatttcagattaagtgcatgtatggtatcagtaacaatgccatggagcaaatacttcacttattctgtcttttgctccctgagggacattgtgtcccaaatactttggataaagttcgtaaggtagtccaagatctcgggttggactaccaaaagattcatgcttgtgtcaatgattgtgtgttatttcgtggagagtatgataatatgaacagatgtccaacatgtggggagagtaggtggaaaaatatatattctggagaactcggggaaggcagtggcattggaggagtaaagaaaaaagtccttcgtcctcgtaaaatacttaggtattttccacttattccttgacttcaacgattatatatgaatgacaccacattgacctatatgcgttggcacaaggaagaaatagttgatgatgggaaagtgcggcacccagcaaactcattggcatggaagcacatagatgaaaagtacggggatcggtttgaatctgatccacgcaatgttaggattggacttgcatcagacggcttcaatccatttgggatgttgaatgcgacttacactacatgggcggtgatcctaattccatataacttgcctccttggttgtgcttgaaacaatcttattggatgatatcgatgctggtacctgggcctagatctccaggaatgaacattgaagtatatttgcagccactgatcgatgagcttaaacagggatgccaaggtgaaaaagaattttacgcttcgtgcaattctgctttggacaaaaaacggttttcctgcgtatgccatgttatcaagttggagcagaaaaggcaagtttgcgtgtccttattgtcacaaggatactgaatacttgtggttaaaatacggcaagaagcattgctacatgggccatcgccgctttttggcttcaaaccacaggtgtagaaagaacaaggttagcttcaataacaaggttgaaatgagggggactccagtggcactcagtggtgacgaagtattgaagcagtacgagagttttgagcaagtcaaatttggcatgatgtcaaggaagaggaagcaacgagatgaagatactagatggcacaactggaggaagaagagtattttttttatcttccttactggaaatcattgcttatacaccataatctagatgtgatgcgtattgagaataacatatgtgagagcttgctaggtactttgcttgatttaacaggtcaatctaaggacagtgagaaggctcgacttgatttgcaagaattgggtattaggaagaatcaccatctattggtccataaaggaaaatacactttgtcggcagccttgtacacgttaagtccaagtcagaaggaaattctatgcagatttctacaacatgtcaagatgccagatggttatgcctcaaatatcaagagatgtgttgatgaaaatggttggaaggttagtggacttaaaagtcatgactaccttgttttattacaaaaacttttaccattggtggtatgccatattttgcctgaagatgttgtgatcccattgatcgagctcagcaggttttttaacaaactatgttcaaaggagcttgaggtgactgaaattgaaaaactttgcaattcgattggagagaccctttgtcggcttgagatgatattccctccatcattttttgatattatgatgcacttactagttcatattgcttcggaggctagaattagaggccctgtttgttatagatggatgtatcccgttgagaggtacctacgtacccttaaaggctatgtgaggaacaaagcgtgcccagaaggttcaatagcagaggtatatatctcggaggagtgccttactttctgtgctcggttctttgaagatgttagtacaaaggtgaataggccagaacgtcaagaaatgtaacaccctgaaaattcaaggcaataaaaatcactaaatgtaacatacccgaattctaggattaaggaatttccatcaaaactagttgaaaggaaagttcttcaattttgtgaacgaaaaatttccattttaaaccctaggtgaagttaatctaacttgtactgaagtaaaatctgagaacaaattaaaaccttttcatctttaacctataccatagatgcaaaaacaagtgaaagcatgcatactcgtttacatcatgttttgacttaagtccttcttatgcatttggattttcgttttgcatttcataataggtctcatgaataataactaagatctagataaacaactaaaccattagggcctagtgctagctagaggaagttaaaataggaaccatacaccttaaaatatatcaaaaaggcctatgtcaagccccacaaaactaaatttggtcatccatttgaagacaagtcataaacatggaagtgaacaaataaattaactcatatagggtatattctatcttaatcatctctataagcattctcttaatttaatactaaagtaaacttatacataaataggtaaggagcttacgacatgtgtaaggtaaactataattttaacatatcaacatcaccttatgttaagaagagtccaaatataacttttataaacatttacatgcatttaggcaaaggaaaacacatataagagataagtcttactaattatctataataattcgtgaaagataaaatcatgggaaaaattcatgtaggctctaattaacatatacaactcactgtaattttggttcaatttaataacaaaatttgatacctcaaataaatcagtcaaaccagttaaataatagactaattaaaattcctaatcggctaaaaccatactttgtttaaaaatgcatttaacttcatgggagtgtataggggaaacaatttattcaaatactaggtcatttattatgaataaatatattttttccagaatttatcttctctgtttaggtctcctaaaaattcaaacagtttccattgagcccttcttcttttaatttctgtgagcaatctatccataattcgtgagtgaaaccaaataaaatggaaactaggtacattcatctacttccagtaaaatccacatgaattgatctgtaccccaaaaataatatatgaattaacaaagatgggtaagagaaataatcctgaaaatttgtctaaaatcacttacacccaattatctacccatccctcacaccaccacctagcttacaccgacctggacccacctggcagcctccttggcttgcccttcctctgtgcaacttctctagccgaccaaaactgagaaagagaccgagccaacagccctcaggcgcgtttgacacgtggccacgacgtgtcgacgatctaaaaacgccgagctccatctccgcctctcccagacgcgtcgtcactcctcacccaccattccagtgccgatccaaccgagggagagcatccttgctgcccttctccaccgtttctctatcgccggtcgcgaagaagatgatggccacattcgttgatgagccacggtcatttcctcttcttttgcattccaaaacctactctcgatgccatctctatttcatctaatttcgtcccattctatgcagcggttgagcgggaacgccaccgtgcccacaaacgccctggagcgcacaacgacgaccgctgtcgggttctcgtcgtcgttctaaccaaaccgaaccaccccaagccgaacccttgcgccaccagaatcgcctagacgtcctcttaagattctccaagaacctcatggatcggtgaatcgaggagggatatcggcgtcatcttctccatctccggccgccgacatcgatcttcgattccttgatcccgggtgagcttcagcgcaattcctgactcgtgtagcatctttagatggtctttgagccgttccactctttttcttggcagcccggagtccggatggtggttgtcaccgttggcatgccgatttccgccgccgtcgggacatcctctgcatcgtcgtcgctgtccaggcctacccgtaccgcgtccgagctttggtgagcaccctgcagcctatagaacatacatgcatgcatccctttgggtacatccagactatagcatgacatgcaccaccacccgaaaacatcctctgctcggactcgccgctggcgctactccaatgtccgctatctgataaatgtataggaatggaatcgaaataacatgatcttcattttgtattttggtcgcacccccaaacgagccatcgtttgtcgccggcgagctcgagatcgagctcagccatggcgctctgttctgtccaggtcgcagggacttcgctttgagaatttaaacaaatataagggttaatatgaaaacatactaaacactgacatatgggcctaggactgcgggttggtttctagaaatctcaagggccttcctgcatattggccgtatgactgacagcggacccctagtaacaaaatctgagattatgtaagaaaagtacctaaaacttgtaaaaaatccatagaaaatcaaatataactcattttgagatgattatgtaaactcatataaggatgaactttaatgttatgaaataaaaacttacacttgcagtacaaattacacctctaaaatttatttaagaaaaaaatatacataaagcatgcacaaacttataaaatgcatacaaaattcatctcaactcattttagggtaaattcacatttcaaggaatcataaatttgttgtccactgtaaagtgaaataaaataatatacttactttgtacctgatgcctctaaaactattatctttaaaatgaatagttttagataagctgaactttagaagttcatataaaattcatcttagatcctttttgagtaaacccaagttctgtagattcaccaaaacatatacttccaatttgtaaaataaaatcatatacttactgtgtaataaaagcctctaaatatttatgtaattaataaccaacatagagcaacatttaatttgtaaaatttgtagaaaattcatctttagtctaaatgaagtgaaccaaatttctataggaccagcaagtaatgtaattcaacctagtagagtgaaatatggcaccctctgttcataccatagctctaaaccttaatttggtagtataggtactaaacacataatagtggttaaacaatacatataaataagtatatatatgcatggtagctccaaataattccaaataaaacttgttaggaccagtggatccatagttccatccccatccacaaaaacttagaagaacttagctcatataataatttctagattgatataatatattgctagcatagactagagctcccctagtttataagaatatgaactatgataataaagaccataagcttatgaactaaggttagactagttaactaaaatactcattttgtacatcactagctagatgaggcaagttctggacctaaacctctaaagccatgaccctatgtaacactatacacctataacacgttataacttgtaaaatacataaagaattcatattaactctaaaaattgtgaaaccaaatgtgttagtcttagaaaacacatatcttcaccttaataaacttaataagaatcaccttacaacagcatttcataatagtacctaagtaaatcctacactataccgacgaaacttctaaaattcataactctcaaataaaatgagataaaatagaaattctttcacctaaattcattttagaccagtacctattcactgtgcacaaatcatgcattttagagcattttgtatttttcacatatttcggtgtttaattgcattaggtgtactttgtatagatgattgcttaaacggtgaagaagtgaattaggtgctgacattttccagttgcaaggcaagtcccaccttcctctctttgatcattttgaacctttattttggaggttattgcaaatgtttgcaaatcttgcatgtcgattgtacactaataaattaaaattttcttaaacttgttagaaaaactcctattatttgcattatcaccctaaccccacatatatccatatccatcattcctaaccataggaacaatatgactatgccactttgtatatgagtttagatgccactagattgctataatgcttagccatgcttacaatggtcttccttgtcattatgggctcattacaaacatgtcaattgattttgaaataatctggacagaactttaatacttgtgattttgataaataaaatgatggaaaacgtggattttaggtttgggctcaagtggtgcacatatggtgattagttgtgtaccgatagggggagagtgcacccaaaccgacttaaagacttcactcaatgtcagtccatttcgtatacagtacaaccacatgtgctagtatgggatagcccaagcttagtaaatcatttatggtttagccttacattctggtaggccagtgtgggtgggttcccgttgtgtccgccaccacggcgttaagtttaaggtgtgggcccgccacttaacggttctaggtcatataacgtgtaggcttaggatggagtaacacgtatcgtgctggtgtaaggctaaatcatgaattttgaaaaagctttgttgtgggtaataaatcgggtacttatgtttcgcgtgacacgctcttgcatgattattatttcgcatcatgtgggtaaagtgtacaaactctgcagagtaagaactaatcgattagccgtgctcactgtcataaacagcatgtggatatgtattgagtatagacttgtgtttattcttctaaatgttgaatttaccttcaaattatgttgagatttgagaatgatctccttgctgccatggatggcaatgaggtgcacatttatacattattaatgcctactttgatgcccatatgctaagtactagcttgctgaaatttatttgaaagaaaatttgatttgaatgtggtttatgcaaataaaacttgctttgtgctaaaaagaaccatatcatgccttccttgattatatgccttgcaagtagggtgttaggcttgtcttggtgcttgccagtacattatttctaataatgtactgattcttgccgttgaattaaccttttgcttgcaggttttagatttagtctgtgagtgatgcgcgtaatcgactgcttcgcctaggatttgaacataatggggtaaactcctagtcggtgtgcttgtggattgggtagacaagcttccgctgttctatatatttatttggccggtcggcctatgtatctctaagttagttgtaattttaatcgctttcatctttatttgtgtttgctatgtatgtccatgcttaagatgaaagtgtgaatctagtgcacatactgggaattagattcacatgagtataagttaagaatatttgagatgttgtagatctttagctatttttgtcaagtctcctgaatgtgtaacacatctggtcgccgccttcgagtggtttgacgggcacatctcaggttgaagttgactggcaggatattcctctcttgaggcgtcggatatttcattatgcttgttagatgatttgaattattcatttcatctctcaattataatggaaggtccgaagagcctacaacactaaaattttgaactttttaaaacttttgcatcatgctggatgttatggttgctattgcttgccaaatcgtaaatgatcataaagaaattaaagaaaagatctacatttaagcaatagataaaatttacgagaatatattatttatgtttaaccctataaatacacacgaaagcaagccaaataaagtacaagtcaaatattaatttctattttgaatcacaaatcaaatattaaatattcgaaccatcttgatagcttgatgtcatatttaacaaaaggaaatactaagattaaatataattcatttggatccaacctcacatgaaataatggtcaccaccataagagcatctccagcagggtcctcaaacaaagtccctaaataagttttgagagttgatgcaaaaaatataggtccagcaaagtccctactagagcccccaatctagggaggcccctagatcactcctccaagcccccagtccggggggctcaaccccacagcccccatcctctttttttttggcgggggaaatttctgagcgcgcgccattgtcatcctccctccctcccgcgtcatcgccatcctcccacaacctcccaacgagcaagccgccaggtcgttttgctccggccggcgaccacccgacatccctcgggaagaaacttcggcgagattccacagtgtgccgcctcaagccatcacaatcatcggttttactccgtcactcactgtcgccgacctccttgcatctttggccaacgcgcgtcgtcaccgatcgatcacgcctaggtgagtctcgacgtcctccccgaactagctgctcacccgctgtccacaaggcctagcgccgaccatcgacagctatctatcaccggccgcacacatgctgcagtaaaaaaattcagagatgatggtgattaaaacaaatcacaatagtaaagttcagtttcgtatgtctgagtctccttgtttgattttgatctttatgggcttcctaggcgtctaggcccatctaaatcattcgcacagcaaaacgtacattgtcatcattcatgttttatatgcaatgtcttgttctatgtcagagagctaatcttgctgagcatatataatatttaagaaataaatttgtgtttgcactgagtccttagtactgcggaaccaatatatatgctaaataaatacatattgcaaacagtataacctgatgtacattgcaatcatttgttgatgtttctgagatagattggaaaggttgtcaatttatatatttattgcagtgactagattgcaatgacaagtggaggtgattcctttgtgcgcatgatgtccgaggacactgatgtcgaagtgctaatgccaaatgaagaccttcgtacttcaacaaatggtgcaaaaggaagtgccaaaagatcaagcaactatactcgtaaggaggacattcaattgtgcatttcatggcagagcattagctcagatcctattattggcaatgagcaaccagggaaggcatattggcagaggatcgcagagcactaccatgctaaccgtgattttgagtctgataggaatgcaaactctcttgagcaccattggggtaacattcagaaggaagtaagcaagtttcaaggttgctacaatcaaattgagcgtcatcatccaagtggcataccacatcaagagcttgtaagttaaattgtttatttattattattaataacaatcttgtatgtatgtgaactaaaacttaaattatgttgcaggttcttgaagctgaggcattatactcgtccactgcaccaaagaatagggcatttcagtttaatcattgttggctcaagttgaggaattctccaaagtttcaaacactagaatcccacaagaggccacggtctaggaagtctttgaccccaattgagagagctggtgaagaagatgaaggagatgatgctagcaagagtacagctcctgatttatctcagccgagtgctaaaaagagaccaataggtaggaagcaagcaaaggagaagttgaagaatggaggagaagatggaccatacaaagaggcgatgaaagatttgcttgacgctaaagagaaagaagcgaaattgaaagaagagagatggaaggaaactaaggagattcaagagcgcaagctcttatttgctgagcgtaagttagtgtgggatcaagaacagaagattatgttttgtgatgtttccaccttggaaccggatgtgagaacgtatgtgttggctatgagggcacagattgcagcttcaaaggtggctgccctcaatggtggatttgatggtagtagtggctttggaggtgagtttggtggcggtaatggagaagtttgagcacttcgatggaataagttggattctattggatgatccacgtgtcctttactagtaggatatgccattatcacgattggtctttgaagtccttttttgttaattatttccacaataattttagtgtcacttgctagtaggacatatattactttcagatttgttatttataatcgaaccattcatggttgtaggatgtattatttttaaattatataatgcatcattgggttcacatagtttattttttatgagcaattttcattttcattggtgaattacgaatattggttgcatcttgttgtcgtatatggcactgtacccataccatatttacatgtttaaaaattttaattttgtattcgaattgtagtatttgaaattgtgaatttaagtatggttaaattatgtgagttagaaataattgtgttcgaatttttgtggtgttaaacatactgtatatggattgtattttaaaatacaagataaacatgagtagggactaagaaatagggggtactgctggagttggaggcattttttagtcattgagaaataggggcagcccttatttaacttttaggtgcttcaaaataaggtctattgctggagatgctctaatgaccctatctatatatttcactcgaatatttaacatatctttcttcacataaaattcacttatgtaaaatggttggtcacataaataactagagcaaatatatcactacctttatgatggatttaatggaatattttaaacctacatttagatattgagtctccaaaatatataagttctgatgaggacatcaacaccatcgatacatccatgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgtggggtggattcggactgcagggcagcgccaacttctgacggccgncacgacttcatgcgaactccgatttgngcgtgcaagtacttcatggaaagattattaagtctactttcaaatggatccagccacatgtccatatctattcttgagccgcccgcattgtcattttactcccgactattttttgtccatggtgctgcgtcacctctttttggccaatgggctgtgtatccatgttgggcccattaggggcccgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcaggtggtatcagagcgtggttcatcggtgagagaatttacccttcccttcgtcattaatttttttttcctatagtccagaaaagaccaacaaaaaaaaatagtagattagtttttcgatgatcctatagaccattgtgccttttccctagtacttgttagttaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccaccatcgcagtcacccaccaaatcactttctatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacggacatctacaaaaaaagttacatccgattctccccgctttgtcgggttcggcaaatttaaaatcgccaaattcctcttgcaaaattctgtttttgtggcgagaagcttcgggacctattcgcatagaactttaaaaaaattctacaagcttcatactttgtccgtttgagataagattttctgtggttggttctagtgtgctcctggttgtgaaaaaaatatcaaaaaaaaagttgtgcctctctcctcagcactagagagagcaagcaaaaaaaaaaagaggatccagcgagcacaccacaccattccccctttgtcaccaccttctaccaccggttcttgttttcgttgttgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccaccaacagctccaccacaaacccgactacagcttgacaggtcttgttgctacagcaccgatacacctcgttccacggttgctaacttgtggtgttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggcaggtccagaggataaagatgaggagggtgcatctcattccccacgcaccaaaggcatcatccaatactttacaaggcaagtgaagcagcacacagaaggacttgatacagatttgcaggtgacaaatgagaagattggacaataggagtccacgcagatctccaccaacactaagcttacagggttggagacagcggtcgcccgcattgacactagccttgctgctcttgtgaggcattttgatgctctcaatgctggaggcaatggtgggggtaatgacgatgacattgacggagagtacatcgaggataatttagaggatgaatatattgctgacactgaacaagatgatcgagatgctcaagatcgtcgacggctacacaacaatcgacgaggtatgggtggtcgccgccgacgcgaggtacgcaacaatgatgatgctttttctaaaattaaatttaagattcctccttttgatggaaaatatgatcctgatgcgttcctctcttgggagattgctgttgaccaaaaatttgcataccatgagtttcctgagaacactagagttagagctgctacgagtgagttcaccgattttgcttcggtttggtggatagaacatggcaagaaaaatcctaataacatgccacaaacttgggatgctttgaaacgggtcatgcgggctagatttgttccttcttactatgcacgtgacttgctgaatagattgcaacaattgagacagggtgcgaaaagtgtagaggaatattatcaggagttacaaatgggcttgcttcgttgtaatttagaggaaactgaggacactgccatggctagatttttgggtgggttaaaccgcgagatttatgacatcgtagactataaagattacactaatatgacccgattgtttcatcttgcttgtaaggctgaaagggaagtgcaaggacgacgtgctagtgccaaggctaatttttctgcaggtaaaacttcatcatggcagacacgcaccactcctccggccggccgtactgcttctccatcttccacacccacaaccagtcgagcagcacctcctccatctagtgacaagtccgtgacaaaggccgctcagccagcaccgagtgcttcttcaatggtatccacaggccgaatgagagatgttcagtgccaccgttgcaagggctttgggcatgtgcagcgtgactgccctagcaagcgagttttggtagtcaaaaacgatggtgagtactcctctgctagtgatttcgatgatgatacacttgctttgcttgcggctgaccatgcagataatgagccaccggaagagcacattggggctgcatttgcggatcactatgagagcctcattgtgcagcgtgtccttagcgcacaaatggagaaggcggagcaaaatcagcgacacacgttgttccaaacaaagtgtgtcctcaaagagcgttgttgccgcatgatcattgatggaggtagctgcaacaacttggctagcagcgagatggtggagaagcttgcacttagcaccaaaccgcacccacatccatactacatccaatggctgaacaacagtggtaaggtgaaggtaacaaaactggtgcacattaattttgcaattggaaattaccatgatgttgttgaatgtgatgttgtgcccatgcaagcatgtaatattctgctaggtagaccatggcaatttgatagggattctatgcatcatggtaggtccaaccagtactcttttctgtaccatgataagaaaattgtgttgcatcccatgtcttctgaagatattttgcgtgatgatgttgctaaggctgccaaatccaaatgtgagagtgataaaaaagcccaatctgatggcaagaaacctgagacaatcaatttgaaacccaaatgcttacttgctactaaatctgatattactgagttgattgcatcaccttcagttgcctatgctttggtatgcaaagatgctttgatttcacttcacgatatgcagcattctttgccccctgctgttgctaacattttgcaggagtactctgatgtgtttcccaaggaagtgccaccggggctgccaccggtgcgcggcattgagcatcaaatcgacttgatcccaggtgcttccctaccgaaccgtgcgccataccgaaccaaccctgaggaaaccaaggagattcagcgtcaagttcatgagttgcttgataaagggtatgtacgcgagtctcttagtccatgtgcggttccggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagttgatttgcgtagtggttaccaccagattcgtatgaagttgggtgatgaatggaaaacaacatttaaaacgaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgacccatgcacctctcctccaacttcccgattttaataagacttttgaacttgaatgtgatgctagtgggattggattgggtggtgttttgctacaagaaggaaaacctgttgcatattttagtgaaaagttgagtgggaactttagataaggaattattctacttatgataaggaattgtatgctcttgtgcgaactttagaaacatggcagcattatttgtggcccaaggaatttgtcatacattctgatcatgagtctttgaagcatattcgtattcaagggaagctgaaccgtagacatgctaaatgggttgaatttattgaatcttttccttatgttatcaaacacaagaaagggaaggagaacatcattgctgatgctttgtctagcagatacactttgttgacacaacttgactacaagatttttggcctagaaacaatcaaagaccaatatgcgcatgatgctgattttaatgatgtgttgctgcattgtaaggatggaagaacatggaacaaaatcgtcatcaatgatgggtttgttttcagagctaacaagctatgcattctagctagctccgttcgcttgttgttgttgcaggaagcgcatggaggcagtttgatgggacattttggtgccaagaagacacatgacatccttgctagtcatttcttttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattctgtgttaggattgcctaggaccaagagggggcgtgatagcatttttgtggttgtggatcgattttctaaaatggcacatttcataccatgtcataaaactgatgatgcttctcatattgctgatttgttctttcgagaaattgttcgcttgcatggtgtgccaaacacaattgtttctgatcgtgacacaaaatttcttagccatttttggagaactttgtgggctaaattggggactaaacttttgttttctactacttgtcatccccaaactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggagttgaattttgaacctggagatatggtttggttgcatttgcgaaaagaacgatttcctgatttgagaaagtctaaattgatgcctagagctgatggaccatttaaagtgttagcaaagattaatgagaatgcatataagattgatttgcctgcagatttcagggttagtcccacatttaacgttgcagatttgaagccgtatttgggagaagaagatgagcttgagtcgaggacgactcaaatgcaagaaggggaggatgatgaggacatcaacaccatcgatacatccacgtccccccatatacagcatgatggtcctattacccgcgctcgtacacgtcaactaaattatcaggtgagttctttcttgagttcatattcctcgtctttatacctcggagacgcgtgcactcgtgttttactcaggaacgatggagaggatccaaagggaagaggattcgcgtggggtggattcggactgcagggcagcgccaacttctgacggccgccacgacttcatgcgaactccgatttgggcgtgcaagtacttcatggaaagattattaagtctactttcaaatggatccagccacatgtccatatctattctggagcggccgcaattgtcattttactcccgactattttttgtccatggtgctgcgtcacctcttttggcccaatgggctgtgtatccatgttgggcccattaggggcgcgtcctagggttggagcacgaccctattgtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttttctagcaatctcagtgcttgtcctacttgttcttgcttgttcttcgattgcttgcaggacgagtgcccttgtggccgggttgacgcgcaccacaagttcgcggcgaccattggagacggtgtatcggttgctaaggtgcagcgtctttggacagttgtagtcgggccgtgaacgtcgacttcatctaatcgagttatcccttacctctcatcgaaagatcgggccacaaaccctagcgggttcgcatcaagttcaccttgggaaaaatccaaattaatctaaaaacaattcaattgtgggtgaataaataaataaccaaataaagcatttgaatttacaaatccaaaatatgttgagctacatttcaattccaaatccaacaccattttgcagattagcccttccacttttcctttttcctttccttcttttctctctttcctcctgtcggcactattcattgcccaggacgtattcgttctgggcccaagcctcttccctgtgtcacgcatgccatccctgtcaccatcgcgcgccgttgcagcgccgcacgaacgtcgccctcgcgtcgccgctcctgccgcgtcgagccccgcgtctcacgccgtcgtgtcgccatcgccttcgctcagccgcgcgctgccacgtaaatcgcccatctatgacgttttcctcatgatgttgtatattttcgtcattgaatagaccatatctatgacaaaattttctatttcgtcatggatcagtcatggcgggataggtaccaaaactctatgacgaaattaaaaatggcgtcaaggtacaatagaaaatttcgtcacaaataatgcacacctttcatttattaatacctgttggtcccacagcgcatacgtggatatccaaatttcatttattaatacctgttggtcccaccgtgcatatgtggcactggtcccaccgcccgcccaaattatatgtgccactggtcctatatgtggctatcattttttttataaaaaaaaatacacctgggaatcgaacccagtccatgagcatttgcgtaagaagctctaccaccatgatactaagatctttgagtgaaagcttgtttttttgttaattgtcctttatgcggtgaacctggagaggacgcggcggccgtggcgccaccatgtggaacacacccactcggcggtgtcgtgtttcatcatctcccacgttgggctgttccccaccaggtggtttggatctgaatccccttgaatagttgatttacgattgtgccctcattatatgtgtgttgtagtgttgtaccgatatgaacgaggggtaagtcagtccaaaccacaagaaaattcacaagaatagcagcaggtttttacttttaatgcatgaataaaattttaaagtagtttatctcactcatatgagttcgaaattagacgattcctttttcattattcatataaaaatattgtctacaatttcgagcacgtttagaatgttgtcaagtaaacagtgaagactcataaattgaaattcaaaattttgaattgtagaacaactgtgtggtttttcttttaaatctctaggtaaaacttgtagaaagtctttctccctcatactgacttcaaatttgattattcttttttctacaaatttctaaattcatgatctatcaatttattgtgttattacaactatatttttgtttactgctagataaattaatccgagctggatgtgcatgtgcttgaaagatggacaaatttttgggtggtaacttttgcactgacttcctattagcaaatggtaagaatggtcacttgaaccatagtgtccaactgatctacttagtgatgttgctgccacattgttaaattttggaagtgggaaaatgctcttttgatgtgttttgggttcctgcctggcatttgcactccatattgtcgtggaactgttgttgtatgcctgtactttgtagaaatgaagcatgtttaaattgtgtccataactttacaccacactttacggtcctgcatacaaatctgtatatctaaatgctatatgcctatagtctgtagaaatgaagcatgcataggaagttacttgtatcataactttagtgtcgagaaatgtccaggggtcttccggctagctccacaaggtggtaggctagacgacctgggttcaaagcctcacccctcctaattatttgatattaggtccttccctaatattctagtttttttttatcataactttagtgtctaatttttagtgctacactcctatgcattctagttcagttgcttgtttgtttggccagtgaaatgaggtgggttggggatggtgacattgagttctgttagtgcaatatattatggggacatcggattagtgttgcaaattagccctttcattcaaaaactaatatcgtatctgtcgattgtttcttgttgtttctctagcgcataaaaaaataatctaacatatggtactatcctatcaggttgctgtgctcctccccatcaccctcgggcaggtcagaaaaataattgatcctgaattattattcagttgtatctgatttggagaataagaaatttgatgttgatataatctgaaacttggttttgtttgattgtcaggtgttgatataagctgtcttagtctcctttattatcttatgcactgtgatgaactccatctacttattttagttgtgttgatgcttctatgagcttactgtcgtgtggtggacttggttatgtaaaatgatgtttggtgctatggtggacttaaattatcatcctgtggtaaacttttgtggacttaaatgtgaagatatgtgtactaggttgtgtgaacttatttgtaatatggtgctatgtgaagttggtatctgtgttcaatgttgatgttgggcctattcataatgtcctgtgaagttctaattgttgctccaaattggccaatgctaaaaattttctagacctaatagtgggttggggccacaactagatgtaaaatgtgtggctaaatgggttgggccaagacaaatgatcagtgggccttcatcctaatgtgtttgacacgtgtcattgaaacagattaacacgtggctatatcaggtaaagacatgtgtcattaatcagatataaacacgtggcgcctcaaaatgagaacacgtggcgctgccaccttcagtcacgtggacatatgaaatgccaacacgtgggattaaatacgactgccacgtggctctagtatactggagatgctaatccaacatggagtacatgtcatctgccacgtcacatctgtcacaccccgaagttccttcccaagcctaaattggagttttaaatggtctcaagaaaatacctgtgtcaagcaagagcaaaccttaataaattaatgcaaataataatcggaattggcatgtggaatttttcttaagttttacatgccgaaatacgctaaaaagatttttagtggaattttcagagctctcgaaataattttaaccaattaaaattgagcacaagcaattttaatcccaggaaaaatcctttttccttctttttcctttttctttcttttcttttctttttttttcctttgaatgggccgccggcccattcctcctttttctccccctcctcccgctgggccggcccttcggccggcccagctaagccgcgcgggccggccgcccagctcccctctctccccgggacaccgacaggtgggccccacctatcggggtcgtccccttcctccggccgcccgctccacgtcgccaccaccgccgaaactgccgccacgcccacctccgcctcctccgggccacgacgtccatgtcgccctcgcgcccgcgcctcccgcgcccactcccctctctctctcccgcccgcgcccgcgcccgagatggccgggatccgattttcgaatcccgcctctctctcctcccctactccccgcgttggccggcggaattccgcccctaccggccacgtccgggattcccctcccctatttaagctccgtcgccaccccctctctctttttccccattttgccgaactctcccgagctcttgatcgctcccgcaccgtgcatccgcccgccgccgcctttcccaccactccggccgcctttacccgcc

SEQ ID NO: 57270 - DNA, 9031 bp, Oryza sativa
agccaaggcctcgaacaatgggaagctagtgaggatcatagctctgaaggatgagatagcacgcttgaagaaggagaatgctcagttgaagggtctcccagcgccaggaggagtccggatccgcaccacgccccgcaagacggcgactgcacccgtgcgcattcagcttgcgcccaggaacccacctccgcccgcaattctcgcagctccagctccaaccccagctccagttccagtgccagctcccgcgtccgctctctccttcgctccagcgtcagctgccaggggtccagccagtggcaacggaggttggttgtctgctactcccagtggcagccgcgaccacagcagcagcagttccagtggctcagagccgggcagcagggagacgtatctgccagactccaggagccgctaagagggatctggtgacgagcaggaggatgccttcgactccaccgaccgcaggagccgttccgagcattaggcttgctttccattagtttatcgactgtttagcatttgcctgttagtttgagtgtttaggtctgttcgcttgggggtcagtcgacggtcgatatcatatgcctatgatatggctgtcctaataaggatttttgcttgctttttaagtgttttaattcagatcagaacaattgcagtttaaattcctatataataaagcttagttcctgagcatctgtttttcttcttttcccccgtctgctcttcctcaagatggtctacaccaggaatggtaaccgtgcaataggcgagggcagcaacggcgaagaacgcactaacggtgtgcatcccaaccgtgattccggcaatggtccgccaccactccccgagaatccgacccttgcccaagtaatggctcatcagacgcagatgatgacagctatgatgcagcagatgcagcagcagcaccagcagatgtaccagaggatgcagcagcaagccgagtagcagtagtttggtccccctccccctcagtccaaactgccggagtttctacgcgttagaccacccaccttctccagcaccaccaaccctatggaggtaaatgactggctccatgccatagagaagaagctcaatctcctgcagtgcaatgatctggagaaggtcgccttcgccacacaccagctccaaggtcccgcgtcagcttggtgggacaatcatatggctacccgcccaccaggcacggaagtcacttgggcggagttctgccgcagcttcaggaaggcgcaagtgccagatggggtcgtggcacaaaagaagagggaattccgggcactccaccagggcaacaggacagtgacggagtatctccatgagttcaatcgcctcgcgcgatatgcaccggaggatgtccgtactgacgccgagaagcaggagaaattcctagcaggtctggatgatgagctaaccaaccagttgatatctggagattacgccgactttgagaggttggttgacaaggcaatccgtcagaggatcagcgcaactaaatggaaaggaagaggaaggcagcgcagttccggtccaaccaagggagccaccagcgaccgcgcttcactcccggacagcaaggtggacctaccaccctaatcgtccgccagcaccgccctttcagtgccagcaacttccatcagggcgccagtggcagccagaaccaccatggcggtcagcccaaccgcagtgcagctccactcccaccaatggctccagcacagtcagctccgtccgcgcaagccaagaaggagactgggacaaagccagggtcttgcttcaactgtggcgagcttggccacttcgctgacaaatgcccaaagcctaggcgtgtcgggccaaggtttgtccaggcccgtgtcaaccacgcgtccgcagaggaggcgcaagcagcaccagaggtcgtactgggtacattccctgtcaactcagttcctgctacagtactttttgattctggtgcaacgcattctttcatttcaaagaaatttgtggggatgtatgggttaagaaaaaaagagcttagtacaccaatgaaggttcataccccaggaaatagttcaacctcggtcagttatagcccttcagtgctaatagaaattcaaagatcaccatttctagccaacctcatccttctcgaatccaaggatctagacgtcattcttgggatggattggctgaccaagtttaagggcgtcattgattgtgcgaatcacacagtcaccttgaccaatgagaagggagaaaccgtggtgtacaagtcaccagtctcaccgaagcaaggaatctccttaaatcagattaaggtggaaaaccctgtgaccaccggggagaagagttcgcggaaattggacgatatccccatagtctgcgagtacccagaagtgttccccaaagacctcactaccatgccacccaagagagaaattgaattccggattgatttggcaccaggaactgcccctatttacaagagaccgtacagaatgacggccaacgagctagcagaggtcaagaagcaagttgatgagtagctgcagaaagggtacattcgaccaagtacttcaccttggggtgctccggtcatttttgtggagaagaaggacaagacgaagagaatgtgtgtcgactatcgcgtactcaatgaggtcacaatcaagaacaaatatcctttaccgcggattgatgatttgtttgatcagctgaaaggagctaaagtgttttctaagatagacctgcgatcaggctaccactagttgagaattcgggaagaggatattccaaagacagccttcaccactcggtatgggttgtatgagtgcacggttatgtctttcggacttaccaacacacccgcattcttcatgaatctgatgaacaaagtgttcatggaatttctggacaagtttgttgtggtcttcatcgacgacatacttatctattcaaagtccgaagaagaacatgagcaacatctccgtctggtactcgagaagttgaaggagcacaggttatacgccaagttcagcaagtgtgacttctggttgtcggaagttaaatttctgggtcacgttattacagctcagggcgtggcagttgatccatcgaacgtggagtcagttaccaaatggaccccaccgaagaccgtgtcgcagattcagagttttcttggacttgcgggttattaccgccgattcatcgaaaacttctcaaggatcgcccgacccatgacttagttgcttaagaaagatgagagtttaaatggacagctgagtgcgacaagagttttgaggagctcaaaaagaaattagtatccgcaccagttttgattctgcccgaccagatgaaagacttccaagtctgttgcgacgcatcccgccacgggcttggatgtgttctaatgcaagagggcagagtggtcgcgtatgccttgcggcagttgcatccacacgaagggaattatccaactcatgacctggaattggcagcagtggttcatgctttaaagatctggagacactatctgattggcaaccactgcgaagtatatacggaccataagagtctgaaatacatcttcacccaaccggacctaaatctctgacaacgaagatggttggaactaatcaaagactatgacatgagcattcactaccacccgggtaaagccaatgtggtggcagatgcgctaagcaggaaaagctactgcaatgccctatgcatcgagggcatgtgcgaagaattgcagcaggagcttgaacatctcaatgtgggagtcgttgaacacggattcgtagccgctctagaagcacggcctacgctcgtcgatcaagttagagcagtgaatgatcttgaaatagcagagctgaaaaagaacatgagagtcggaaaggctcgggatttccttgaagatgaacacggcacaatctggttggcagaaagattgtgtgtacctgacgacaaagaactgaaggatctgatactcaccgaggctcatcagactcactactccattcatccaggcagcatcaaaatgtatcaagacctcaaagaaaagttttggtgggtcagcatgagaagggaaatagctgaattcatcgcactctgcgacgtttgccagtgagtgaaggcagagcaccaaagaccagcaggtttactccaacctcttcaaatcccggaatggaaatgggaggagattggaatggactttataacaggactgccccggacatcatcgggccacgattcaatctgggtagtcgtggatcgactcactaaggttgctcacttcataccagtacataccacgtatacgggcaaaaggttggcagagctctacctctcgagaatcatgtgtctacatggagtacccaaaaagatagtatctgatcgagggagccaattcacttcaaagttctagcagaaattgcaagaggaattgggaacccggttgaatttcagcacagcctaccatccgcagaccgatggtcagaccgagcgagtcaatcaaatattggaggacatgttaagggcctgcgcacttgattttggtggagcttgggacaaaagcttgccgtatgcggagttctcttacaacaacagttaccaggctagtcttcaaatggcaccgttcgaagcattatacggccggaagtgtcgcacccctctcttctgggatcagacaggcgagtgtttggaacagaggtgctaagggaagcagaagagaaagtcagaaccatcagggaaaggttgagaattgcccaatctcgacagaagaactacgcggacaaccgccgaagggagctcacttttgaaacaggggattacgtgtatcttcgtgttactccgctccggggagtgcaccgttttcaaaccaaaggcaagttggcaccacgtttcgtgggaccatacaaaatcttggaacgaaggggagaagttgcttatcagctagagcttccttccaacatgatcggcatccatgacgtgttccatgtatcccaattaaagaagtgcttgagggtacccgaggaacaagccaattcggagcacattgatattcaagaagatctgacgtatgtggagaggccacttcgaattcttaagaccagtgaaagaagaaccagaaacaaggtcactaggttctgcagggttcagtggagtcaccattcagaggaggaagcaacctgggaaagggaagatgagttgaaggccgcccatccgcacctcttcgccagctcctccgaatctcggggtcgagattccgtttaagagggggggtaggtttgtcacaccccgaagttccttcccaagcctaaattggagttttaaatggtctcaagaaaatacctgtgtcaagcaagagtaaaccttaataaattaatgcaaataataatcggaattggcatgtggaatttttcttgagtttacatgctgaaatacgctaacaagatttttagtggaattttcagagctctcgaaataattttaaccaattaaaattgagcacatgcaattttaatcccaggaaaaatcctttttccttctttttcctttttctttcttttcttttctttttttttcctttgaatgggccgccggcccattcctcctttttctccccctcctcccgctgggccagccgaaggtccaggcccagctaagccgcgcgggccggccgcctgcctcccctctctccccaggacgctgacaggtgggccccacctgtcggggtcgtccccttcctccggccgcccgctccacgtcgccaccaccgccgaaaccgccgccacgcccgcctccgcctcctccgggccacgtcgtccacgtcgccctcgcgcccgcgcctcccgcgcccactcgcctctctctcccgcccgcacccacgcccaagatgaccgggatccgattttcgaatcccgcctctctctccttccccactccccgcgttggccggcggcatcccgcccctatcggccacgtccaggattcccctcccctatttaagctccgccgccaccccctctctctttttccccatttcgccgaactctcccgagctcttgatcgctcccgcaccgtgcatccgcccgccgccgcctttcccaccactccggccgcctctagccgccgctagactcgccgccgcaccgcgccgtcgccgccgtcgggttcgcgtggccgagatccaccccgtccgcccttcctccgtcgagtcgtcaccggaacccgcatcccctcgcgctctggtgagctctacccctaccgccgccttcggccatggtttctgattgctgtagttcgtctccctccctctaacctctctcttttcctcccttagggcattccggacctcgtccgcccgccgccgttgtcctcccatagctcgccgtcgccgttcaccgtcatcctcctccgtgccggccactctcggtgaggcactcccgctcctctattcccctccctctccctcctagccgcgccgggtcgagccgccgccccggtcgtcgccgccgccttcacgtcgccttcgcgccgccgcctccgctgccggttgccatcgctggcaacgcgtgcgcgcgctcgcgccgtcgccatcgccgtggccggtcggccggccttgagccgagctgagccgggtcgccgccaaccgtccgatcggccccgaggtgatctgggccgtcggtcccatggaccggtggtggaccacccgcgtggtcccggtccacggtggaccggcagccttaggccgctgacccgggggccccacttgccggcgcccctctctccccttgagctgctgacatgcgggccccgcccgtcggcgccgccgcccccttgatgacgtcagccctgggaattaattgcgcaataaattatttaaggactttttgttatagtaataaacacagtgaatcttataaaattcataaataattcatccgtgctccatttaagcccattcaagtctcagtaaatcaagaaaaatgtgtagaatccattaaaaatggttttgttctctgtttcagtagtcttatagcctgtttgcattgtttgctttgtatgtcgcttagattccggttcttccgacgctccggtgtacttcgaaatagtcaccgaggtttctccagcagcagagcaaggcaagtcatgcttgtcacttgaacatgttgatcctatattgcaaatgctctattgtttttcttcaaatactgcattgttttataatgttactatgggatgtttacctattgttacagccatgctattttgataccatgctcctttgttagcttgggttataacatgaatagactttggactaggaattgcttagccatgcttagttcaactagcacacattggggaaaaatcctattaatgtttagactgtaggttctaatggtaatgttggattagtgacaccgcttcggtgttggttaattaaaatgaatcacatggcgggctgtgggtgcatggttttgttggtcgcacccatggcagttaaggaccggttcacgggatgccctgaaagaacttatcgtacttaccacaagccagcgtgggcaacggctgggcttgtagtgtagcttttctctagccgacgcatccaggcaagggtgggcgtgatggagtttggatgggccctgtgacggcctatgcggcttccgaattcacctaggcacaagaggggactgcccgctgccttgcgaggagtggggttgaaacctgaggtgtggtgtgcttggttagagggggttatgcgaatggtcctgtcacggcctctttccggtatgtcgtggtggcatgtcggcgcacggaaacatgtcgtggggctgtgtcttgtgggtacagttgtacacctctgatcagagtaaaactattcgaatagccgtgcccgcggttatgggcggtcaaccagattcaccgtgattagtctcaccctagtttaatctaatgaaattggatagtttaggtggatggttgggcccgttgcaacgtgggatagcgttggacagcggatgattaatattgattaattattacaactgtttaattcttacaacttctgtttataaatgctcgctttatgcaaatgaaccactctagctctcctttgataattccctgcatcatacccctattccggtatggcttgctgagtacagtgggtagtactcagtcttgctctattttccccaacccaagagtacgagtatgtgtcagacagtgatttctccgaggagtaggatgcctgtggagtggtgttcccgctgcagatcaagtcaaggctcagctccagttatctttcgtttttccgctgtatttatgtaagacttttatgatgtttgtaagacgtggatctgaatgtcaacattgtcatttgtgtaccccggccggtcctggacggggattttcatgcacattctgcttggaattctattcgggaatttctgggcgtgacaacatccaacgtggattccacgcataacatggagtacacgtcatctgccacgtcacatccaacgtggattccacatatggcagccacgtggcttggacgacgcatgtcactagccagctggaaagcaattctgtgacgagcaccttcgtcatggatagaagcatttctatgacgaaatctaccattttgtcatagagaaacttatgtgacgcgagttctatgactaatcctatttcgtcataagttcatcatagatgttattttacgacgattattgcatcttccatgacaaaagtagatcatcatagatgtaccgatctctactagtgcacgtcgtcgtgtcgccgccatcgctatcaccacctcgagcaccgcccgcgccgcgtaccgttgccgtcgcgcccgccgtcccatcgccgttgcccgtcgcgtcgccgccctgagacacgcaccgccaagccatgtgccactgctgcgccgtcgtccgtcgcgtcgcaccacaccaagccccgtgccacgtcccgtcgccgcgcgccgtcccatcactgtgccccg

SEQ ID NO: 57271 - DNA, 9636 bp, Oryza sativa
agacgacgatgtcgaacaatgtcgttgtagcttgggacagcaaaacaacaacatccttgatctcggtgaaacgacggcgtgggcgacgcaaaccgatctctgatcggaaaaggaaaataacagcagcaagcagcaatatgccaccaaaaccaatctgaacctcgagctcatggcattgatggctttcctggcagcatggaggagctcacgtgcagcatgttgactcaacccatgcatgcatatgtgccactgcagacgtcgagcatgtatgctcgtagcgtgcatacacaggtgcagaacagccagagccacgagtagacggtaacgatgagactgctgttggtgctgcttgacgcgaacgacgaacgtcgccgcccaaggagattgagacatcctcccacacagcaacaaaacacgaggccgcgtcgagatcaagattgatccttcggtggcaaaccatgatgatgacatgacgccaggagatcgatctctccgaggagaacaatgacgacgactggaagaaaaaaaggtggccgcccccgggagcgagatcgcctcccgggggcgacggcagccgaagcgattagcatcactctgataccatgttggatagaataggagagatatactatataacgtgagatgattgtattgagcctcaagtgactggaatatataggagtacatgtggaggagataaggaaggattacagataagaaaggaatccatacaaatcaatccaatcctaatacatctctaactacaatatactctaacagcaatgtgcgcctatgccctaaccgcctctagcccagcatctagcccggttggccatgagctggtgagcttatcaatcttagcttccagcacaagcccctcactcgcctataaaagacctcccagccttcacgagctcgtcctcccctctctgccttttcttcacccttctacacatttcgtcgaacatcttgtgggcgtgctgcagcttcttcccggctccaccgccgccgcggaacttcgtcgttccgccgtccctcggtaagtcctcactcctgttactcctcctattcctctaggaactacctcccccaactatttcgtcgattagggccataatcgtgacaagcccgagctccgaagctccgcccaaggaggtcaccgtggacatgccatcccgggggctctcccttcgatttttctagaaaaacggaaccctcatgcgccataaatgctcacgccctcaccaatttggtcggaaaccctccgtatcgccctagcacctagctacccgtgcccggccatggcggccatgcggcgcctctcgcccccgcgccgtcctgtgccgtgactgccggcaggaggacaccggagtcttgccgctccctcccctggtcaccgtcgggtcgccctcggccggccttgctgcgcgcgccgcgtctcccctgctgctcccgctcggtctggaggtagaagacgatagagagaacgagaaaagagaagagaataggttgtgggccccacctgtcattagcaccatccaatttcctttagaaaataattcggtagaaaaaggaataaacccggggtcccacttgtcagtcggtacaaaggctaaagatatactgtatttcggattaaaaataaatgaattatgaacagtagcttttcacaatttctccgattaattcgaaattgaatctttaaactagtataacttgctcattttaactcggatttgagtgaaacttgaacctaaattcatctaaattcataagatttctaatggtatataattcactatttaataaaatacatttataattataaaataattaatatcaagtaattagataatggtcaacttaaatatgtgctcataaataggattgatattttacagtagagtagatgtaataatataggcctttaacatgttttgtcactatagcaaccccataaattagttataatcaatattttaaattaatggatgtataggaaaataatagtgctgtttattaatctatgtcactactcgaaaatcgatttttcatggcgtttggaaaatatttttcatggcggccatgtggaaaaaccgccagcacagaaaatcgtgggggtggggggtcaagggccgccagcggaaacacatcttcgctagcggtgtacttaagaaggccgccagcgaagataggatatcttctttggcggctttcttaagctcacgccagtgaaggtattgtatgttcgctggcggtaaggggatgcggcccaccaacgaagatgtaggtgtctttgctggtggccctcttaacttaacgtcagcgaagatatcttaacttaacgccaatcttcgctaacggtgtggtgacgtggaccgccagcgaagatacctacatcttcactagcggcgtcctcaaccctccgccacctcaaatcattttgaatggaggttcaaacaaaccgacatatgacgaccgccagggaaaacacgctgaactatatgaaccagctacattaacctcgagcaccattaggagcacgattttctctctcttaagaacacatacatagtggggaaggttttgatcttgaatcttttgaaagatttattgtaccagaggttagttatactttgtcctactctttttgtcaagttttttttcatttttattggttgtatgttgagatttttcatcacaaaaaatacttgacatggaggaacaaaaacattttttatttgttatttggagctcaaaatggcaaactttgcaagaaatattgtgcatgatccatgttccatatatatatatgtagttttcaataggtttatttttagcagatttatatattagttacttgcaaaagaatgagctagctaggaagagaagagaaagaagggtagtttggtaattcgtccgagggatgtatgttttatatatgtagatttttggctaggtttaattatcttgttcaaaatatttaaaataattaaagttgtattatttttttcgcaattaattaattaatgcatagatggcggacagggcatggatgtataaagagagatatcgtgcgtcatatattgaaggagtcgacatattcatgaaagcagctaagaagaatgctgcatctaagaagacaaaagatattagatgtccatgcgtacactgtaaaaatcagaaaagttggaaggatccatctgtaatcgaacaacacttggtaacgcatgaatttgttgcacgctacacaaactggtcacatcatggagagatcccaagcaagcaagttccgaaccaggctacagtacgcgacgaagtgttgagctgggacgaggatgtcattgtagtagctcaagaagaagaagaagtgcatgcagtagaacccgttgatgatgatgatgttgttggtggcaatggttagcacagtacagttgatgatgccgatgatggtaatgtcagcgtagatgtcacgcctagaaattcacaagtaatttccgaactaatttgtgcattaaaacactcgtgcaggaatcagccgaggtacacaaactgacaatttaatacacagattcatcaaaataactaaaacgataaatacttacataagagacacttagtcctcaccatgaagaaaactgcagcagaaaacaaaatctagcgaagcttcagctccactcccataggcagctcaactgggatctaagccaaaggtcttctccttctggatcctttctcttcaactgaggtttgatgattattgcaaggtgagtacatggaatactccgcaagccacacagcaagtatgcaagtgcacatggataccaaaggatggcataatatagggttcatttgcgaaagcagcatttagcaaagggttgagaatttgtaaaacagtagagtaattaatcatccatattaatcaacactgaacagcaccccaatgctgcacaggcccaaccaaacctgaacaaccaaccccggtcgtacagatcaaacctccaaacaaggagtcaaattaattatcacattgttgtcattaatgagtagtgcgggactaatcacgaaaaacattgttagacccgcccataaccgcaggctcagctattcgaatagttttactctggccagagatgtaccactgtacccataagacatagttccacgacatgtcaccatgcgcctcaataccaccacggtacctcggaaaggaactgtgacaataccccttgtacaacacaactcaccacagtgcaccattcctggatcataatcagcccctcaaaaaccagaggcattaactccccagcgactcccacggacttctcgccgcttcttagtctggcaccccataatgaaccatgctatacaaaaggtaaagccgttgcccatgctgacttgtggttggcacggttaatatttcacaacagtatctcacgaaccggtccttaattgtcatgagcacgaccttcaaaaccatgtgctcaccacccaccattaatcagattttaattatcaattataattatcataacacgattcaccaccgtgagctaccattaaatataatggtaagtaatagtgaagcatgatttatcccattaatgagttaatgtttctaagcatgactaagtaattttgtatatagcatttagctgaaccaaaccaatatataaggtccaagctaatcaatttattacccataggaaattaaagtcatcttcggccataattaaatgggaaaggctgactacccaatgacaatcgaaaataatgcataagttgaaataaaacattagctttaaatgggttcaacatgctcaaagggttgtttgggatctgtgtgacttgccttgcaaacaagcgtcttcaattcgtctttaggaacttctccaacgaacgaacgatcctccgaaacaacggaaaactaaacctagaacgcaaaaccaggaaaaacactaataaaaaccaaataaacagtacaattaaaattcataaataggtagagcttgaatttagatgaattatgagacttgaacgaactcattttgagttcgtatgaattagctatgaattttacaagatttaatataatttagccttatatagaaaaggaattacgatttatttggaaacgaaaaacgcgctgacgtcagcgatgacatcatcaccggcaacggactggactgcaaggtcgcaggtgctatgaggctcggccgggctatccgagagcactaacgcgaagaggacgacgagacgaactcacccaagggcggcacgaccacggacgacgacgggagatggccggctacgagattgagatggcggcatggctctgtccacggtgatgatggcgtttcggtgaggggagacagcaaatgaggggcggacggtcttcacctcgctcctgcgatcccgtgggtggcgaaggcggcgatggacggtgatgagcggcactgctaaaaacgcggtgacggaagatgagcggcacagccttcacggtgacggagacttccggtgggatttggaggaaagcgacggcgtaggtcggggacgaccgaagaggcggcgcgacgtggctggagcagctgccggcaaaggagagagaagccgagcgtggcagcggctctagggctagggaaaaattcaggaaaaaaaggaggaaacggaagaggaggcccgaggcatgctatttatagccaaaggaggaggagatcggctcggatacgaggggaatcggcggcggaagggctagggttcgccagcaaaatagaagataaactccacttcgaatccacgcgatataccacgggatatactccgattcttgaggggaaagaaagaggaggataagggcaacaaatcccctcaatcaatttcggaaacgggacacaagatgcgacggatttggcggtggtagcggctgcacacacggctcggcagggagtctggaggttgggggcgacactgtagcagagggacacaatacagacttcttgccgggctttctttctcggcccgattggaagagggagacaaagcagacttcgccgcgagagacagccgctgctcgggctgaagaagagagagagagaaaggagaggagtgggccggattaggccggatttggcccggagctaggaagagaattttaattgattttataatttaaataattgctgaaatgatgtttcatttattaaaaataattccaatgctcaaataaatccaagaaaaatcctgaaaatacttgggcacacaaagtatttaataaaattttatctatatcaatttaactttcaaaattttcatagattttattcacacacttactttaattattaaataatctccaacaattcctttttcacaacgatttataatttagcgattttcagggtgtgacaaatccaccctcttacagaaatctcgtcccgagatttggaacggctagcaagaaatcggatagggcaatcctttactgaccactctgttgaactgactagccaatctgacatacctttatctaactctttttttcttccttcttccaatagaactaacacctaacataatcctcttgtagacattgtcaggtctgccttttgaaaacattatcccttcaacctttcgaatgttgatcacaagatctccaaacattgttgtattcgatcaaaggttccgctttagcttttccttggaatactttgaagtatatcaagtccatagaaattttgcctataactggagtcaaattgattcccatgattccactttagtccaatccaacctatcatggtaaaatgatttcctcttacattatggaaacaagtttcttatcctttaagtatattagtgaaatatctgagccttctcaatccgggcttaaaaatgctttaaattgatagctaatcctgaagtatcttctttgatctgacctttatgtttttgcagtaaaaataattattgtctgtatctcaaatattatagaattgtttcctataacggtgacccattaacctttctaattctagtttccaatgtagcttcttcaatagcttgactatcaactatctggacggactatcaagactttacttccaacattggtgtaaaccactttgcaaccgtattttatggcctctgcagttccaaaataccttgaattagagaactccacacttgatttgactgtcctagtgattattgttccatttcaattgactatttatttatcacctttctatgtatccttctccttattatcatctccatacttcagattgacatagtggtaatgtccattgtcctctttgtacttcagattaacatagtagtgatatccctgcttatctttttaccataggtgtacgtgtaactgatagaacgacccatctaccgtctcacagaagctttgtagtgattcgtcaaaacttcttgtacttagtgatgtgtcggaaagcaaaccattcttgtccttgtaccatattagtagagtataaactttcttaagtgcttccaagtagactctggtgtaggttccactacaactttatatatccttgattaatcatcacttcgtctttattctcattttcctgagttgccataaacatctgtttgacatgagtatacctctgaccatcgataaatattaaggttcatgtatcaactatattattccaatacaataccgtagaatccatagtctcactttcattgattacatacttattcaacacggtgatgattctatttaactgaatccataacctttagatagactggcattccttaaaacaactttgaatctcatatatctttgacaatctggaatacatgaataaactgattgcttggatccatatcttatcctctgtctaattattattgcacctgccggagccatattttttttactcatggaaaacgaaccatttaaatctcttgaactataatgttctttgcaatatagacattggttggcctttcattcatttgggtaatagtaacgtagttaattcgtccttttagttataatctgaccaagatgcaatagagaatattgttgtgactgacatcttgcatcaattattattatacttcaaacttgctccagtttccatgtaatttactgtagacatccagggtagaatcatatgtgcaaccatctactgtgaatatccatcttacttgattgactattaatgctagaacttcaactatcgacctttaaaaattgtctcacattgaatagactatcgtgaacacattttccatgtatctccctctagaactgttgattcttagctgcgattagcatagtttctacaaaaatgtgttgactcaaaacaattaactcataccaatccccaacatgaaaggggtgcattcctcttcattaacaatcttcttactcaaactaaaacatatacaaacttgaacctttcttgatgatacctttgctgatcacatttgacagtattatcttgttactattaatagaaataatgtcatgagcacccggcggcgaatgccctaatttatccctctctttcacggtaacaataataatcaaataattaaagttctgaatttttccagacagcagcaaatttaatgcacacgatagcaaatcaagcagagcaaccaaattaatccagcttaatagcaaaatataaaaggaccagtcttggcttacagtagcaaaaaccaatccctagatagtagtactccacccgtgttcttgagacacgatcagagtaagtggacttccaataaaatccagaaaacgtcctcaggagatggatctcctgataagtagtaaaaaccaatccctagatagtagtactccacccgtgttcgtaagacaatcagagtaagtggacttccaataaaatccagaaaatgtccccaggagatggatctcctgatcacgtcactctccaaacatcagccggcagcagcgacacttcaatagatagcagatgggagcgccataagctttttccgagagaacaaacctcgacgaaaacaaaaaaaaaacctcctcccgtactgcttggtagagtttatatatagtatatacggcacgcaggccaactcaaatacggcgcataggcccatgacacaaactaacagaactctgtttggactcaaaacaggagaagtctaatcacttttgctaaatcagccgctaatgaccctgctaatgataattggctaattagcctaccggtacaggaactgaaccaatatatatatatatatattctttgaattgcttcttttcttcctgcacagcaacttgtatttcttccaccaaaaatacctggctcttggacacatcatcctccctcccttgaaacaaagccatccttggctttggattaatttgagtcagttctttctttttctttacaacaggaaataccagtgacttgatagaactatcatgcattggtttcagcacatgtttaacaccaagatgcataaaagaatagtgattacttctgccctcatgcgttgcattaagatcaaactgccatggtcttcccaaaagcatgtgacaagcattcatcggcaccacatcacaaccactttatcaacatagctcccgatagaaaatgcaactct

SEQ ID NO: 57272 - DNA, 1600 bp, Oryza sativa
ttcaattctaaagattgatgcattgcacatactccgaccggacgagacgcactgtctcatccgagtcatttgagaagcactcacctagtcgttttagaaaagagttcaaataaaataaattgcaaaaataacagtctttccttgaagcctgcaataaacacttatttcccctggcttgctgagtactcccgtactcacccttgctctatataaataatccccccccagttgctaaagaagctgaagcggatcctgctgatgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtactactctataataaagagacctctgatgttgtgatattctgtctccctgtgataccagcactgtttcctaggactggtatcgattaacaggttaaattggagcgtcacgggctagtcccggtcgggactagttcggggcgtgacaccaagagccttgctaatgaaggcaataggatgaccatcttgagatagaactgctccaatcccagtttcagatgcatcagtttcaacagtgaaaaccttttggaaatcaggaagtgcaagtacaggggcagaaaccagtgcttgcttaagatgttggaaggctgattctgtttcagagttccaatggaagggaactcctttcctaagcaagttagtaagaggtttgctgatcaccccaaatcccttgacaaactttctgtagtatcccgcaagacctaggaaccctcttaacttcttcaccgaaatgggaaccttccaatccaccacttcctgaattttgttcttatcagtgtgaaccccagctgcgctgatagtatgccccaagtaagtgagttgcctttgagcaaaggaacattttaagagtttgaccttccagtggtgtttgttaagcagtgacagtacttgagcaatatgatccaagtgcgatgaccaatcagggctatatataagaatatcatcgaaaaagaccagcacgaatttcctaagaaccgttttaagggtgtcattcatggccctttggaaagtggcaggtgcctcagtgagtccaaaggacatgaccgtgtactcatagtgacctgtatgggtttgaaaagctgttttatattcttcaccaggagccatacgaatttggtggtaaccagctcgcagatctaacttagtaaaccacttagcatgagaaagctcatccagtaactcatcaattactggcataggataggttcccttaacagtgatagtaccaaactatacttgcacttgagaaattagtgtataacgatacacatcctcatggccaaatgagtatagcttagcaataagccattttattggtttgcttgtcactgtgcgcacagtagcatgcatgcacacgtgaaacattagcgtgtgatgattaaatgccatagttgctgcagatggcgtgctcttctccaggcttggccatcggctccacggcagcccccggcaatgtgaattga

SEQ ID NO: 57273 - DNA, 4032 bp, Oryza sativa
ggcataggataggttcccttaacagtgatagtatttagtttcctgtagtctatcaccaacctccaagtaccatctttcttcttaacaagtaaagcaggagaggaaaatggacttgagctgggttgaattacccctgactgcaacatttcagcaacctgtttttcaatttcattcttcaaggcagggttaaatctgtaaggcctctgactgacaggagctgctcctagaatgagtggaatggagtggtcacaatatctcttaggaggaagaccagtgggttcagagaagacatcttgaaaagagttaatgagttcctgaacatcagaaggtaaaggctccttagtcacaggatcagatgcagaaagctgtactatgtgcataattgacccctgtttcaccatgcccagatactgttctgttgatatgactgaacagtgagtggtctgtggtactatgccctgcaatctgacaacattaccatcaactgtaatttccatccatttgtctacccaattaacttgcatgggactgtattgttccaaccaatccataccaaggataatatcatagcttcccagatggagcagtctgaaattactgatgaaattaagtccttgcatccaccatctacagccagcaacttcatgagaacaagtcaaaaatccaccatcagccaatttaacagaaagttgttgttgcaggggttacactccagccattttcagtccaattccagcatccataaaagaatgtgtactaccagaatctaccagcatgagtagttcagagccttggaccaaacctctcagccgaatggatttagaagactcagttccccacaatgcttgctgagaaatagccatcagatcactgttactatctgaaggagtttcagggtctccatcaggggtctcatcctgtaatgcatccaataactcctgaacaacatgcaattgtacagctgaaccacacttgtgatccctactccatctctccccacaagtgaaacaaagccccttagatcgtctataagatttaagagcagctagtttctcttctctagctcgagcagactcagtacccctcttgtcttctgtatgttgtggagtaaattgcttctgtggtgtagcagtatgagcaagtgcaggagttttctgaaaactgcgaacaggaatagagctgtcaggtttcctgtattggttaaactttataccctccaaagcttcttcctggagtaaggctactgcacaagctgagtcaagatcttgaggtctctgaactaataccacaaccctgatgtcacttctaaggccttccacaaatttagtaacaaagtacacaggtaacagagaattgtcataagctaagagttggtgcattaaactgtcaaacttctcaacatactccgaaacaaaaccctcctgtctaatatgaatccactgacgtatgagagcctgctgtctatccttagaaaatctggtacacaccaactcacagagaccagtccaagaaattccacatatctgattcctcacagattgcaaccagaatgcagcattaccacagaaatttaatgtagcaattttcacccaataaactgactgtatgccataaacatcaaaatattgctcgcaattagccttccacatttgggggttatcaccactaaattgggggcaaatcataggtgggatggaattactcagattaaaactagcagatccactaccaggagatggggtttcaggttcagaaccaaaattaatgtggggaatggagaaattgtccttcataccaaacattggcgtcgcagttgcccccgacttatcagcagcttgatcctgcttggagttgcctggagctccacccgcggcggtgctgccgaacgcctccgacttgacttgccgcaacaggttgccctccaagtgatccaccttagcgttcaacgactgcaccgattctcccagtgtttccgccttcttctccacggccggtatccttgattccaccgttttcctcagctccaggtactctgctctggtacgctcctccccttccactctcttcttctcattgtcagaaatggttttgagcaggagatcgaacttagcttccaaatccatctcgagattccggatccaaacctcagcgctagctctccgaattcagccaaccagatcgagggagccgaaacttttgcggatcacacgccaccgaagtagcaggatcccacctctccccggaattttacagccaaatcaagaggattttgcagcgcgtgagggctctgataccagattgttaggggctctcaagaacacgcttcacaattcacgaatttagtggcaatatttgttacttctcagatccaacaggaccgagccgccgccgccaacgcctccagatgccaattcccgaattgttctagtgttgttcgtttgatttattacaaccaacccactctctctctctccggcgccagctcacaagcgagctgataccttacgccacccactctggaccgtggaccttcggattgggcctcctctcacggactggacgccgagttgcaacccaggcttgattgtcacctgaagtctggatcacctcctccttatcttctctgctaccagcttcatcagcaacttcaggacggcttccttcttcttcttctggttcttctgcagttgagccttgcgagatatctcctggatgatcttgagagtccctgacacatatgctcttctaaatttctgactctaatctcgagcagcacacgataatttaaaagtcgatttttccttccatggaagtttttatttcttccgactggagtagtattccatacacaatccgttagatccttgtaaacggccgtttgtgatatcaccacgatagaaaatagaccgttcacacatcacataattaaaccctggtggtcaaaattgatcccttctccgtacgactgaacgatccgttcgcgcaaaaaggaaataacattagcctgcgctgtcaattttcttcaagttgacttaacacgcgttgctttggtcgcatatggaaaaaaaatcaacagcaacgagataataaattactattcggaaactgagactgtgacggtggatcagttcgacttgggaaaaaatcacggtgctttgttttgacaggtgtgaccagccatgcaactcggggtgaagcgccggaaatctgggagagcctactcatcacgtacactgcaaagcttcacagaatatgcgccttattttatcgcgacatatagaaagttttgtcgatctagacgatgggtgaaactgtatcacgggacaaaatctgaagtgctgccagaaatttatccaacaacatcttgtgtgttgggcagacccagggacagaaagcacgcgagttgtggatcctgtcccagttgcacggagagttggaaacgctttgtcctgtacttgctccactccaaataagcacggcttcgtcgaaggcctccgagttcagagggtactaaacgacagcgagatttttgtttatttgatggattcaggcgacctcagatgtaccacaccactaatccactatcccactgagacacgtactcttatcaaaagaaaacaatactacacggcacctgagactcctgactactatagatgtcctggcacgggcttgcaccaagatacgcatgtgtgcatcaatccacgcctccgttcatcctggtagcctgcatccagctagcccttgcagtgcttgccgagccagccttcgcgtgacgcgtgccaaagccgccacctcggttcatgcctcctgggtgatccgagaacgatgaacctgctgccggctgcggatagcaggctcaggctgctgctttgtcgattgattgccggccatctgggcatctgacaccaaaaagatcaattagccgactgagacaactcaaattgaggacagacatgccaggacagcaagggggagcatgccatgtccgagatcatcgtgatatgaaccgcagcataccggcggtatggt

SEQ ID NO: 57274 - DNA, 4632 bp, Oryza sativa
gatttcaccgtgcaaatccatctcccccggtgacgcgacgacgcgcgccaaagcagggttgaaggtggagaggtcggtacaaagggacaaagtggcgacgcccgcgaggcaacaaccgagggaggcgcagccgtgagggccgcgtggtatggtgggatgcacggctttctcctacgaatgctcctactgtctactccctagcccgctcgcgaggcgaggccgttcgaaacgggcgagacactcacactcactggaccacggcgcgcagcgtcggcacgaggcagggcaaagcggtggggtggggccgtgtcgaccggtcagctgttgatacaggccgttcggcatacgcagcggacaaatcgacaggtggtactatctgtctgcttatcgtgagtacggagtactgggcttctaggtacgagtaatccgttagtacggaggagtagactagtagtactagggagtattatatactgtagtagtaaaaatttcgttggatgtcacaacatgtttgggaagagtcgtacaacggtactagtagtttagttatgaacaccgcagacaacgtagatgagcaggagatgcaaacctttttaaaaacaaaagggatagaacgcaccaaacatggggaaggttcgtcgtagatggccgggtaacctgggcacacgtgtgcagtagaattgtcttttctgtggaggacaccaagtcgttgtttcaagctgataaaggatcggtaaagatacatttcaaacttctgcctgagtaaaccaatatcagatttttttttcacatacatacaaggtagcctttgaccgatcagcctggtgacttggtgagtgttaacaatcttccaaaaagatgggccactcgataattcggatggaacggcttgtgtttgcataaataagggcctgtttagttggaaaaaaaaattttgggtgtcacattgaacgtttgaccggatgttggaaggggtttttgacacgaatgagaaaactaatttcataactcgtctggaaactgcgagacgaatcttttgatactaattaatccgccattagcacatgtgggttactgtagcacttatggctaatcataggctaattaggcttaaaaaattcgtctcgcgatttcctttctaactgtgtaattagtatttatttttatctatatttaatactccatgcatatattcaaatattcgatgtgatgtttttaggaaaaaaaatttgtgaactaaacagaccctaacttgagtatcagattactcagtcctctctgcttgtcccgtatactagaagcagccaatcctgtcactcccgtccagtatcacctacggcaccaaaagtccacatgagggcaattgtttggcgacgtgcacagaatatgactactaggtcctgtttagatttaaattttttttcttaaaactttcaactttttcgtcgtatcaaactttcctacacacaaacttctaacttttccatcacatcgtttcaatttctttaaaattttaaatttagcgtggaactaaatacaacctagagtactccttataaagatattctacgtgggttgtttgccttgttgcacggaaccgtacggtttcccatgcgtgggtgcctgaggtccaaagatcatccggatcctattccaagtcaacaaatattagtgtaattcctattccaagtcagctcgtttgtacgggaacaatcgttttctttgccttcacaatagtcagttcatgtagataactcaaaacaaaataccactacctctatttcaaaaataaagttatttctgatatagtagcttcgtccgaaaataaatatatttcgcctaacttcaaatctcaatccatcacaattattctctatttactctccctatcctaaaatataacaatttagttcaaattcgtagtactatgatatatctaatacggtcatatgttgttatattttaaaacatatatggtaaatgttgttcacttagtttctcttttgaaccaattacaacatttttcaatcatttctatttactttcttagtacacatgttcaacttaaaaatacttatattttagaaccgatgtgaggacatatccggtgaagacgagcaagtgttggaacttgtgaaaatcatacttaaaaattttataaattcatgaaaaaaaatagtagaaataggtgtagatatgaaatacattctcactgaatctcaagttcgaactcaacttcatttaggaggtgaatagtaacaagatactattcactctaaatttgtctttttttctccaaaacgaagttgattttggatttgagatttggtccgaatgtatttcatatctacacctatctctagtgttttttttatgaatttataaaacttttaagtatgcttttcatgagttttcaacacttaactcgttttcaccggatatgtcctctgatgtagcaggtggtacaagtatttgatcaaaacacttccaataaaattggagagcacaccaagtaccttgtactagaattcaattaacgtgctgttaatgccatggttgatttgatcatagaacgttcagactagagcactcaagtccttatggcataaccccacatgttactcagacaattagtactattgttgacagcggataaaaatgtgggctaccattcccatcgttagaaaaatgcgacttcgcactatagtcaatataagatcacaattaaaatattcaagtgcactccgagttcatcccgcatcgacagcaactgcaagcgcaagaggcttttactcgtcaaggagaacagagaaacgataacgcggtgccccaccgatcgcagcatcggattcctggggagccgtacactgaccgtactcacgtacgtgcaaggctcaaccatcaaacgatcgaacgatcgacggctcgacgcaagctgccgctgactttgaatgatccgtcgccccgccaatttgtctttagttttggtgtgaatggcgcgcggaaactaggggcttaatgataaactagaaagaaaaagacattaacctacgtggagagcacaaccaaccaaacaagaggttcttatcgttgcccagcctgattgattggctactatatctagtgcccgtcctactcattcattacatggagcttcaaagaaagtaaatttagggggaaactcatggatgcagaagctcatgtgtgttcagctgaggatatcctgacataagctacagatgcgcatatcctttggggaagatgtacgttatgtgtagccgcaagaatggcaatttggcacggaaggcctggttcatgagtcacgaatttttcattcttttatcaggctatgcaggcgtttgccacatatattcagtgatgtgagcagatttccttatatgcagggaaaactgtgtgaaattccttggtggccagttgcgtagtgtaacctttcctcccccacagagagaatacgacggacgttgaatgcgactcatctctccacgacgaacataatttggttctccctttttatttcctgtcacaccttacagatgcagtgcaatccaataatttaggacgttgaccagttatccgaccgctgtcataaacatctttggtcgttttgagtggtgtatgcatgcaggtgcgtgttaatgagtcttccctttcaatcggacatgattagtccatcatatcggctatccagtactactcctgttccaccaaaaaaccaacccaggcaacgatgagatataacctatgacgataaatctggacatgttcatgtccagattcattatcatacgttatatttctattcaagttcattgctatagattatgtcccaccgttgtctaggtttttttaaaaccaacggagtactacttcactgtacaccgcttgtagtcgagtaaaactgatgtgtactaggcatgcacgagtggacgtgaagggcagaagtacagttttactccttccgttccaaaataagctcggccatgaaattccatgtctaactttgaacgtccgtcttatttaaaatattttttattagtatttctattattattatattatgaaacatgaatattacttatgaatattactttatatgtgaacttatgttttttagttttttttaaaaaaataaataagacggatgattaaagttggatatggaaactcatgactgcgtttattttgggacggatggagtagtatatactcctttttttagttctttaatagaggcttgcatgtactccctccttttcatattataagtcatttgatttttttttcttagtttgatcaagtttatagcaaaatattccctccattccaaattgatctacatattttataggtacactaagaccaagaaaagctaataactctctcatactatatttactctagcaacaaactcaatgcatgcaacatccccactattgcatgtgggtaataaatacttctgtgcatggatgcatgtatcaatgtctatttagtacttcaatgcacaaataacgaatagacttaatgaatgaatacaaatatgtagatcatttaggaataacctaaaaaaactaactataaatttggaatggagggagtataagagtaacattt

SEQ ID NO: 57275 - DNA, 1932 bp, Oryza sativa
atcaggaagcggactagttagggggcacaggcccagcataaagggggagctttaaacctcgggtgggccgtgagcccgtcactgcctgggatggggaggctgagcaggctgcttttgcacggtttggttgcagaataagttcatttaaggtcccttaacttgtaaatgaatccgattttcgtcctccatccagaaaaccagatacaacgggtcgctatacttacaaaaccggtgcaaaattagtcctaaggcagtatgacgagtggttttgtctgatgtggcattttgacttgtcctacatggcattttgaccactgagttagcacaatcgttagggaataaatggggagcggtggattctcgcgcgttagtcgccattcctctcccctttccgaaaccctagcttaatccggggcgattcggagagcggaagcgcggcgatgggagctagaggagtgagggttcgtcgtcttcttcgcggcaatcgtacggctcacctattccctatcgggttgctccgttggattacaaacccgcagtgttgtgcagatgcagagtgaaggccgcgaggtgcaaagtgaagcacagcgcgtgacctcctgctcctctgccgccatgcggcattgagagcggtgctcggcgtcgccatcttcgcatcgaacagctgcagcacgctagcaattgtcccctcttcgtcgccctctctgtcgcctaggaggagcgcacctagagttagggtttgtggaccaaagaagagagaaggggcacacccttttttaaccctctggctgacttagcaagaagcgcccaacgggctgtgctgacttaaccgggcttaaccgcggccaacttccccctttggacaaaacaaccctcaatactgctttgggaccaatgtttgcaccggttttgatacttgaaggacccgtcctatctggttttctggtttaggaatgaaaatggattcgttgataagttaagggaccttagatgaacttattcctttggttgcagtccaggtgcatcaagaaggcccaacagggatgcacggtaatatggtatagcacacatcgtggtttgggctagttgccaggcttgaaaagatgaactttcgagtgattaccttaaggctgtgtttagttcctaaaattggggagaagtttgggaaaagttggtagtttggaaaaaatgttgagagtttatgtgtgtaggaaagttttggatgtgatgtgatgtgatggaaagttgggagttggggagaagtttggtgtgaactaaacagggcctaatactgggaacaatattttttagataatgggtaaaatccaatctttagtttaacagaagctactgccacttattacataattcttgactgaaaatcaagtataataatttctaacaaaggataaatagacaacccaataataaacgccaccatcaaagaagagagacacttattcaaagaacaattttattgttaaatctccattcaaagttgacaaaaaatttgcatagcggacgtctccaaattccaacatgcaacgtgaataatcaccatgtcctcttcacacttgtcccaaaaccgaacctaatatgttgctttgaagagtacctgcatataaaatttagttggtgttttgttaaaaactgtgtcatttatattcaaccatagagtctaacataaaacatatgttccaactaaaatatgttttctttggtctttgtgtcaatcccaatcagccaagtatcaaacatatgagtcaaattatgtggtgattgtaagtcaaaagagataaaaaatggttctccaaataaatttagggatggtttggtttgagacctaaattggccttaccaatttttgtcaatgataaattttggtaagttttggcatggctaattttggcaaggtaaatgatggactactgt

SEQ ID NO: 57276 - DNA, 1108 bp, Oryza sativa
ttaggttataagattttctatcattggccacatttatatagatgttaataaatctagattcattatgtgtctagattcattaatatttatatgaatgtggacaatgctagaaagttttataacctgaaacggaggaagtaccatataaaaatcttaattttggtgggaatcgtcaatttccataacactttatccctattaatatacccattaatacatggatcgaacataaaagataccattttgatgaatgtgggaacaatggattttctgttgtctcccttccatagttccatggtatactcccctgtcacagaatataaacatttctagctattcctactagaagttattatatttttggacggaggtagtagtttttaggcatggatgaaaatccgttgttaagtacagttttatcccaagaacggttcataattagcttggatgcgacacgtgcgacacaaggtaagcatttggtaaaataaaaacacgtactccctccgtcccgaaaaggaggtcgttttagcgctgaagcaatatcccgcaaagagtgtcgctgggagcctgtcttcgtagttcagacctactctgccccagctcagctagtctgacgttctgccacatcactcaccgctctctcaccccaaaccaacagacatgaaggtgtagtactagtattagtaatgatagaagtataggcgccgtacaggttatttttacactgtcttgatactctcaccagaagttagaacgtcaagtttaaagagactgagggagtatatccgtgttcgaccgtgtcaatctcactcttggatttttgtgatccggagagcaatgattctgagaacgagaggcacaatatgcttccacagggtgtgtttagttcacatcaaaattggaagtttggttgaaattagaacgatgtgacgaaaaagttggaagttcgacccgagtttagttccaaactttttcttcaaactttcaactttttcatcatatcaaaactttcctacacacacaaacttctaacttttttgttacatcgttcccattttaactaaactttcaattttaacatgaattaaacacaccctcggccacaatc

SEQ ID NO: 57277 - DNA, 719 bp, Oryza sativa
tcattattacccatcagttttcgcagtgagctaaactttccccaaaagcttgcgtgttgtgttttgccattcatcggtcctttcagagcaccgcaccaccattgttgcatgtccaagctcaagctcacctattgcccaaaatatactgctgtgccctccccattgttcttcgcacagaggacatctcgaggtcgcctgcaggagtatgaagaccggcggtcgtcgaatctcgaatcgtggcagcaagcatagagggcagtcgtcgtctgcatcatcttcatcgtcgccagtccgggcaagcctggcagaccacgcgcatggcataggctgcttggcctaaaaaggaagcatccacaagcccactttggtgtggtgcatcggaggaggagaaaggtgccgttcgcaggggcatcggcgcttcgtgcagagggaaggcatcagctgcccgattccggaatcgctgtggccattgcagagaccggtcatctccgatctcgtgctgcacagttgaaggggatttggcgcccttgcatcgccattgcggaaaggggatccagctctatataagggcatggctgcggtaggcgtgaagcgcaaactcatcgtcgacaaatcccctacccatcacctcctccatttgcctccgtcgcccatcgctttgcttagaaggagggggctaccttcagatctggaatcctctgagggtttcttcacatctc

SEQ ID NO: 57278 - DNA, 759 bp, Oryza sativa
catcatcttggccggtacacagatgcgtggaccgcaccaaaccgtgccttgatcgtctatggagaaattgggggtgctttcttcttctgtattctttttattaactcttttatcctttcgacgtctttctgggcttcccggatttgcgactctagcggtaggctgtactgtcaagctggcagggacacctgactgtaccacggtcagcctcaacttctctaattctctgcacaggcgatcttggtcaggccatatttgagctacgttgcaatagaccttgcgacttagcgcatcagcgaccacgttagctttaccggggtggtaatgaattccaagatcgtaatccttgattagttccaaccatcttctctgcctcatatttaactcggtctgagtgaagatgtacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacaaaagatctcgaaatcttttcggatatctggcaaggtgagaactgaggcagtggtcaaccttttcttcatttcttgaaagctgtcttcacaggctgcagaccattgaaatttctttttcttcttaacagctcggtcataggtctgact

SEQ ID NO: 57279 - DNA, 1467 bp, Oryza sativa; identical to SEQ ID NO: 22683

SEQ ID NO: 57280 - DNA, 933 bp, Oryza sativa
aactatgtgtctaattttttctagaattttatgtgacatttgttaattgatgtgtatggaaaatttgtgtgcatagtatatattcctggtaagtcctatctacatttatcattgtcatcattcttgaggctcttgaaaccatccatttggccttgtttctttctccatgtcttatcttatgtttgcactgaactctcaaggtttaaggtcatacctacaacaaacccagtgaacatggagtgtggagagctaacaagccgggttggttgtggtcacatggactcgtcggctcaacgagtaaccgaaccataaatgcatgcaggagctaagctaggcccagccacccagaaattacgccggtcgaatgtggtcacatccacagctccagacctgaaccgccgatggaaaactctgaaaactgaagcgaatagatgaacatgctgaaaaatcccagcatcaggcatcagcttcgtgcctcgagcccgtcccgatcccgaccggagtactacgagctaccactacctcctccgttgactccggcggccatggccatggctgcaagcacgatggtacaagtgtgtactggtagtagaagtagtaccaatgtacgagcacagtacattcttggcaagtgagcagtacagtggtagtaatgatggctttgctgctgctgctgctgtgctgatgatgatgatgacaagatcatcgtggcctgtagcagcgtagcgtgtcgcagtttgaggagaggagaaaagaaatggtgaatttgtgatgaactgatgatgcatgcagagtaaaactagagcgaatttgcaatttggggtcagattgattgattgggtgatggtggtgatttggtattccatattcacagcggcaaatctcctacaacaagaagtggatcaaaactaatgaaaagaagaaaccaaagag

SEQ ID NO: 57281 - DNA, 6406 bp, Oryza sativa
  unsure (1)..(6406): unsure at all n locations
nnnnnnnnnnnnnnnnnnnnnnnnnnnnnnnnnnnnnnnnnnnnnnnnnnnnnnnattgatccaatgatctactagcagttaagcttataataccaggattaatccaaggggtgtatcaatatttttgactaaaatgcacgtggctgtcaagtttatatacaattctactcatttttcaagttcttacactaaatcgcacgcatctacaccaagttcttgtaccgtgggtgcaatttactccattctctttgtcaccttggtagcctaattttgaattttaaattactaacattcccctttcaaacgcctgattaactgaaaatgaatgaatttctgtatattcaattgttttgaaatacttgaactgtggtaagtaaattgtagagatgcttatagttagaacagatggaataggtttgttgtactctcttcggtccaaaacaatgttagacctttcaaaattaatgaaatgcaactttcaccacctaattctttcacataaattaaaagttattacatcaatcaataaatatataatgttacgaaagcttttataacaaacacctgaccatgttgcggactaagctagttggtttccttatagttgaaattgcacatcggggtttaagtgattccaagagtacgggtgcttaaatttacagataattattctttaacaagactttgttaccctcaatatgtacgtgttggtccaatctaagaaagcgtgaggttaactcatgatatgtcgattaactattaactcgcgaggttctcaacatatgccagccaactcttcatttttttttcgttgtaggttatgataatctcgacatatactggtccaatgatctaatctcttaaatgtgctattagaaataagtgtgcacatgtgcattcatatgggtgagtacgcgtgtatgtatatgagcatatatgtttggactatgtttacagaaacttggctatattattttcatatgtccaaaccctatgctctaacctataaggcttataattatgatcaaaattaatctatgtgaatagtatggattctaaaataacatgaatgtgctcccatgcttttatactccttgataaaatttctatagaatatttcaatttatagatatatttatatatatacatacttttacatgatagagactattagattaaatctatcataatgtccaacattatctgacctttgtcctttctccctccaaaatcattagtactccttttgaaatgaaatgtcgaagaaggacatttaatgtataatctttttggggccatcattaaatgtttcgtaaaattatgaccttccataagaagatacttcctccgtttcacaatgtaagtcattctaacatttcctatatttatatggatgttaatgaatctagatggatatatatgtctagatttattaacatcaatatgaatgtgggaaatgctagaatgacttacattgtgaaacggagggagtattaaggtgttgtatctcttcaatcttgatgtcgtgccactgaattggctaaagctctcgggcaaatttgagcctaccttgttcttattcgagatggcaccgtactactctatccatcattcattactttattacttgatctctaggtacatatatatagcatactactactatatatttcacgattttttgattttttttttcaaactatatatctatagaaaatatttaaaatataaataatatgacagagtttttcataaaaaaaatactaatttaactttcacatttttaatactaatattatttttgtcatctatcaatgatttaagatattgacatctgataataatacattaaaaactttaccttttttagagcggaggtagttaatattctctctccacagttacaaaagagtgtcattgtaacataggttttggggtgtagctaaatttgttaattaaacaaaagctgattataattatgtagtaaaaaaaagttcgtttatatatatggactttaaaaggctaaaaatgacaaacttttctaaaagagaacatatataaggccctgtttctttcagcttgggattaagaaacagacaacttattgaagtagcttattataatctggaacccagcttattataatctgataagctcatttaggtgagctttttccagattattgggtgaaaaattacccacaataccaccccactccctctttagacttgcaaacccaataatctaggctctaataatctaggaaagaaacaactaaccgcttattctactacagattataacaatctagcttatagtaatctgactcaataatctagattataataatcccaagctgaaagaaacagggcctaaacctctagatagttccggccaaacgtgagatattcatggaacctaagtttttttaaactagtaacgataatatcatggccaaaccgaacaaatagggatatgctatgatggagtattttgtaacaattgtaatgggccaggctcatataaatagagataagctagaagggtgattaaagataaaacattggatgtcgtgtttactttcagcgtacggacacaccgtggtggtgggaggaggggatggaaggaggaccactccgtttttaacttagtagaggtatttttttattgggattatctatatatatatttattgacaatttttttatcaaaatttatcaaatgtaattatagtataattataatataaaactatagtataacttggatataactttgaaaaatcccaccatgtggagctatttctgcaaagcggaagtcatgggaccaaatcccctcacccgtgtgtgttacgattttctctttcccactagcatgaatcttagagtaaatctaatggttcaaaatatatgaaatttgcatacaagctacattataaatagagtaaatttcacaaagctatagatattttgaccaaactacgcaaaactacatatttgagatgttgtatcaaaaaactacagacttagcggtaaaattatcacaaaactatatatttaagaccaagtaccacaaaactatagattttatattataagttatcttaaaagtacatatttcatattgaagttatcacaaggatacaaattctagagtttaaatccctattgcaaactttatgttggagctataaatgttatagttttgggataaattagcactaaacctatagttttgtgataaaattgctgcttagttttttttacactccatcctaaatctatagttttgtgagaaattttagcttcaggtgatgaaaacgagtcaggcatgaagaggaagatcaggaaggggaacgggattcatcgcacacgtacccatcatggctgcttggttttctatgttatatagacttgtagtttgtttctatttcttgatatctattagtataagtttttttttctgcgggatctattagtacaagttagtagtactattctattagttagtgttctcggttcggtgagttgtttcttccgcgataaattgtcagcgctagttctccatttttttttctgtggatcaagaagaaaggaggctcagcaggaagcggattgtatcatgagagaagcatctgcaatgggtgaaagcctgatggagcaatgtcatgtggaggtgaaagcccacgggtcgtcaacttcttttctcagagaagaacaatgacaatgacagtatccgagaaataagcatcggctaactgcactaaatttgtagttttatgatagaagaccttaaatctgtagttttctaatattttggttgaagtactattttcgtgaaatttactctataattacatgcaagttacaatatgtttttagaaaatttgctgataaatatataacaaaaccgttttttattttcacatgcatttcctattcatataattacaaaacaagatagaaacataaacgggataaaagcttttgtaggcaaccaaacacgtccaattataccacccaaaacagcacggatctcatggcgttggaattactccatcgttgatcattgtcactgaagggagaccctagcttagctaggtaagggtaaggtagcggtagcgcctctatcaaaaggagcaaaagaaaacgaccgttcctccacgcatgagcatgaactgtgcgagtctgggtgaacagcagcaatgaggagtgaggaagaggattcatgtgtactggcgtggagagcgaccggtgatgggtgatggggtgagggggcggcgtggctggcacgtgcttggttgggttgggggcatccactctttctttctttgtttttcttttcttttctttctttttaaggaaaaggatagatctcttcacactctcatcacctgtactggaccatcttttgttaaaggcgaattcaagagagaagccaagagaaatggttggctataacaaaagtaccgggggctaagcccctggatctagagtgtattttttttcaaaaaaaaaacaaatactccttttatcccaaaatataaaaaataaccaccactaacacaaaaacaaaaagtaaatttaatcacctcatcaattggatcacctcgaaacatgtaaataattatgtgattggaagtttgatggtagatgatttaaaacaaagcaaatttaaatgagctagttagtactatatacatgactgcgtgccatatattataagacatggagaaaaataatagtgtctttatattttatattttagaatggaaagccagagtacttggacaaccaagaaaaataattggtgtcggacaattaaagttgtgttcggaaccccttgtttccatcatgtaaaatgaaatatacattggcgcataattaattaagtattatacattggcgcataattaattaagtattagtttaaaaaacctgaaaatagattactataatttttaaagtaatttttctatatattcttaaaaaaaacacgccctttagtggtttgagaaggatgtgcgtataaaacaagtgagtagaagttagaaagatgggggtaaagaatatggtatagatccttatcaaatccacgacttaagatgactacaactgagcatgtggttttttctttcgaataccagatatataaaggttcagcctattctaaactgatactgtaagtctaacatcggtgtgttaaacagaggagagaaagttcctcgtttttcacgcgcgtgcattttgaactgctaatcagtgttttttgaaaaaaaaaaatatagaatttttttgcaaaaaactatattagtcattttctagtttaaaatagttaatcacacgctaacgatatacctcattttgcgtgcattatctttttctcttctcctaaatgcaccttagtcccctcacccaaatgccctatggttgaaaacagtatggaaatttccggctatcatttctggtctgcacctaccgttttagtcggtatcggcaattatcagtgttggaaatagaaatggtaatatcttctggaaatgatagcggaagtgggatggaggttttttcaaccgtttttattggtaatcgtatttatccggtaatttccgtcaaaattctgagaaaattctgaaagttctccaacggctcagctagtccaacccatcggaagctcatgaatgttggaagcctggcggacttgtagcccattagaaaagggaagtggctaggggaaaacacggttaaccctagggcgtggcatgtgggctttgttgaactttggtctcttcaacttatcgatgttaaagtattattgaactttgtttatattattcgtcgaacatattatcatatcattaatcatcatataatggtattatgtggagtgtaatgatgtaagaataaagttataaagttatcttcatgtataattaaatatgtgattatgcctcactttgttgtttccaatatgaattttcttccaaccaacatcgctaggttctgtttcgacgtttccatttccaatatactgatatcgttatcgtttttttataccgtttcgattccgttttcggaaaaaaagaaatatagaaataaaaatggtagagggtttttccgaccattttcatcctaaacaccaacagcaccatctctctccaaattgtactagcatcgtgttattacttattccacgttattatggtaaaaaatttcacggcgcaaagcatctaggctagtccttaattcactacgtagactcgtggtaccgtttgtaaaaaaaaaaattgctccttggaaatcgagcgattttacaaaaaatgataaaaatcctagtatgnnnnnnnnnnnnnnnnnnnnnnnnnnnnnnnnnnnnnnnnnnnnnnnnnnnnnnnnnnnnnnnnnn

SEQ ID NO: 57282 - DNA, 2499 bp, Oryza sativa
atacttccttagctcaaataaatcccagaaaaatctaggaattatagaattaagcaaagtatttaatgaaattttatctggccccattttatattggaatttattaattaaaattagatcttcttttctaggcttttaaaaataaattctaaaaattccatttaaacaataatttacatattttgaattctcagggtgtgacaaacctaccccccttgaacagaatctcgtcctcgagattcagaagaactggcgaacagatgcggatgagctgacttcaattcatcttctcgttcccaagttgattcttcttccgagtgattactccactggactttgcaaaagcggataactcgattcctggtccttctctcatctatttccaaaatacggattggtttctcaacataggtcagatcctcttggacttctatctgttcaagattagcttcttcggtaggtacccttaaacactttttcaattgcgacacatggaacacattatggactcctgccaaagattgaggtaactctaactgataagcaacctctcctcttctactgacaatcttataaggtcccacaaaacgcggtgccaattttcctttggtgtggaaacgatgaactcctcgaagaggcgtgacacgaagatacacataatctccttcttcaaaactcaaatctctgcggcgattgtcggcataactcttatgtcgagactgggccactcgcaatctttcttgaatgattttcaccttttcttctgcttcccttaggatatccgtcccgaaaacctgacgttctcccgtttgatcccacaaaagcggagtgcggcacttccgaccatacagtgcttcgtaaggagccatctgaagactagcttgataactgttgttatacggaaattctgcataaggtagattcttatcccaacttccaccgaaatctaaagcacaagctctcaacatgtcttccaaaatctgattcaccctttcagtttgtccatctgtttgcggatgataagcagtactaaagttcagcttagaacccatctcttcctgaagcttcttccaaaaatttgaagtaaactgactgcctcgatcagacactatcttcttaggaacgccatgcaaacacacaatccttgccatatacaattccgccaaccgacttccggaatatgttgtcttcactgggatgaaatgagccactttggtaagtctgtcgactatcacccaaatagagtcatggcctgatgacgttctgggtagaccagtgataaaatccataccgatttcttcccatttccattcaggaatcttcaaaggctgcaacaaaccggcaggtttttgatgttctgccttgactcgctgacagacatcacatactgctacgtattctgcgatttcacgcttcatacttgcccaccaaaatctttccttgagatcctggtacatcttagtactaccagggtgaatggaatataaagtatcatgagcttctttcagaattgcatcttttaaatctttgttgtcggggacacagattctctcgcccaaccatacagttccttgctcatcctccatgaaaccgatagcttttcctcttctcatattcttcttgatctcttgaatatcaggatcattaatttgggcttctctaacttgatcaattagagtgggcttcgcttctaaggctgcaacgaaacctctagctgacaattccccaaatttaatctttcaaattccttgcataattccaatggcacctgtcgtccttccgtagcattgcaatagcctttcctgctaagagcatctgctacaacattagcctttcccgggtgataatgaattcccatgtcataatccttaattaattccaaccatctcctctgtctcatgttcagatccggctgagtaaagatatactttaaactcttgtgatcggtatacacctctgtacgagtaccgaaaagataatgacgccaaatcttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatactcttgaaaacccttctttggatcaggtaaaatcaagataggagctgatatcaagcgattcttcaactcttgaaaactctgctcacattattccgaccacttgtacttcacatctttctgaagcagtcgtgtcatgggcttagcaatcttggaaaaattctctataaacctccgataataacctgcgaggcttaagaaactgcggatctctgaaactgtcttcggttgtttccagttggttacggattccacattactaggtcaacggcaactcctcctgctgagatgacgtgaccaaggaacttcacttcagacaaccaaaattcacacttgctaaacttagcatacagttgatgttctcg

SEQ ID NO: 57283 - DNA, 1754 bp, Oryza sativa
tatggcatgcaaccaatcaccagcttcaacaggattagtggtactagagaaaataggcggcctcacacgaagaaattctgctaacttgttctggggaggtgcatggttatttccctggttttgctgattctgaagttgctgcatcatcatgttcattaactgagtctgttgagcaagaacttgagcaagggttgggttcccttcattgttgttgttattgttgttgttgttgttggggccattcccgttgctgcgagtgttcaccatctggcatggacagggcacaagaagagaaaccgggggaaactacttaggacagataattactttaacttttattgatcttaactgagtttcattattacaaactgaagactctcacaccactaaactcaccaacttcctaacactcaaaagcaaacaaacacatgcacttacatcccaccactgatgtaaatcacatgcaagacccacacacacacaaccaaacttaaaacaagcaaactaacacaacgatctaagacaacggctagacatggcactctagttcttccgagcatcggaggtcgattgaaggctcgttcggctcgtcttcatcatcttgggtagctacccactcaatcttggaatggttgcgcttggattcttcttcttcatcatcacttatgatgataaccggaggatctgctaaggttggagcaacttctttctccaccacacgaacctttggcgccaattgatagcgagggacaaatagagctctcttccttgcggtaagacgaatcctggccttttgaggtggtgcttctcccttcaatgcggctagttccttctccaaacgatccaccttgtcttctaacttgcaaatcttaccacgattccaatcttcacgatcttgagctgctaacacagtctccgcgcggctttcatccatagcccacagcatctcaaccaaatgccttgtggtagcatcattctcaattccttcagtctcaaggtaactgccacggtcacttccctggggttggccgaggatggtagcgatactcagtgtcggccaactgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaagtactcaggcttgtagcgcggcatctaaagacaagtgaaaggagggagttaagacatttatccaattaatagcacaagtttttggattaatttgaataaagattagaaattcaaagtaaaaaggtaagtaaataaagtaaaccaagctttgcgagataagttgaaacagttggaaaccaggttacaaattttgtacttttgaataactggtttcaaaagaaatgaaagaaacttataaaatcaacatgctaaatttattttattgcagcaagattaaataaaacaatattgtaaaacttttgctgataaaatgagccattagtacagtaatagatgtacggtactaataacactggaataaatttttgaatgagaaccattaaaagagattatgaagtgcatgtgccattagtttggttcaattaaaagagaaaggga

SEQ ID NO: 57284 - DNA, 795 bp, Oryza sativa
  unsure (1)..(795): unsure at all n locations
nnnnnnnnnnnnnnnnnnnnnnnnnnnnnnnnnnnnnnnnnnnnnnnnnnnnnnnnnnnnnnnnnttagctccaatcaaagagagatctcgtacagcattcgagtttgacggcaaacatgatccaaaccgtgaagacccagattctctggactttaagatcatgaaggagaggatgtacaagatattctcaaatgccattgtcgtcagttattcgcatctgctgccagtcgtgccatataatgcattcaatcctcctccgctggtatgtatcagaacacttcaaaccgtgatcaaaacataattttgtcttcttgttgaattaactgaccatggaggcatttcattcaggaatttgctttgataaagtctgaccccccaatcgctcaacgctgatcccctcgtcatcagaccgttcaggggagtggaggaccaaaaatcaggtcagactcctaatccaaaactcccaatccgactgggcagacagattctcgcaagagaaagcttgtgatgaatgacgacgaaggcgacgacaataataaatttggggataagggatcacccaaaaaattaccaaagcacactgctccgaagaagaaactgtctaaccgccccatgccaaagtttagaaaatccccaggtataaaccatccggtaccgtttcacttcgacatgcttctctcatgaagataatactgaaaactggaaggaaactttgcaggaaaccgtctgacatagatccatccgggaaggattctgatccggcttacacagagacaggttcattcaaagaagct

SEQ ID NO: 57285 - DNA, 1762 bp, Oryza sativa
atccgcttttgcaaagtccagtggagtaatcactcggaagaagaatcaacttgggaacgagaagatgaattgaagtcagctcatccgcatctgttcgccagttcttctgaatctcgaggacgagattctgttcaaggggggtaggtttgtcacaccctgagaattcaaaatatgtaaattattgtttaaatggaatttttagaatttatttttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatctaaattgaaaaaggttttaaaaagtcttcttttggctttgggccgaaagtcggcccaaaaccttctctctctctctccccggcccaagtcggcccagtccgcagccgagccgcccgcgcgcgccctcgctgccgctgacaggtgggtcccgcttgtcagtcgtcgtcttcctcgcgcagccgccgcccgaaaccctagcgccgcgccgccgccgttcctttccaaatccggccgcccctttccttctccggccgaattgatagaggggaaatgatcctcgggatctcctctaccttttctcctttggaaacatcggctaaatcgttttggaagttcgtggaatcgagttcgattcggatcggcctctttccttcaagccacgaagtttcctcctcgtcgccggccgccgtgggccttcgtcgccgcctccgagcccctttaaaaggaccccgagctcttctctacccgccgccacccttgccttcgcctctcgtcgtcggaaatgccctagcgccgtgtgccctagcgccgtcgtcgccgccgtcgctccagccgtgcgccgccgccgttccagacgtcgccgtcgctcgggaaggacgtcatcgtggtcgccaagtcgtcgccgtcctcgtctgccgcttcgccaccgtcggagaccgccggagcatcgtcgccgccgtcgacccgaagagcttcgccgcttcctcctcgtcgccgtcgccgtccgttgatcttccgccgtcgctttggtcgccggtgagtccgtcgtgccgtccgctacccgttggtgccctccgttcgtgccgtagtgccgccgttcgccggcgagcgtgcgccgtccgagccgccgagccgccgccgccggtggtgacatcaccgctgacgtcatcggggccgttcgtcgtagaccggtcgtggaccgatcgatctcggccgtccgttttggatcaagtcgatctcggccgtccgttcgtgtgaaccgccgccgtgcgcccggtccaccgcaaaccctagcctgctgacgcaataaatccccttttccttttcaaaaataattcattattgcgtcataattcaattaaaatcaatataagtgttttaatccgattaaatcttcaaaaattcatatctaattcatcttagctccgatttagttggttcaagtctctaattttttctaaaattgagatctacatgttaaaaatatccacatgtactgttcatgcttgtttatgtgctgttttggtgtttttgctcttttctgtttagattccgtcttttccggagagtccgttttcgccggagaagagtttgaagagttccaaggccagcaaggcaagtcacacagatcccaaacaaccctttgagcatgttgatc

SEQ ID NO: 57286 - DNA, 3842 bp, Oryza sativa
atgctatactggtaaatatttgataagctcctggtttggaatggtatattctggtttgaagatagaactgtgcagccgggatggttgtccagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgaagcccttgtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacattaggagaacttaagattaatatatcatgccaaaatacacaatttttttcacatgaatatatactaatttatccttgagctactaacttatcatataaaagataagctcgagctcagctcgacaaagctcgtgagcttgcagctaggctcgagttcggatcattaagagttcgaaccgcgctccaatctagtatgagcctcacgagctcgagcttttttgacagtcctaattggaagtagcaatgataggtcagcctcactgacttatttttaactggactgccacgtaggttcaaaactactccagactaagttgttgggggactgtggggtaatttgcaccattgcaatagttcaagggtgtaatttggactttttcctcttttgtatacttccttttcttttttaaaaaatacagtacaaacgcaagcctttcactcccactgggtgatcatcgctaccactgccccaaccaagtgtgttgccacactccgtctcgacgacaccataccaccgccggctaggctagtcattgtgtgatcccatgtcccgtctcctaaccacaagacatgtctcagcctcaccgccaccggcgccttcttactcactcatctcctgtcacacccaaagttttcccttcccttaggtttcaaatcactaataaatggcttcaagaatttgctttggttaccactagaaaaccctagttaacaatacatttaatagtcggaattgtcaggagaatctttttcgaaatctctttgctctaaaaatcactaacaagacttaaagagtcaatatcagatcacggaggcaatggtgctaagttaaaagtggccaagtaattcttcttcctttggcctttggtcgtgaattgtgcccaattcactcccctctcagcccgtggcttgttttgcatgaggaaccatatacgtgtcagtttgcggaaccatttcctttcctttcagtataggtagtcgagttgtctaaccgtaggtgcaaccctaggttcctaccggccaatcgtttgccgtaccggggctttaccgtgaatcgtgtctagcccgccggtttagctgcagtcgttgttgtgtcgttcactcgttcatttgaacgaggtgttccctgtggttcgttcgttcgtccgtcccgagtcgtcctttaggttagagccgttcagagccgccggctcctttcaccggtttcgattgatcatttgggtgatcctgtgtcacgtagaattgactcgttgagtcggtatcacgtgaggcacgcttgccaatcaatctatcctttgatcctatgttctttcgggcttaaatccctgtcaattgattaaggtttttctgttaatagtaatagcacagagcatcttctaaaattcataacttaataatctgagctccgttttaacccattcaaattgcagtgaattcgttaaatgtcaagaatccattaaaattggtttcttttgttgtttcagtagctttttagcatgtatttattgtgtaccttgtttgtcgtttagactccggcacttctgacgctccggtttattttgaagtggtcgccgaggtcccgtcaattgaagagcaaggcaagtcatacagatatcattgatcatattgagcctatttgcaaaaacccctgcttttctctcaaaattgcattacttttataatgtcatgtgggatggtttctacccatactcagcctttgtttaccttaattcattgatattctgggataaaaatttgactagatgattggtctaggattgcttagccaagcttagatcaactagctcacaatgggattcactataatttagtccttaatttgattatgctatgccttcttggcatatggttaattaattaaaatatgctttacttggtgggtcgtgggcacatgcatgatgatttatttggtggttgtgcccatgacaattaaggaccggttctcgggaatccctggaagatatactcgtactaatcataagccatatgggctctaggctgaatcttaagtataatattttctagctagcacaccattggcgaggatagatgtgatggagtatggatggacctggattttggtctatgctgcttccggatttacctaggcacgagcggaggctgcctgctcctggattttggagtgggggcgaaactggaggtgggcatgctggttaggggtggttatatggagggttttgtcacgatttccccctttgcagtatcgtggcggtacttggggcatggtttcatgtgtggaatcgtgtcttgtgggtaaagttgtacacctctaatcagagtaaaactattcgaatagccgtgcccacggttattgggcggtcaaccagctcaccatgattagtctcaccttaataatttgccttaatgaactagtgtagttcaggtggttttggtttgggcctgtcgcaacgtggtttagcgttggacagtgatgatgttaatactacttaattatatattgttttactgctttcaacttatgatttacaaatgatgtttttactgcaaaatatcctatgagccaatcctttgttttatccttgcatcataccttccccttggtatgacttgttgagtacggtggttgtactcagtcttacttctttttcccaatcccctagaagcagaagttggttcagatggtgagttctatgaagtttaggattgtgccagccgtcaagagtttgcctgtggagttatggaggaagcttcgcgttgctgtgaagattaaatttagttctctagttttttcgctgcgtatgagtttattttgttatttttgtaaaacgtggaactatatcaaattgtcatctgtgtactatagttgatgtctggacagaggttaaatgcacagatagccggtgattcgggttattaaatccttgggtgagacatctccaccgcccctaattgttcttccatcgccctagtcatcactataaagccgccctgaaccccctcccccccccccctccctagtaacctccaaccttgaaaccctaatccggtaaagcctatcggagttcgttagggtgttagtgatgaggcttgccaaggaggttgtggtcgccattgtcgtgactgccaccatcattgtccttcacgctcgctgtttgatctgatgacattcatcatagtctattgagatttttgggaaatgtaagtaaaccaatgaaagatacaattactttggtaactctgtgaacat

SEQ ID NO: 57287 - DNA, 1112 bp, Oryza sativa
acccactttcactgcaaccttcgctataaggctcttttcccaaagctttagtatagcagcagccaaaccctgcagttttgtatttctacctgccagaaattagtcaagattatagttgggctacatatataaacatcttatgatgggttacttatgaatatacaataatgcttgtggaactttaaggaaataggttatgtgtgcataagatgttacaatagatagtagtgacaatcaacacttaaatcatcctataaagcatattcatttgaaactatcaataaagtgactatcgagtgcagaatatggcaggcctgcaggtcgactcacgtaggtcaacatgtgttggcaaaggccgtgcatgcttccgcaggtaggtcagctcctcatctgctagtgctggtctcacaccaggagggcattgtctaaatggagtcttgaagtcagggacaacctcaggaaggagatcagcatcaacaggcaatggtgtgttccaccaccaatcgataaatcgagggcccaaactgtccagtagtctgttgacttctctttcatatagtgttcccttgataggtttgtcgtccttatcatcagcttcatcattatcattggttaaagtttcatctttactccaatatttcccttgggatgtaggattgttagatgttactggggaaagttcctcattataattaacaaagtcacgatgccgctttgcgttttctaggtaactgcttcctctgtacacaaaatgtatgccccctcttgtccaaacaactaagcctcctgttttaatctaatgaaaagagaattaaaaaaataaatatcaaaggttttgaattgataataatgatttggacttaaataattcaaggtaaagagggtgtcgttaaaataagttctctggttaaccataggttaactaagccaaacataattcatcagctaagccaaccttacaatttcagccaattaaaatcttggatcaagcaccagcagtccaccaaccggtgtagcaacacctgcatcaattcaatcatttatctgccagaaaatgctggtcacatttgcaactttctaacagaaatgtgggtcatgatgcccaaaatgaa

SEQ ID NO: 57288 - DNA, 1097 bp, Oryza sativa; identical to SEQ ID NO: 22684

SEQ ID NO: 57289 - DNA, 6573 bp, Oryza sativa
aggcttatccggtcatcaagatcgataagcactccgcacttaaattcattaagggcatcacggttctttttggagtgcctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaacattctcaagaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgtgcgggccttcgagccgcacgctaccagcagagcctgcggcgctaccatcagcgccacgttcaggcccgatctctctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcacagagttgcctaacccgtggaacatcgagcaccttcgtcgcttctacccctgaggggggggtcgggtgtcaggtttcgggctcgggccaaccccgcacccccccccctcgggtgtgcagggttggccgggggctgccacacatgcacattctcatttctctcatttcagtatttcaataaaagcagtttcaatttcctaagggctgtatctgtgccgctttttcctttttgaagaatttttgacttgaaatgaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatatccccacgcactagccccgacccgcgcttttcgaggactgggacttgggcacgggcccttaaatcaagctaagacacaaaaagaggaccgcggcacagatcatcctcatctcattcgcatagcaaaataaaattaacacaaagaattttttcatcatttttgattgcagattataagttgatctatacaaaaaacaggcctgaaggccttagaagaaagaaaaagaaagaaattgaagattggcgggggcctgggggctcattccgatgcgcccgggtcgccggcctcgtcttccacgtcgtctgcaccgctggcatcgccctcctcgtcggagttgggggcgaacgcgagctgaggggccgagccctcgaagctgtggacgatgtggtcggcggcatcccggacctgcgcgcgcgcgctgtcttcagtcccaggtgggaactcgtccagcgccatccacggagagaagttggggtccctggcctggtagctcgccaggacgagctccaccgctccttgggcgaggtccctcgaggatgacttgatggtcttctcgagctcctcggggagctgctggagagccccggccatcttcgagaggcgctgggcaaggcctcccaggttggcggcaggctttattgtctgccctttccagaggcccgcctgccgaccggcgcgatccaggcgggagactgcatcccacagcatgccgggccctatctcgcccgccaaacggagggctcggcttccccggcggatgagtctagcgcgcgctgcatgtcggcgacggtgtgttcggcatctgcgaggcgggcggttaagtcgctttcgcccgcagccgccccgccgatgcgcgccctcgcgtccagctccttttcccgcgcctcgaggtcggcagcccgctgctccagcgcggctctctcggcgcggacggattccaaattgcggcgggcctgctccgtcagcgctgcttcgcggagggacagggagtccgccaaccgttgcgcctcggcctcggcctcttcgagagctcgctcccgctcggcaagcgcgtcctcgcggaggcggagtgcggactcctcttcggcgcaggccgactcgtgcgccaccagcgttgcctcccgggaggcgacggcggcctcgtggtccgccaggtccttctccgcgacgcaggcgcgctcctccagcgccatggcgcgcgcctcgagggcctcttcacgccgccggagcgccgcttcggtctccgctgctcgctgctctcgggcagcggcggcatcaaggaccccctgggcggcgtcgagcttttttttcagctccgcctcccagttcccgtgctgaaggcggagggagtcctgcgcctcgttcatcactgtggtggcgatgagggcagccccccgctcctcctccacctctcgagcgatctccgccagtgccgtcttgcgggcctcgaggtctgagacgtgccggcggtgtgccttgcggcccgcttccaccatggcctccaccgagtgccgcccctcctcgacacgcgcccatgcggcgtcgagctccgcacgctccgcctgcagggcctccacctgggcacttagcccatccaacaccgcggtgtttgcggcggcaagggcctgcagaaggggctctgcgctcagcggggcgacggaaggcatgggaaagagctgccttggagaagatgccgcgcggctcggcccgccaatggacgtgccggcctcggggatgtcccccggacctgtttggtcctgggcgtcgcccgaaggagtgggcccaagcgatgcgcccgcggcctcgtcgcgagccatcccagaagctgtcgcctaggcatcgcccgaggaggtgggcccaagcgacgcgcccgcggcctcgtcgcgaactgcctcggaagccgccatcgcctcagcctggcgaacccgggcggcctcctcccgagcggcttcttcggcttggcgagcccgggcggcctcctcccgagcggtatcctcagcctggcgagcccgggcggcctcccgggcggcctcttcagcttcccgtaggcggtctgcggcctctcgccggtcagattcccgcctccgtgcctctgcggccgcaggatcttcggcctcggactggccggacttgggatggtgggaggaacgcgatgggatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctcccaggttgctcttcccccgggcgtcggtagggcggttgctccccgagcccccggacgcggggcccagaagcacgacccccttcaggggtagattgatcccctcggcggcttccgcctgcgccgtcatggcccttaggagcctgcttctctgaggccccgaccgccgtcataatggtcaagatggaggcgcgatctggatcgctgcagagggggaggataccgtgggggatgagggacgcctcaacggagttgagatttagcacccgttggaccagtatcttgaagtcctcgggagcccaatcccatctgactccctggtgggtccgcatgtagtcttcggacccggtgtactcccaaggcgccccgagcgcgccgctggagcggcgcaatccgacgacggaaggtagtcgccgtacaccatggccccggtgagcccctgggatcgcaggcccccgaggcggtcgaggacggcgtcatagccatcccccagatctaccggcgcccgccagctgaagccttgcgccgggggttggctcgaaagtcgaaggcgcctttcgtcgccgaggggggtgtagaaccagtcgtttttccagtcatcccacttcttgcgaaggacgcaggggatgtagcggttcagcaccggcccccgcggcaggaaatagcagccgccgaccaccgacggtggcgataccgactgcacggtgaagaaccaccggaacagccgaagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcaaagggaagaaagaagacggacctccccgggtagtctggcgccgggcgtccctcgcccagcatgactatctcacggccggtggcagattccggcataaagcggcgcggcaacccagcctgcttctcgctcacgatgcgggaaggcgcagcacactaccatcaagcagtgcggagccccgtgccatggcgccggacgaagagaagatggagagcgagcgcgtgtggcgaaagaagggcgcagggaagaaggagttagggcgcaagcggcgaaggcaaggggaatgatggcgaaaggaaggaaacaagtcccatcctcactgcctttatacccttgccaacgctgtgcccggctcctcgtttctcgcgcccattatttcgccccctcgtttctcgcgcccacgcttccactgatcccattcgcccgcttgcggcgcgtgaggtggatatgcggttgtagcagtcgagatagatcgtatcgtgcgcgcgttaattacgctcgccgaccgaagcgacattaccgtatctccaggcgaagcaaatcggctcgcccagattcgtgcgccgctcaggtgatgtggcagtcttgaagagaccgcccattattgacagccaaattaccattatcggcgtgcatggtttgagaccgttgggtttctgcccaaccatggagaccggtcccacctgtcaccaggctttaggagtggcgtcacacccggccgcttcccataagaagggcgatcgcccttgcataacgccgggggctactgtcggtgacatgggaccgggagtatcatgactagaggcttgaggcagacacaatcgcccacgtggcctggcaccctcgggggacgtcgagcccgagggtgatgtgtgcgcccacctcttggtctccccgaggggggggggtcggaccactcttgcctcgcccccgagggccgaggcgccccgaccccttgcggtttctactccacgtgtatgggttaggtgagcacagcggggctcacctaaccgcatttattgcgcctcggttaagcgtgtcacgccgcacgaagtgcagtgcagtgcactcgattatccggtctgtgaccagtcacagaccggtcaaatcgcgggttaggtggcgacaggcggtcagacgcacgcttcgccccatcctgtcaagacgagagcttctaggcactcgtccccggctggagctagcgtgttacatcccaaagatgacacgttagccccgatcgatatatgccaggcttcatcctaaccattacaagcaagatgttgtttgaagaagggcaaacatacacgttgctaagtcaacgcgtggtggacaagaatgaccgatttgtgaccggtctgacactgctcatgtcgtcagcacactgccaccttcccacgacgtgcccgcctcaggcacgagtggaggtaggtgtgtcccgtcccgtcaggaggatgcttggaggacgaccgtgcaaatctccgtccatttatgaagagaagaaaagtccagtttggaaagggaagggtgcatgtggtatccccttgaagtataaaaggaggaccttgcccatagaaaaggaggatgatcttttccagattcagaacctagaacaagggagaggttggctcacactttgtagctccttcatacatagatccaccaaaacacaggagtagggtattacgcttctcagcggcccgaacctgtatacatcgcttgtgtttcatgctcttttgagaggtcgcgattttcccatatacacggagagcttgagatctcaccctgagcccccggccgaaccggcaaaggggggcccgtgcggtctcccggtgaggagcaccgtgctccgtcaaagtggactcctaaatgtgcgcacgtatccgttgccacgtcttgccatcccacaatccaggacacgacgagcacgacaccagctccgcgcgaactcagcgcgtgtcaagccttactgcacatgatccgaaaacaaagccaaattgtgtttgactaagcaaagtagaaagaaccgaaagcagggaaaactaaaacaaacaaaacagctagatttattcaacaaatccgaacaaatcca

SEQ ID NO: 57290 - DNA, 4487 bp, Oryza sativa; identical to SEQ ID NO: 22686
  unsure (1)..(4487): unsure at all n locations

SEQ ID NO: 57291 - DNA, 14549 bp, Oryza sativa; identical to SEQ ID NO: 22687
  unsure (1)..(14549): unsure at all n locations

SEQ ID NO: 57292 - DNA, 983 bp, Oryza sativa
  unsure (1)..(983): unsure at all n locations
gacgcgggagtccattgagtctaataacatgcccggtggagaagtatcatcgacaaaaggtttaaaaataaaggtatatcatgtactcgttgtggatttttcagctgataaacaatacaaatgattcaataagtagcaataagtgactaattatttaatttcctctcaatattgattttgtagatttgggcagctttttgacgaaaagtagtgctagcacatgttcccctcatccaagtccaagtacccacggtgatgatgcgcctgtagaatccatcgccgaggaagtgcttgaagagcctgttcagtgtcttgagactgtgatcgaaaatacacaagaacaaccagaacttgaaggtattgaacttattagggaatttgactcagaagttcatgttgttgttgatccgactcttcgaatcccaatagagaaattccatccggacattagatcagaagttagaagagcttatttgttgaagggacctacccaacctaaaattacatttccccgtaaataatatgggtctgataggagatattttcgagcagagtggtatgctaactatgattggttggaatatagtgtgtcaaaagatgcggcttattgcttctattgctttctctttaggcaggaagccgatcatgaaaaatttggccacgttgttttctcaaaaactggatatgataattggaagcatgcatatagagcattccctactcatgttggtggggtttccggttgccataataaagcaaggagatgtgccgatgattttaagaatcaaagggcaagtatctcacataaagttgacactgttagcaaagagtcagaaaagttgtatgaaatccgtttgactgcttctttggatattgcaagatatctcatttcgcaaggtcatgcttttcgtggtcatgatgaatctccttcctccctaaatnnnnnnnnnnnnnnnnnnnnnnnnnnnnnnnnnnnnnnnnnn

SEQ ID NO: 57293 - DNA, 1094 bp, Oryza sativa
cgggcttggcgttgctcatccgtctcgttatcgcccataaagacgccgaaatagagaggggtgtagttgtcttataggctttcatcgaaatcgtcgagatccgggtcgttgttgcgaaaaccgaactcattgtactccacgatctcggtcggacgcgagtcgacggcgggagagctccagtagccatccagctggtccgtcgaaactgagccgagtggctggaggataacgccgacttccctggagctaggcgagatcggtgttgaagccgacttccgcctaggcctacgggatggggacgctgtggtggtgaagacggctgccaaatcgtcggggagcttcattaggatcggtgggtaagccccatcatctcgatctgatgacgttggagaagatgcaatctctcccgagtggtttgaagccgactcgattgagatggacttggagtagatttcagccgcgtttggaactccaaacgggactgagatccggctctctcccgactggtccgattccgagtcgaggagagagatcttgccgaagttattggtgacgaagtcgaggctgccgaaccgaaacgcctgcccgggtgggaagacgaggtcgtcgatgccggagacggaacccattgcactgatcggcgaaaagcttgacacaacccctacctggcgcgccaactgtcgaaacaagatttcggcaatactaaaagggggtggctatcaagctggaaaagtggatgggtttggagacaaaggatttatacaggttcaggccttcttattcaagaagtaataccctactcctgtccggggatgaatccgccgagtgtattattggatgtataatctccaagaaagttgatgtcccaggaacgactcggacccctccttatataggggaaggagtccgtattacaagggataactcatatccttatcagaatacgagagtacagataaaatacaatcgtaaccgactaagcctcagggtatttccttgacgtacaagttaagaaacaaacccgagatacaaataaagatattctatctatattcggtatcctatatccagtctaaatataatcgctgtgtaga

SEQ ID NO: 57294 - DNA, 1117 bp, Oryza sativa
  unsure (1)..(1117): unsure at all n locations
tgtaccagcgcccttcccctctctctccccgtgccgctgaccggtgggccccgcttgtcggcgccgcgccaccccgtgctgacgtcagccctggaatatattgcgcaataattaattaaggactttttctttattagtaaaaacacagtgaatcttctaaaattcataactaattcatccgagctccgattaagtccattcaagtctcagtaaattcataaaaatgtgtagaatccattaaaaatggctttgttatctgtttcagtagtcttatagcatgttttgcttgtgtgctttgtttgtcacgtagatttcggccgtttcgtcgatccgtggtttctcgaagacgttgctgtggttccatcagtgcgagagcaaggcaagtcatgcaatacaattgatcatattgtacctaatttacaaatgtcccgcatttctattaaatattgcattgttttacaatatcatgtgggatgggtcctattactcagctatatgttgttttccttatgccattgataacttgggtattaaaatgactagatgttggtttaggagatgcttagccatgcttagttcaactagtgcataaaaggggaccacattaaagcatagacttgattattggcaatagctctggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcgtccggggtgtccggttgatcggctgccggattcaccgcggcacgaaaggggggctgcccgttgcctgctggggacggnggcgaaccctaaggtgtggtgcgatcggttagagggggttatgcgaagggtcctgtcacggcctctttccggtatgtcgtggtgacatgtcggcgcacgggaacgtgtcgtggggctgtgtacttgtgggtacagctgtacacctctgatcagagtaaaactattcgaata

SEQ ID NO: 57295 - DNA, 1509 bp, Oryza sativa
  unsure (1)..(1509): unsure at all n locations
tcaacggcgtcaaatatttcgaaacggatggagtaatattttgtcggatcaaatacgttgtacgatatactccctccatcatataaaaatgtaaggtacagtcaccgcaaatgtaaagattaaaaaaaattatcacttttttaattgcctcaatagaaacacgcatatacccaatataattagagattttaaaagtggaggatttttaaaaatgaatttagaggagaggaatgtgctagttaattgtatgcatatatgtgcgctgaaaacattaaaaaggagggtgagattgtaccttatatttatgttgggatatcgatggagggaatatatactagtttgcccaattctttcgaaatgatgcaattccttccaagagtagttagtcactagtttggtactatttgataaacaattaaacaaactatggatgcctttgtacatttttttcggtaagtatacagtagatgctttatttttcacattgtcatcattcttttcttttcaattacactacttgcaagttggcgatcacgcatgcatgcatatgtagttactaggatataggttactttactaaaagctatatgtgatgggttcagtaatttagttttcatgctgattggtggaaggctatagtggtatttagattcatgacgttcttgactgatcggagtgttctattaccacaggcaaatgcacgtgcatgtgccacctggtcttgaagatgtcaaattgtgacttgattggcctctgacttgttcgtatgcacacgtgcatgcagacttctaattaggtaatcggcgcaaataagctactactcgggcacctccaatgtttatgaccataagtagcattaaggtgggtcccactattcttagggttattaccacaatgtttgaagcaagagtaaactttaagatgggtcccacaatgtactattctagtaatttttttatcagccgtaccaatttttcatcctcatatctattttaccccattattttattgcttgtggtcaagccataagcttaaagctttcttttgcatttaatgacttatgactttgtttcacaatgtatatggtcactataaaaccttatggcctcttcttatggccacattgtggctgcctagggacatttatatttatactagaaaaatgcccgtgcgttgcaacgggtgaagtctattttaatcttattattgttatatggttaagttaagatgaaatttaatgtggaatttcgcttggatatatatttttagaaaatcaagagctccaattagtagttcgatcttctcaagttagcatgcgagttttttaaaacatattttttatatgattccttatgtattaaaaaccgatcttaaaaaccgactcaaatacggatatgtattttcaaaagcaaacaaacttaaaaactgactcatacacgaatgacataccaannnnnnnnnnnnnnnnnnnnnnnnnnnnnnnnnnnnnnnnnnnnnnnnnnnnnnnnn

SEQ ID NO: 57296 - DNA, 1026 bp, Oryza sativa; identical to SEQ ID NO: 22696
  unsure (1)..(1026): unsure at all n locations

SEQ ID NO: 57297 - DNA, 1676 bp, Oryza sativa
gcgggtgagggccgagggttttgcgaggttttttggggaatggaagatggagaatgaaggagtggagaggaagtgtcttgaagtagggaaacggaggcggtgctgcgagggggatgggctgggcttggctgggttctcgtgggccttgacttcgctgcaaccgaaagaaggaaaaagtccacaaggactccctcgaatataggatgaatctgattcgtatcccttacccataataccagatatcttgaccctcttagctattaaaactgatgcaatatgaatcctttggtggttttgaaggtggttttcgttgatgtagcatctaagtatcgcattgacttagtcttcgtcatctacgtggcattaaaaaaataaaacataatgtgtggggcccatgggtcagacgacggcgtgaaaccaacgggaccaaggcggcacctagcgaaagaagagcataaggcggcagctacctcgtcagcgggggaagtgctggccacgcacggccggaatcatctaggcgtcgttggtcttgccttggccacggtggggaggcgagagaggacgacggtagggaggactaaccgatggtggttggggaaacgaggatgatagcaaggaggccaaggcaaggggtgagaagggtatgcaacagcaaggaatgctatgatttcccagcggcgtttgcggtgttatcttctccaaagcccatggccgcggctgcggcgtgctcaacaaagagccacttgggcatcgactggagaaggaacaacggaagttgtacccaagggggacaaagggctccgagcgtcatcgtcgtccgtgatttggctcccagggtgctcgacattgcgaatggcaatggcattcgccgagcttgatatctcccccagcaccaaacccttcctcctagcaccaatgcagatttggcaggcgagcgagcgatcccgtccttcctgctagtcctggggcctcgcggaccgcagacaagctcaccaccacctccaatttctcttccacagggcactagtgcggtgccaacactcctctacctatcgtcgtcctctccagcctccctgctgcctactcgtccttcttgctcctcccaagggctctccaactactgtagcgtccctttctaccgatgaggtctgtcggtgaaatgggcccaggggtacacacagtaaagggaaatatctttcccatctagtcgcgtggccacgcggcctcgtttccccccgcccctcgggtagcgaggtggctagggggcctcggggtgcggtggccagggggcctcggggtgccacgccacacccctcgggctttcggggcgtgctaccccggggccctcgcccggccaccacatggtggggagaggaggcgaggcgaaagacgatgctccgcgcctttaatgcgcggcgccccaaccgtcccgcaccgcattcaatgcggcgtggggggacgtgcggcgccgctcgattgacccatgtcaatcgagcatgaccggcttgtgactggtcacaggcgacgggacggggggcagtgcccccatgttctgctctgtgtcaggcggagtgggggcatgtgtgccctgtcccgtcggcacgctgctaggggcgccccacgcgcgtgatgaaccgccgaagtcttcatgcaattaatagggaatgacagggatg

SEQ ID NO: 57298 - DNA, 2395 bp, Oryza sativa; identical to SEQ ID NO: 22700

SEQ ID NO: 57299 - DNA, 4782 bp, Oryza sativa; identical to SEQ ID NO: 22701

SEQ ID NO: 57300 - DNA, 7028 bp, Oryza sativa
  unsure (1)..(7028): unsure at all n locations
nnnnnnnnnnnnnnnnnnnnnnnnnnnnnnnnnnnnnnnnnnnnnnnnnnnnnnnnnnnnnnatcttccattccccaaaaaacctcgcaaaaccctcggccctcacccgccgccgccgccgtcgcctccaccggtaaacggcagcatgaggtgagcgattgctcccctcctcctcctcctcctctcccatcatcacttcggctcccgattcggcggagaaacccatactccgcgccgcccgcacgcgccgtccagcgccgggagcggttagatctggagggggcagccgctgtgcacgcggggggaagatccccggcagcgcgagagggcccgtggggtcccttccgcgggcgtgggcttgacgctagggttcgtcgtgttttgatttctgtgggatctgtttgttgctagggttggggggttgggggttggccgtaggaagtttagatggtttttggtggtgcgcctcagttcacggccatgtccccgcgcacgtgcgcgggttgcccccagctatcggtgtgttggtagatctctctgctttggtttcccactgtgtcgggttggttaattatgcttgtgcggcagctactgtttaggtgtagctcgtgtggtttattgagctagccagggttttatttggttaattggaggtgatcatctgctcgtatagtcctatagttaacgaggataacttcgcactgacgaccaggagtttaataataaagtaataataagctcaagtttaatagtgggctataagccaagtagccaaatgtaagcttatgtggaagagagagtttgaaaaatgaagagggttgggtctcagtctcatgtaagagctaaccattcacatactttaagatggataagttaattgtatagatgagatagagaggagaagaaaaatatagataagcttatagcttatctactatgcatgtcaactctaatatgtgctataagttcatagttggctttattattaaacttgctctaagttggttcatgccatggtgcgtgcagcttctgataactgttaggaggcaattagtttatctcttattcctagatatctcttattagtagatatttctgtgcctttgtagttttgtctatcgattgtgatatttttaagagattgaaatctggtttgtaatacatttttgcattagtgctttctcattgtaagtgttagttcatgttcagttgtaggtaactctgatactgatgccaatggcaattgtgtctcggtattctctaaggattctttgttggttttgctttatgataggattaccagacaccaccattttatattcattaagaaaactttcatttttatcagtattttgtataatactccctgtgtttcacattataagtcgttttgacttcttttccagtcaattttttttaaagttcgtccaagtttatagaaaaatatggcaatatttccaacacaagacaaacatattaccaaaatatattcagcattacattttagtgaaactaatttggtgctgtagatgttgctaaatttttctataaatttggtcatacctaaagaaatttgactagaaaaaaagtcaaatatgatacggagggagtacttgtcacttgttcatatagcatggatattactggcacacagtaaacttgtggatttttgtaggctgctgatgtatttgtattggagtttaacctcaaagggatctaaccctcattcttttgcttcttgtaaggtgctcagaattgaattttttttatggttttctttttgtttcctgtagtcggcaccctgaagtgaagtgggctcagaggattgacaaggtttacataactgtacaattagctgatgctaaggatgctaaggtcaatctggaaccagaaggtgtattctctttctctgctacagctggaactgatgggaacttatacgaatcaaagctagagttgaacgacaaagtaaatgttgaggtaatacatgctcgtgcaatagctatatgactgcagtttcctctatattaaaatgcgtggttccttatcccgtgtttatttgttttgattctacaggagagcaaaataagtgtaggtgttaggtccatattctgtattgtagaaaaagctgaggccaaatggtggaagaagcttgttcgagatgatcaaaaggcaccacactttgtgaaagttgactgggacaaatgggttgatgaagatgatgatggtaagctatgcacttcttttgcggtgataaactgtggacttgttttctcatgtttgacgcaactagtagcagcataatgagaacaagtgagatgaagcaagtgcgcctaacatgttagaatggagtatcatttgatcatagcacataatgacatgtttgaatttgaagaatgttccatatatgtttctctttaaggcattccatttgtttttcaactggtcatggtaaaaaaaaatcatgcgcaggacaaactgttattactcgttatgttggatataaacctacattgtctcactcgtttagattccacattcaagccccaaaactaatatcagtttagggacctaatctgctcttataatatattattttttaacttaattatatagatattccaggaaatttaatctggccttattaatgtaaataagcccttgttccttatccaacgttttgatatgcatatattttattttttaggtgctgatgtcaacgtggatggaatggacttttcggtaattagttcttttcagatttcatgtttattcctagatttcctttttgctcatgcatatattgttttttaaactaatgtttttctttatgtctttttttatagaattttggtggcatgggtggaatgggtggaatgggcggaatgggtgatatgatgggtggcatgggtggtatgggtggcatgggtggcatggctaaaaagatgggtggcatgggtggtatggccggtatgggtggcatgggtggcatggatgagttcgaggacgagagtgacgatgaaggtttgtcttcctttattgtgtccacagattctcattaatatccacttgtttctattagctatatgatagcataatatgattctgtgaaaatataaattaaggaagcattatttttgcagtttggtaagattagtatggtttagtttgaactgcctgaccagatgagtgatatgactcatgcacgtgacaaatgccattaattgaaaggccaattcttgaaaaatctgcaattgtgtgattcgtactcttaacagcagtgatcaaaatattgcacctttcatgcttggcacatataaatgcaactcaataggataaagctatttttttcatcatacaggactgtttcttgatattgtgattgtagaagtaaaagtgctatttaatggttctcctgcacattttggaatagtttggcccgaattatgttgttcatgctgtaactattatggtggtaattagtctgatatgtttcttacttgcattgattttgtgataggtatgatactaaccttaatcacatgcatcaaaagtttcttaaccattatacttacatactggttaggaaactttttgatgcatgtaaagttagtgtcactaggtgcagattaaggttagtgtcgcgtgtactcgtattcatcatattgtacttacgtctagagaactgaagcacattcccaagaaattgcaaatcagtttgtattcatcatattgtacataaatctagagatttgaagtacctccaagaaattgcagacttgaagtacatctaggcatcaattataagcaatttaaacaactatgttatgtcaattaagttgatataagagtgccagttatctttgtttttttatatatcttagtaccttttaattgtaatcttgcttgttaaaagtcctcatgccatcttttttgactttgttgctcccttgtttagaagaagtgtctaaacctcaagacgcagagaaggctgctgaagccggaaaatcccaggagtcggacgctaaagccgagacaagttagagcaatcgaaggcccctctacataattcctttctctgttgcatcccgtcttttatggatctggtgaactgaagaaaacattttacgttatgacggtagggatgggtgctcccttgtagaacgatgctatgaaactggagctccaactgagtacgcaaaccattcttggattgtttttcttaatgcgctttgatgcttcatcgctctgcaatcatatattaagctttggatgctttaatctgcttttgtgagatactgctgtgcccgtgctagagtccactgagcatgcaacaattcatgtgatctgacgatgcttgtgctagacgagtgaggcagtagcactgttagttcccaagcttgttttgaaaggatgcatagtgaatccctatttatttgtttcacaactctgttctgcgctaattggttgaccgtgagaccttttggccagcgtagaacgactactacctgtttgcatgtggtcttacggtcaacgtgcatggcaggatgtaagtaaggtccctgactcctgctgttaacagagtaacaggaacagggcttttccggaaaagcccgcattcatcagattgaggcgaacgtgaacaaacgtttttaattgaattcagattaaccaacttgttaatgcttgttcaattcaaacgtaatgctaaaaaggggcctaacacaacatttaggagtgttgataagagtgtcaccctattagtactgatttattccctctgtttcgattaaaaataatcgacgtattgtagaaaaccaaaaattatcatcgtcgtacttcaaaggcagcacccgacacatctcgcatatgcgcttcgttttcttatcctcgccgcttcgtatgccaaaaacctcgaattttgttgagaattaatattatttttatggaaaatcgcaaaagtagtggccaaccggggaaaatcgcgaaagtaggtccctgtcgaacgggtgcaattcgatagggcacctatcgaacgacgggcagtcgacaaaggcatgtcgaacggctggcgttcgacacgctcacctgtcgaacggagggagttcgacagggcccaccacccggcgccgcgaggcctgtcgaaccgggggcgttcgacagggccctccaccgaccctgtcgaacaatgggcattcgacaagccggtttaaagccccgtccacccaggccgcgagttcgatttgttttgaggaccacatcgccagccgccgccgagagtcgccacatcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgtattgttcgatgttagtatgtatggttagcacatatttgttattgctaaatgttggtagaggtatttaagtaattgtacggttaaattagttcttagttagtacatattattgatatgttgtgtgttaaaatagatacaaaggtgttatattttatttggattattaaactagttgtttgttactaatagttgtaaattagtacacggcaatatagtataagttataatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaataccgtgtggccagtgaggggtcaacatgaatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggtggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtaggttcgagggttgagcaacatacgtgtttattggagaatacccgtctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaactcatgaggattcttatcacaatcttcccccactattggaggtgatgcaggcaagaaacccgggcacacacatggctattctcgatgaggtgaatgaa

SEQ ID NO: 57301 - DNA, 784 bp, Oryza sativa
  unsure (1)..(784): unsure at all n locations
nnnnnnnnnnnnnnnnnnnnnnnnnnnnnnnnnnnnnnnnnnnnnnnnnnnnnnnnnnnnnncatcgttctacaagggagcacccatccctaccgtcataacgtaaaatgttttcttcagttcaccagatccataaaagacgggatgcaacagagaaaggaattatgtagaggggccttcgattgctctaacttgtctcggctttagcgtccgactcctgggattttccggcttcagcagccttctctgcgtcttgaggtttagacacttcttctaaacaagggagcaacaaagtcaaaaaagatggcatgaggacttttaacaagcaagattacaattaaaaggtactaagatatataaaaaaacaaagataactggcactcttatatcaacttaattgacataacatagttgtttaaattgcttataattgatgcctagatgtacttcaagtctgcaatttcttggaggtacttcaaatctctagatttatgtacaatatgatgaatacaaactgatttgcaatttcttgggaatgtgcttcagttctctagacgtaagtacaatatgatgaatacgagtacacgcgacactaaccttaatctgcacctagtgacactaactttacatgcatcaaaaagtttcctaccagtatgtaagtataatggttaagaaacttttgatgcatgtgattaaggttagtatcatacctatcgcaaaatcaatgcaagtaagaaacatatcagactaattaccaccattataagtacagcatgaacaacat

SEQ ID NO: 57302 - DNA, 1771 bp, Oryza sativa
ttcaaggtcactcggtaacggtggtcacatcattcccactcggcgatgtactacacaaccgcgaagcaaatgggcggattgctaagtgggctttggagttgatgtctttggacatatcattcaagccccgcacttcaatcaagtctcaagcgttagccgattttgtcgccgagtggaccgagtgccaagaggatacccccgtggagaaaatagagcactggaccatgcattttgacgggtcaaaaagactttcaggcactggagctggagtggttttaatttccccgactggagaaagattaagttatgtgctttggatacatttttcggcgtcccacaacgtcgccgagtatgaggcgctccttcatgggctacggattgcaatttccctagggataaagcgtctaatcgttcgaggtgattcacagctggttgtcaaccaagttatgaaagagtggtcttgcattgacgacaacatgatggcatatcgacaagaggtacgcaaactggaggataagttcgatggacttgagctcagccatgttcttcgacacaacaatgaagctgccgatagacttgcgaactttggatccaagcgcgaggcggcgccctctgatgtttttgtcgaacacctttatacgccgacggtacctcacaaagatgccactcaaattacgggcacccatgatgtcgctatggttgaagccgactggcgagagcccttcatacgatttttaacttctcaagagctccctcaagataaagatgaagccgagcggatttcaaggcggagcaaactttatgttatgcatgaatctgagttatacaagaaaagcccttcaggaattctgcaacgctgcgtatctttagaggaagggagacaattgctgaaagacatacattctgggatatgcggaaaccatgctgctgcgcgcaccattgtcggcaaagcttaccggcagggttttttctggcctactgcagtgtccgacgccgacaaaattgtgcgcacatgtgaaggttgccaatttttcgccagacaaattcacttaccagctcaagagttgcaaactatcccgctgtcttggccgtttgcggtttgggggctcgacatggttggcccgtttaaaaaggcagtcggcggttacacgcacctcttcgtggccatcgacaaattttccaagtggatcgaagctaagcctgttgtcacgattacagcagataatgctcgagacttcttcatcaacattgtgcatagatttggagtgcccaatcggataatcactgataatggcacacaattcaccggcggagttttcaaagacttttgtgaagatttcggaataaagatttgttatgcctcagtagcgcacccaatgagcaatggacaggtggagagggccaacggcatgatacttcaagggattaaagctcgagtttttgaccgggcttaaaccctatgccggcaaatgggtgtcacagttaccatcagtactttggtctttgcgtactacgcccagtcgggccacaggccagtcacctttttttcttgtctacggggcaaaagcaatggtgccgagtgaagtcgagttcgaatctttgcgctttcgtaatttccgtgaagaacgctatgaagaagaccgagtggacgacttgcaccgactggaagaagtccgcgaagcactttgattcagtcaggctcgtacttgcaagggttgcgacggtatcataatcgcaatgttcgatctcgtgcctgtctagtcggcgacct

SEQ ID NO: 57303 - DNA, 3232 bp, Oryza sativa
atgggcgccagtcggctggctttcagcagtcggctggttttcagtagtcagctcggggtccttggatatattctgctctgtcatggcaggatcggggtcttttccagatggatctatatcagatggtttcctgcaaagtattctttcagaatttagcatcattttcatgagagagcttaccaaagtgaaatcataccgagaggtcttatacctggaagatgttctaatttttggcattgcgcggccggccaattttttcctgggcatggtgcgctttgggggtttgttaggcgagcccttatccccagatttatcatcgtcgccttcatcatcatcaagcaccagtttcctcttgcgaggacccgtctgaccagttgatttggaggtctgaggttgcggatccggtctgatcgttggccctccacctccctgagcagtgtgttggcgaggagaccggcgctgagtgactggtggatctgacttcatcagtgcatattcctgaaccagatgcttccatagttagtcaactcagcatgaagacaaaattatgttctgatcatggtttgaggattttcgatacatacctgtggaggcggattgaacgcattatatggcacgactggcagctggtgtgagtagctgacgacgattgcatttgagaagattttatacatcctctccttcatgattctgaaatccagagagtctgattcttcacggttaggatcatacctgccgtcgaactcgaatgccgtgcgagatctctccttgattggcgctagtcggcatttgatgaagtgccgagtaatctgctctccttgcaagccttgctctttgagctttaacatgcgatccaacaattccaaggcttggactgcttcgtctccgattggaagggagttccaggtatcttggtatactggaggaagacaagagtacccgggaagagcaggctcaggattttggacatagaaccagtttgcgtgccagcctttgttcgaagtcttgaagggcatggagaaatatttttggctcagagttcccctcagttggaatcctgcccccccgactacacacggtttgttcttgtttggttggggcttgaggaaaaagatccggcggaatagggcaaagtgaggcttgatccccaaaaaggcttcacaagcatggacgaaattggcaatatgtacgatggaattcgggtttaggtgatgtaagctgattccatagaagttcaagatcccacggaaaaatcttgaggtcggaagagcaaaaccaccgtagaagaaatgcgagaagactacaatttcatgcgtatctggagatggaaatgcctcaccgtacgctggccgccacccgatgatctctttggctgggagaacaccatgcgccaccatctccttcagattctcctctgtcgcatcggacgccgcccattggccttcaaagctttctctctcttccgccatcgatttttctcaaatgtgctgatttgattcgagggatggcttgagagaggtgaggaattgaggtggtggatcacgggaaggattttgatgcacttttcggaggtggatttggccggagttgtgaaccctagttcgctggcgcagctttgcactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcattgcctaggctattcgacttatttattaccataatctttataatgcttgatgggtaatctttagagtttttatattcggatgcctgtcaagtgtgttcattcgtgaaccttttagagtgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttgggggctacacctaattaggtgcatctattcgatgcaccatgttttttatcttttcgccctttacagtccactcggcaggccttggcatgaaaagcttgaagcacttggattactatctttgagaaggctatgatggtcgactgcaaaggactcgggggctactgtggagattatgggtatcccatatctacacggcgacggtatttggattgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttcccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacagttggcgcgccaggtaggggttgcgtcaagcttttcgccgatcagtgcaatgggttccgtctccggcatcgacgacctcgtcttcccacccgggcagacgtttcggttcggcagcctcgacttcatcaccaacaactttggcaagatttctctcctcgactcggaatcaaaccagtcgggagagaaccggatttcggtcccgtttggattcccgaacgcggctgaaagctactttaagaccatcttaaccgagtcggcttaaaaccactcggccgagattgcatctcctccgacggagccagatcaaaatgat

SEQ ID NO: 57304 - DNA, 2166 bp, Oryza sativa
  unsure (1)..(2166): unsure at all n locations
nnnnnnnnnnnnnnnnnnnnnnnnnnnnnnnnnnnnnnnnnnnnnnnnnnnnnnnnnnnnncacatacattgtattcaaaccttcggaatttttattctatttgacaatgaacgatcaacagagagcttattttgaacataacctttagtaagccacaccgcatgataagatgactcataaactcacactggtgaaagaagaatgccatttttggcttttcagagtgtttgcgttgtactatgtaattctcaaaaaagaaaaagtgaaataagttgtaattctgaacatgaaatcctttacaacaaacctaggtaagctagcaatattggtgtaacaacggtaacatttgttatgaaaaaaaactggatatatctatctgatattgtcaaaacttatactttaaatgaaaactatataccctgtccgttttctaagttgatgacaccgttgactttttatatgatgtttgactattctcatatttaaaaaatttatataaatatcagttattttgttgtgatatatatgttttaacattaaaggaaatttaggtgtgatactttaagcatatttacacaatttttctaataagatgaatggctaaatattattttaaaagtataatagcatcatctattaaaaacaaaggtattagattgccgtgttttaactgtatacattgtatatgttgtcatacatttcttttctgaccatagaaaagtattgcttcctccatcccaaaatataataacttatagcgtttaaaagttgtaataaaatataaaaacttatatataccttttttaaccaatcacaactttctacctttcgaattaattttcccccaatttccttttcccaactattcacaacattctcttatttaattctacatactttcttataggcatatttaaacctaaaactcttcgcatttaggaaagaggtggtattaagcagctaatgatatatatatgtgtaaacaagtgtgagaagagccaccagtttcagaagacaccagccgactacagcagccacagtgaatcgaaccagaagaaattaactagcgcttctgatgcatgcacagtggtgtcgtcgatcgatcgatctgcccagcctcctctataaataacagtacgtagcaacaacacatctacacccctccagctgctacctcgatcatcatttgtgcactatagctagagaaacatattgtaaccagctaggccagcccaatcaatggcgtccgccgcggctaagattgccgtcgtctgtctggtggttttgtccgtggggcagtccatgatgatgacggcggcggcaactactgccgccaccggcgccacgacgtgcaactgcgacacaagcggttgctacaattgcatgctggatgtcgtcaccaactggtgcaaaggcagagatttcaactggatggtgttcaccgcctgcttgatcaaatactccaaggaaaaccagtgcttcagcaagtaatagacttatcggagctagccgacatacgccgatctatcgtttgacgcgtacgacatatatctatttctattatctattatctatttctattatctattatctattatctatctattctattatctatctatctatctatctatctatctatctattctattatttatatctattatctatttctattatctattatctattatctattatctatcgattttgctatatatttatcgacaaatttttccccaaaaatttgacggatgtaattacagtacaatcgtagtgtaattacactgtaacttgcatgtaattacactgtaactatagtgtaacttgtatgtaactttcaaaaatctttccgcaacatgttatttcggtaaaatggaggtcgtgggaacaaattctttcatatatgtgtgtgctatgatttgttttcttcctcaccaaaacaaatcttgtgatagatctaacgattcaaaattatgtgaaacttacaagtcacagtgtagttacatgcaagttacagtgtaattggatataagttacagtgtaattacgttacgattgtactataattacatctgtcaaatttttggggaaaaatttgtcgataaatgtataggcagtcccattatctattacttcctccgtattttaatgtatgacgccgt

SEQ ID NO: 57305 - DNA, 1645 bp, Oryza sativa
  unsure (1)..(1645): unsure at all n locations
gattcaaacacttttttttatcatgcacgacaagacagttattatttaagtggaagggatttaggcattgtgtgtttcttttttttcggttacaatggtgtgcacacattgagttattatttaactcatcgaagcaactagatcacataatgagttttcagttatattttaactgttagcgacttaggcatgggttgtttatttaataatcgatgcggatgcacggcgagttatttcttaactcgacacgcaatgtattgttatttacgattcctttttttcccttgcagctacagtgcgaatagcagcgaatcttcagggtctagtcttttcaaaccatcggagttatcgtcttccccacattttacggccagttctttcttctccgtcgaccaagaagaactctccctcctctctcgccgcctctgccccggagatcgccggcgccgccgggattgattcccactgattttcttccacaagtcggccacaggtaaatgtgatatcccccgatttttatccgttgtgttatggatgctggtttcgtttccccatcccaaatcgaccgcaatctagggattcttcctaatgtatcgtcgctccctttaggaagggtgaagaggattcggttcgccgattcgcaaaccgcgtgtgaagttgtgttccacaggccatggtcagcggcgcaacttcttcatcaatggctggagatgaagcaacacataggaagccaaaaaggaagcggcgggctaagtcggccgatgaagacgcatcaggcgatgaggttagtacaaaactcagtcaatcttttgctacctttttttccagtgactattttgggcatatgttaattgatacaaatttactcatgttggggatccataccgcaacaggggagagcagggtgtgcgtagtttgcgtgcacaaatccatcatacgcgattataagttatttctttttactcttctttgtgtcacaatttcggataccctaggtgtatctatctacagcgctctgcaattgacttacctttaatttgatcagtcaagcgcatgggtatgtgttgttatttttcagtcaaattagcgatatcctttatgcatcaatagcttctttttttttttactataatgtgttatgcagtatatttcggttttcgtttgattcccacgacccacccacgggctcgtgccgactagaatgaggattggtccatctttttggttgcaaatatacgattcttttgttttcagttctgtctcgcatgtatgcgagtaatatactatattcacaatttttccttttcagtatacataacaataggcaaattgatttatgtgtttgtcatatgccgtttaatttttattttcatacatgtcagtgttatgcacaccatcttgtgtgtattcttttttttcttttttttgcaaacacttcataacactgccatttatagcctcgtctttccagtgaacatatcagataaaaaatcacatccttttatttttatttctagtgtcggcattgatatactagcaccattttttttggatttttattattcatgcttaatttcaataggtnnnnnnnnnnnnnnnnnnnnnnnnnnnnnnnnnnnnnnnnnnnnnnnnnnnnnnnnnnnnn

SEQ ID NO: 57306 - DNA, 2443 bp, Oryza sativa
  unsure (1)..(2443): unsure at all n locations
tgttaaatatgttattcgaattttaggcatacaatatatttggataagttttctagtacgagtctttccccgggttctctgttgttctgtcagtagcaaaatttccggtattttttgcagcgtgcacatatccaaatatcaggagtcaagctttgcattgtagctattctgttcaagtgaattcaatttcacgttcaaaagtgctacattcacccgaggttgtgtgccatgagattttcagatgttgctacgcacacacaattttgtgtatatgaggtttgtacggagttcaagatactttgttttatgcacccaggcgtttcaagtggttcccaactccccctttcgttttccacgtgcacgcttttcaaactgctaaacggtgcatttttacaaaaagtttctatacgaaagttgcttaaataaaccatattgattcatttttttaaaaaaaatagctaatacttaattaatcacacgctaatggaccgctccattttccttgcgggagggattagtttccatcctcctaaaacgaacacagccctggagttctgataaatttactctttactaccttagagcatccccaggagatccttcatccggtcctccatccgatatatggtgtacgcgagatgaaaatggacctccagcagatacggcatccagtccgccaaatatggacgatgcgccaaagcgagcagatttcggccaaatatagcgattctctctcctcacgccatatctcaatgcccacatctcctgcccacattcggacttccgtcgcgacctcgcctccgtcgtcgccgttgctggccgcaagttgctgatgccaagtcgtcgcaagccgcaagctgccgccgcctcttaccagcctgtcgaccgcctgcgctgctcgccgtggagtgtggagaggagggtgtaggcatggagagggagagtaccaaatctagaaggagccgtgcggccgccgcctgccgccgttgcctcgcgcgttgtcgtcgcctcctgccgtcgccgttggtgggggcgaggacggagcgaagaggaagggcggcgcgagatgcaagacggcgggggcgaggtcgcgaggagccaaggaagcgaggacgacaggccagcggtggttggtggcgcactctagatgcgccgctccgccgccggcgcctctggatggcgatgcgccgctcccggcctccctcccgatctgtctgacttctctctctgcactctcttctctagggttagcagcttgggttgggcctgctggggacttggggagggattatggactattgattggatgggcctttttaacttcagaaattccgagaaattttccggaatgtttccgaccgattccgagttctgacggaaactgcgattatcatattcgattccgtttccgagaaattccaaaaaatttccgaccggctgattccgtttccgaaaataggtccggaatccggaaaaattccgtaccgttttcacccctagtaaagaagaggaaataggaaataggaaataggaatagagtgaaaggaaaagagtagtagtagtagtagagaagaggaaataggaaataggaatagggtaaaaggaaataggaaataggaatattttttgctgtgtttttatgttcatttcattttatggatgatggtacgaatatataaaaaaatgtttccctcaattcaaatatatcaattaaaaaactatccattaaaaatatatccgttaaaatttactcgtttcaaaatattttcgcgataaataacaccgttaaaattaagttagttggaaatatacccttaaaatacaaatgtaaagttagttggaaagatattcctaaaatataggatgatgagatatggatgatgtaatatgaatgatctgttggagttggaagggatatcttttttggatgatactccatatggacatttggaggaccaaatatagatgagcggctgaggatgctcttatgttctgaaggcggtggtctctgaatccggcagaagtatgcgcatgacgtcattagcagtctacttgtacaacccaagaacattgtcttgtcacttgtgcaacatcagatccttgagaagcaaagaagctcaccctcaacaaaataacctcaaatttcaagcaaatgccgcaaatttcacttcataatcaactcagtaatttccaatctgaagagtaattgacattgacagtgcaatcaatgacgggcctgttagcaacccatattgaatacagctctttgtttggtggagaacataagaagaagaaaagagagataagttctataagggttctagaactacagggggtggaggtagaagttgagtttgagaaggaattgacaagcaacccattgtagnnnnnnnnnnnnnnnnnnnnnnnnnnnnnnnnnnnnnnnnnnnnnnnnnnnnnnnnn

SEQ ID NO: 57307 - DNA, 2836 bp, Oryza sativa
  unsure (1)..(2836): unsure at all n locations
nnnnnnnnnnnnnnnnnnnnnnnnnnnnnnnnnnnnnnnnnnnnnnnnnnnnnnnnntcgatctaatctatgtttggaacacatgaatttctcgtagaatttatggaaactttcattttaaataatcctactggacataactaataagaaattttcaacgatctgatgatgccatcgtagtactaggcagagtagttatcattgataggtcacaggagtgctcaatatttcgactctaatatgttagactaccgttgacaagatgtagagatcaaccgaatgaagcagccattaaaaaaagggaatatgtaaagcgatttaaaagcctaggcttacactacaatggaaaaaaaaacatctctaaattcaactttcaagattcaaatttggtcgcggttaataaaccaacaaccagataatgagatccacagcaaaaccaagacaagttcgtcaaaggagtataagtttggattcactcaacatagagccttgcccttgctatggtatattgttgatgtgcaagtgagctgcacattctctcaacatctggcatagaaaccacctttgcgcaactacaaattgccactgcctttgtatccttcacctagctgaaaaggatatgaaaataataggttaatccccttccataagatgtttctagtccactccaactcggtttgcactaagaattacctggttttgacaccatacttcccttaactctgttcttcgcaagggatgcagaccatcttggcggatggggatatagactagttccaatagcttcatcttggattgtgcgaaagaaaagaagccaatccacatcttgactatcgaacgaacaaactggagtaccatttacagaagcaattccaagtggaaccaggcttttgtaagatgtttcttgagcaagatatttcaaaacctacacagttcaaacgatttttcagtcagtgatgaagaagggtataaaacaccttatgttttagtttagtagtggataaactgtcagtatatcacacatattaccaagctgtctagtcaatatcattcaaacttttcagaaaaaaattaacctgtgctgcccacttaggtaaggtcatcaagacttcaaaagtggaagctccagaagccacggacattgaagtcaacggctcagctgaagatggcccatcctcgctaaccgagacaacacgaactaactggcggctctcaataagttcttttttaatatgcttctccaaaagctacataatgccatgaaacaacatatgacattgcaaatatcaaactgaagactaaaaaatgctccataattacaaaaacaataccttatcatcaaaacaggtctgtggactgccagaaagaagcagtgacacatgggaagaactagatgttgtgatatcacaacatattgtaaccatcccgtccaacagagttgaatcaacatgaagaggaggagcagcgctgcaaagagaaatgttgtgagcagaaacaagctaaaaattttatagtaatcgtgcaagcaaccatgcataactgcaaataagaataagaagcataactttataaaagttaaaatatgattacaaaaggatacaggttaaatactctacggcactttagtttacattttacaagacacaccaataaaagcatttataatttatgttaccattaagttttgtctttagtctataggaaatgttacctcagttaacctttaaattatactagcagcaaaatacaagttagctcactgagacaacatcagtttgagctttaaatatttctgtggcatagaaaattatgatatgattactgaagcaaggacacaggcacaaacataacacacacatgagcaatagtatttaagatacaacaggttgtgagatattgaatatgtattatatagcagcggaagatacctgactctatcctggagtttgcaccatcgaaactgaaaaaaggagagaagaaaatcaaacattaacaaggccctaccaacaattttactacttgcataatttttcttgtccaatttaatagaaaaaaatggacagagaatatgaaaagtatgtgccatattatcttgttcctaaattcatggtacataaaatttacatacaatggtactagcaaaataccattgtattgcaaaaatcaacaaatatacaagttccaattttaaaatttgtatatatttcatgaaaaaacaaatacatttgcaatcctacatcaatcaaaaaataaatccacaaatcagaagatcctaccaaacaaaataggaggtggtgggaaggcacacccaccagtcaccaccaccactactaagtttttcgatgtgggtatgctgcatagtctaaaatgaatatttacaactcagaaagtgagactccaactaaactacatcgagcttcattccatcaccatacaagtatggactttagaacctagccccggcccaccagcttgtataaggtgcttagcaatactggccggtggccactagcatgttacttatgatgcagcagtatttctgatttgtaagttagcatcatgtacttcattactccaataacctagcacttctacaaaataggtctttggggtaatactctatttagaactcagcactaattaattagacatagaaaataaaaggcagcaacacatggtaactagaagaggatttgacacatacttcaatattgagaagagcattcaaaccatcctctagtgagttcaatagagatgaatcctgtaaaagagatggaagtacaatcattgatttggaataagaaaaatgccatattttagaagaaaaatataggca

SEQ ID NO: 57308 - DNA, 6019 bp, Oryza sativa
aaacgtaaataagaaacaagtaattgaaaatatcataaaagcagactaccgtcgattgaagagattgagcaatcttttctccacttggaacttccaaataaacctgtattatagcttaaaaggtaatatgagtagctacaaggaagaagaataaggaaaaattggaaaaaaaaaactttcactaaactaaacaggaaaataggcagagaggaaggttaaaaagaaatttaattgttagtagctacaagtcagacaaatatatctggaatatataaacaaggttacaagagttaaaaaaaacaaaaaccaaaatatgtaattttaaagggccaattagttaatctctaaattggcccttaaaacacaatcaacctcaataacaaagggagcctggatgcatgcatttatgaactattccctctgcataactatatcggccgtgtatttttctcgcattaaaccaagaaacccaatgagatagcctaaatgcccatatttatggctccataagagtattgatgcaattgttgcctggctctaatcccagctgcatgcatgcatgaattaatcgtattatcgatcactcaattaaaagatcaataccgtatgctaagagcagtgataactacattagcaagcactctagcacccaaattatacaaattggcaaacttcatcagcaaacactaataactaaaatggatcagtaaaccaaacatgtaaagaagcatattggctatatagactgcagcgctaaaagaagcatagtccaggtgctattgggagctgaagcaccaagcagccaaacatcagtgctctaaaaatcggtgctaggcgcctattagccgcctgggattaggcattacattgtgtactagacggctagccatccttaggtgctcttgtgcgatctaatttagtgttgtactgtctaatttttatgtaatatgcttgctaatttcctaggcgccagccctgcagacactctagggctattgtattgtctaacatttgctagtttaagttagacatgataaaatgtatagtacatagaaaatcagcagagtttagtgcatacaatggtaggaaaaggcggacgaatgagtgaactaagtatctgtggatcagatacatcagcatcgcgccagacaagtgtaccaatttcttcttcgttgtcaagctgctgaccccggaggtacatgaagcggggttgcaaagcacgttgtgcctccagaaattcatcaactgtagggttaatcagcgtgtgcacctgcatgcccagctttccaagttcagaactgacaaacaaaatatatgtacttaagagcaagtttaatagtagatctaactactagatataagctaatcaaaaagtagcattagggctcacatgtgtaacagattagttataaggttgtctctaattttcttctctctctttttctcatttatataattaatgcatttatcgtagacaggggtggagctatcaaaaatatcattgaggtcactcttcacataccatggtgcaaatgccaattctaagagtaatttattagttccaagcatatttaataatataattagcaaaaataattggtgtcatcagtaaccatacactggatccgcccctgatcttagagcatgtgtatagctaactttttatacacaagagcttaacactttttattctccaggttatctctcctccacataggtttatactagatggattatagcctacaattaaacttgctccttaacaaaaataaacagcaaaaggatacttacctccaacctcccggacgagatcaactccgggaatgggtacgatggccgctgctgctgggacccaggcaccggacaaggtggcgcccgctgcttgcctaccttcccacacagcactgcaagcaccgtgcacttcacccttgagccgctagggaaatgaggcatggttgaaaacctgcaagggtttgcacccatagcaacagcagatcgatcagacctccacaatagttctccacccgaaaccaacaaggaacacaaaaggaaccgagcaaatcaaacgaataccccagatcggatcgagcagcgaaaatgggatcgagcagagaaaatcggatcgagcggatctaagctaacaggagaccaaaaccgactgccacaactcggaatcgggactcctgagccgctaggacgccggtggaagcgctcgatccatttggtggtggcggcggcggaggtaagaggaaagggtggagctgggatatgggggcgagaatgcaacggaaccctaggtttcctctcggtctcggatcatttaatagagccaaaaatgaaggggaaaacgccgattaatccccagaagcgaagcaaaaaaggcaaaatcgtaacggcaaaaaaaaaaaaaatcgattggccgggagggacgaaccgctcgaggcactggagatcgaacgatgcacggaaacgtgattttccccaattcctcacatttgctacggctgctgctggcctgctgatgctgatgctgatgacgacgacgatgattcatagcttgcggagagaaaaacaaaaaacatgtcggattaaattagctttctcgcagcaggatttggaaggagaattggagagaaaaattaaaaccgaatttgttctgtgcttttctgggcgcatacctcgatcagctttgattatctgctgctgcggctgctactgcttttgggttttttcggccgcatccatttcgatcggatcggatgcgtcgcaggcccgggtgttgttgtgtttggctcatggcattggctccggaggagggattttgggaggaatcgggatcgcacggcaggtctccgggcgggagacgtgcgagcggaggcgccatgttggattgcttcgaggggtgatggtgcgtccagtactccagttcctgcatgttcgtccggctcttgatatttcgatgacaagagtgcgaatgaacaaatgcgagcggaagggagatggggatggttgatgcgcgggcggtcgcgcaccagctcgatcagtttccccctctagtcttttccctctctctctataagtatattgatacgtatatacacgtacacatacaaactttatacttcctccgtttcacaatgtaagtcattctagcatttcccacttcatattaatatgtttagattcattaacatcaatatgaatatgtgaaatgctagaatgacttgtattatgaaacaaaggaagtattttactagaaaagatactagtgcgttgcaacaggtgaagattattttaatcttgttattgtcatacagtttaattgctgtgaaatttattgtagaaattcgcctggatatatatatatatatatatatatatatatatatatattaaaaaaagcgaacttatttccaaaagcgaacttaaaaacggactcatacacggatgatgtactaaagtaccggtaaaaacatcttcaatttttataatagtagagatgtgtgtatagataaaataaaccgaaagatacttatatatttaaaaactgaaataactgaaacaaaaccgaaagaaaactgaaaaaagaaaaggaaaaatcgactcttcccacgcgctccatgagagagaatctgacttagaccctgtttctttccgcttaagattattataatctagattattgagttagattactataagctagattgttataatctgtagtagaatacccggttagttgtttctttcctagattatttgggtttgcaagtctaaagagggagtggggtgacatggtgggtaatttttcacccaataatctagaaaaagctcacctaaatgagtttatcatattataataagctgggctccagattataataagctacttcaataagttgtctgtttctttcagcttactcccaataatctggattataataatcccaagctgaaagaaacagggccttatatgcgagggccgactaaatagcttttttctttaacttattttgaaactagtatggtgactcatcgttataatttttctcacataatagcatttttttcatattttatttttaaaatatattaaaatggtaataggattttaaattactagcaacatgtatgtgcgttgcaacggatgaaactaatattaatataaacaacaaataaatactaaaattaaaatttaagtgtcacaacataacgttacggaagaatttaattttttggctaaatttcttattggccacatttggacaaaaaaaaatcaaagtgcaaaaatattcctaaatggtaactccgttgggccaagaaaataaaggaaataattcctgcgagcctgacctgaaggcctacgaacattttaattggtcgatcacggttgacagggggagcaggttggtttttctttggagttcatgtctagggttttccctgcgaaattttttatatttttttagatatttttatgttttaattttattaatagaccattctaaaaaatatttttaaatctggaccttttggcccgcacgtggccaaataactctgtcacgccgcgtgcagcgggcatgacaattttatcctaccacgccagcgagagcggcatggccagataacactgtcaagccaacgacgccggcgtggccaaataacgctatcactccagcgggagcggcatgtcacgcccagaaattcactagtaatttccaaacttatttgtgcattaaatcctcatccagaaatcagccgaggtacacaaactgacaatttaatatacagattcatcaagttaactaaaacgataaatacttacataagaggcacttagtcctcaccacgaagaaaactgcagcggaaaataaaatctagcgaagctccggctccactcccacaggcagctcaactagggtataagccaaacatcttctccttcgtaacttttcttcaactgaggtttgattgattattacaaggtgagtacatggaatactccgcaagccacacagcaaatatgcaagtgcacaaggataccaaaggatgacataatatagggctcatttgcaaaagcagcatttagcaaacatttaagaattgtaaaacagtagagtaattaatcatcaatattaatcaacactgaacagcacacccatgctgcacaggcccaaccatcctgaacaaccatacccggctgtacagatctatctccaaaccaggaataaaccattcaaaaccaggagctaatcaaattattaccagttatagcatcatttattatgatgaaaagtgtgagactaatcacgaaagacattgttagacctgcctataaccgcgggcacggctattcgaatagttttactctggccagaggtgtaccactgtacccacaagacacgattccacacatgttaccatgccctgaagtaccaccacgccactgcaaagggggaaatcgtgacagtacccttcgcacaacacaactcaaagcagtgcaccgttcctggatcataatcacccccttataaacacaaggcatggactccccagcgacccccgtgggcttatctccgccacttctcagtctggtgccccgcaatgaaccatgctatacaaaagataaagttgttgcccatactggcttgtggtttgcacggttaatgtttcacaaccgaaactcgtgaaccagtccttaattgtcatgagcacgaccagcaaaaccatgtgctcacaacccacatttatcaagttttagttggcaaattaattaattaaccaatcatgattagccatcgtgagctaccattatcatgtccatcattaagtagtagtgaaacattagttatcccaatagtgtgctaatgtttctaagcatggctaagcaattatatctaatatatctagctgaaccaatatataaagctcaactagtcaaattgtaacccaaggtatcaaaggacagagtaatcaatacaaagtggccataacaaaggtatagtttcacaccaaccgg

SEQ ID NO: 57309 - DNA, 10538 bp, Oryza sativa
atgaactcgtggcgtggcaaagttatttggccacgctaggcgggatgccatggccaaaaggttcagatcctaaaaatatgttttgggaaggtctatttttaaaattaaaaaaataaaaaggttcaaaaaataaaaaaaaagttcccagtttggctggccggttcagatctgggaaataaattttggatgggtttatttttaaaattaaaaattaaaaaggttcataaaataaaaaaaattctttcgctgccgagccaagggtggcgctcccatcgtattgttgtttgtcgttgccaccacaaggtgagaaaaaggatgcagccaggtttttttcctggacgtgatctttggttcctgtgagccaacctatctgatcgtgttctcgaggttcacaggcaggaagatccattggattggtttgatttgcaatttctgtaactttacctatcagtcttaccaagtataatatataaattagctctgtgttgctgtttggaaatattcagagagtttttattgtgttggtagctattggtaccgtgaaagagagggataaatcagggcgcttgctgtagagtgctcatcagagattcacattcgcggagttctctaagggttcaagttagggatattagtggtcacttcaaatctagagaagcttatagggatgttgagttgaaaatagggcacctcttcctagggctttgttcggtgaggttaggggtaatcgagacccagctcgttagaggtccccaatggagagtaggattcatatgatcccatgtctcccctcttatgcaaatcaatgtatttcgtgtgatttcctgctttgtggtgctaatatgtgtcctctgtgaggttggcaagtgttggggttccttgagaatcaaaaatttgtctcgtgaggcaagaactccagaagttttggaaaagaaccactgaagtaccgggcagacctctctgtcttcggttgatagctgccgaaaaatttctgtcccccccctcttctaggctacaccttggatttcaggtgcagcttctgtacataagattataagtattatggatggcaatgcaggaaacaatcaaatttttaggctgaagaagatactccgaagactgcttttagatgttctggagcaattggcttatacgagtgggttgttatgactttttgggttaagactgctggtgctacatatcaaagatctatgaattatatattcatgatctcatcggcttgttgggtgaatctatatagatgatgtgattgtgacgtctaaaagtgttgatggacacttagctgatttatgaagggtgttagataggacaaggaattctaaaaataactccatttatacggctcttaatccaattttcgctagcgaaggctaaagaggaccacatggaaaaaaaccgccctatatatcaaatagctccgcaccatctcaactttccccacatcccaacttcacgactccttctcttctctcaagccgctcctccctcctcctctcaccatacatcttcacctgtggagcgacagcgatggcgacgagggcaatgggaggcagatctgatggtggtatgggaggaggctggtcgcggtggcgcaataaagagtgtggcggcggtgaccctcccactcccctctcccatatccagcctccaggtgcgtgctctcgacaatagcggctccctccagcctcaacatgctctcggcaacggcgtccgtggtggcgatgggggtcaaatctggtggcaggatgaccggagaccgttgacggtggaagtagtagaagtggcactgacggtgacttccccactcccctcccatcctatccctatcctagatctgaccatagggaggcggccgccggtggcggtagctcgtccacggcggcttcagcagcctccaaggtcatcgttgatgacaatgagtagtgttgatgtttgcatgtttaaaatgcagtgagaaatcaatgtagtgatcttggatgtcaatttgaatatggattggatttgaatctagctttctagacgtggatttaaaatttgaaaatgcaacaatgtctctagatgttgatttttttttcccaaaaggatatcgctggcggtcctcttaattagttgtgtctcctgcgaaaattgattttgcaggcgatcttcttaagtgtctgcaagcaaaattctattatcgcaagtggatttaaattttcatgggtgatcatattaagtggtcgtaagcaaaaatctattatcgcaaccatgaacaaaaatctattgccggctagtagtaccgccagcgaaaatcggtttaggccaccatgaagaacactcttttaagtagtgattaggagtttgtattaaggaagctcttcgagtcatgcatcgagagaattttagtcccgtgaaatttcctcctcactcgtatcgtaaaacttcctccctaatttcatggagtcatcaactgcgttaggggatcgagcagaatcaaaaactgatcgagatcgatattatcttcgtagaccaaatcacagtaccgcacgttacgacgtccagggaccgcgtcagttggcgacggcgacgtgacggagtcgactctatcgtcaccgaattgatcgatggtggccttccggaggatccggatctcctactccgacccggacgccaccgactccgactccgactcggactccgccgacgccggcgaccacgatatcagcagccgaagcagcaggaccaacgccgccgcacgccggaaggtgatcgtcatctcgctgtccaggaagaagggaagatcgttatcgcagtccggtcgtcattatcgtcgtcgtcgttccgaaattccggcggccgcggcgaaggcggtggaggcggaagattggccgtcgtcgagcgacgggatgcgtcgtggcgccgtagcggcggcgaggtcggcgtcggcggccgccaagaagggttcccgcggcggcgtgtaccagcgccagcccgggcggtgggcggtggacttccgggacagccagctcaaggtccggcaatggctcggcacgttcccctcagaggaggaggccagggccgcctacgacgctttcgaggtgcaggtaccgcgcctccctgtcccgcggcggcgccggcgcctcctcccccgccgtcgccatcgcgccgtcacctgcccgcgtcaagatccaactaccggcgccgcggcgtgcatctggccgccggaagaagacgcagacgacggcgacggtgacgacaacgacgacgacggaatcattatcgcaagtgacggcctcatcagcgtccccgtcgtccaaggaggcgccgccgccgtcgtcgtcagcttctgccgcgacgccgccgccgctgaatccgccgccgttcgtcgtcgatacattcctgggggaggatgaccacctcgccgccgacgaggatgaccgcttcggcttcggcctcgccgatcttgggcacctcccgctgccgttcttggatgacaacgacatggacttcaagctcagcgacagcgacgatctctccttcctcttcgatatcggcttcatgtgacgtacgtgacaaacccaacaccaacacgtacgtacacttttgttgtgatcgatcgattcttcatcgatagatcgatctctgcatgccaatccatgcatgatcgagttacatattacattaattgtaaatcaaccaggtaattcttccatttacctacaatcaactgtaaactgtgtaacatattattcatctcaatcagtagtagtaataattaattctgcagtaattggaatcatcctctgctgaattatattatctatggctgagttgacgacgacgacgcgagctgtgacgacatataagctagaaggagccggggcactcgaaggtgacgtggcagccgtcgacgggagtgagccggacgacgtgccggacggcggtcatgaacgccgggagccgcgccgccgcctggcagacgcacgagttgtccagcgacatgaggcgccggcagcacgccgtgtcgtgggggtcctccctgctctcgtcgtcgtcgtccacgttgcgccggtgccggtggcgccgccgccgcccacgcccctccttgtcgccgccgcctcctccctgctcctcgccgtcggcgtcgtagtagtagtcgccgtcgtcgtcatactcgtcgccgccgccgccaccgccgccccgagactggagcccgtgcctgcggctcccgccgccggtgaccgacgtctcgttgagcttgagcgggcgcggcggcacgagcggcggcctcatgacccccggcaaggtgcgcatgctgcacgcctcgttggcgaggttgaactgcgaccggcacaacacctgggcgctcgccgtcacggcgagcagcggaagcagaagcagcgccattgttagtgctgatctctccatgcttgctttgttcttgtcttcttgtctttgctgatgatccagtgagctaccagtcatcatatcaagcggcttaaatagccacggatcctactaaactgtctcgtgatttaatttcaagatgcatggaaaatggggtcaaggagaatcagtgttttttagtgtgattttcaagatggattcgaggagaatcagtgttgttttgtggatcgcaaatgcttgttggtagaagttaggaggagaggaagttttcctatgacattagattgaaatttcccatgcttttctttggctgtaatgacgttttgaagaagatttaattccatcttggaaacaagaacacgaaggctagtttcgaatgatattcagctttcaaggatggaagataagcattgctcgacacgtgaattatgtaatcaattgatcaatataatagttagtagtttagtaccaggttagtttgccttgctgctgcataatgtatctttggaggtcaaaagtaggtagattcagagacttaatttaattttggcgtggattaacaccaaatcaagtaattgtaaattcgctatggttccatttttcaagcatttttcagagtaggcatacaaagaatatgggaacattttcatttcccaagacaattttacaatggtgacaggagaaattttgtcgtgtggcaccatacatctcaattatgaagcttattttctagttagctttagcaagttatagatttttttcaccaaattgccatgaaacgcacgacaacacatattaaaaaaaactaacatttgggcaaaatacttcacataatatcaccactacagaaatgatttttctgaacgagatcctcgttagattgcagacagaccataacaacccgcacctgtaaaaatcgagcaggcatttccgcatacgactccttaataggcccgcaaaaattcatttttgtatgcgggtctctttaggggccgtatgctcattttgcatgtggacccttaagaggtccgcataagaaaatcatttttgaatgcgggtctcgtaagggtctgctaagtctgatttgtctcatcttccctctccactacttcaaaaaaaaatttcacaagcagccttatcttctcttctcggtcctctctctctccaccacttctcctcttctcctcttccctctccaccacttcaaaaaattttcacaggcaaccttatcttctcttctcggtcctctctctctctccaccacttctcttcttatcctcttccctctccaccacttctcagtcctctctctataacctcctcctctcctctctctctctctctcggcagccgacggtgggcttggcgcccgcacgaccggtggcggcagctactaacgacggacgggcggtggttgggcgggtgacagtgacagcactacggagggttggtgatgacggatccaccgcccttgaccttgggcgggggcgatggggcgggtgacagcaggcgcgatggcgagcggcggcaaaggcgagaggagcacgatggcgggtggattggcgcgtcgacaggcagacgagcggcagcgacggccgtcctccgcccggatccagtggcagcgacaaaagacgcgcgacagcaggcgagtgggtgtgtcggtgggtggtagcgaagggcgacagcgcatgacgacaaggactcgaggtgacggcggtgggcggccggagcgggcgtccggcacgtggtgggatggctagagttttttttttttttttgccaaaaaatattccgcatgtagttggcttaaggtttcgtatgcgaaaattacctttttgcatgcatatgcgctaaccacatagaaaatagggattttcgcagacattttctcgcatgcgggccagacaaccgcataagaaaatcgattttgtctatttggaaaatcattttttagtagtgtgtacaaagttattcttttatttttctttccagatgattttgtgaaaacagaattaattaatttctcaaacagaagacaacgaaactgagagctgcaaaattacccgtacacccatgggcgagtaaggagtctggcatgcgcgcgaattgtctcgggtatatgtcgtgggcggaagaacctaaccgcaaccactcaaggcgcgtccttgaggaggccgaacttgtaggagtcacggtcgagcgggttgtggaggaagagatcggcgtgcgggtactgcggcgctagcacattccacgcaatagacggtccggtgagctcgaaccgctgtgccgctccgacgaggcagaccgctatccgcccctccacgacatttgtgccacctgctgcagctgctagcttcctgtggtctaacttgggcggtttctcgttgattttgaccaagggaggaggagaggaggatgaggaagaagaaggccgcggccaagaggagggtgatggtgagaccatggtgatcccccttgtgcaccactagctggccatggttggaacttggaatggcaaaaggctagctagcttgattaatttgcttatgttgacgacgataacagtgttgacctgtgtatattaatttatatgctgttgtattgctatttaattagataaaattactaagtaacactactggagaaacgatcttcgatcggtcggccaaattttacaatagtctcggttctcttataaaccaggactaaacgtcattatttagtcctggtttttaaggacaacaggactatatgatctttagtgtcggttcgccggttgctagagggtgtcaggccggatctttagtccactaaagatgcttataagctgcatgttggcgagagagcgtgcatgtggtggttcgatcagagctaacccttgtgcaatcatgtacgtgttcatcgtgcttattttcatcgttccatgcgtgcaacgcgttactcgtgcttaatttctattataaatttagactaatctagatttggtcggtggatattagttttcactagaaaaaatacctgtatgttgcgatgggtaaaaatatttttagattctttagttttggaccaaaagctccctatacattttactctttgctttttgaacaaaagcttattccctttttttttcttttcagtttcagcctagaccgccacctcctttgcttagactgcttctctttgacctaacccacaagtagagctgtagctccagctcgtatagctgactgtcgtcttcaacctctggaaaatggtgaaaacatctcatgttcatataatgccagaactgatcctccccatcaaatccggtcaaatatttctagattttccaaaattggttgatggcttttatacaatcgatctgctctttcctttttatcaaaatcgaagcgaatccgcaaaaatcgggataaaaacattgacttttaaataaagactaaatccggtgaattaaaacagaattgaaaggtaaaaatgggaaaaatgataaaggagtaacggggaatcgatttttgcaattaattgaaaaataaggtgacgaaaaaaaagagtaaaaaagcagctgatgaagaaaaactgaaaaaaaggaaaaaaaaggaaaaagaaggcgaaagagaaggacagaaaaaaaagaggaaaaaccggcgaaaaaagatggacggaagaaaacggaaaaaatggaaaaggaaaaaggaaaggaaaaaagggtgaaaaagaaaaaaaaagagacggtcggatggaagaaaacggaaaaaagggaaaagaaaaaaagaaaggaaaacggcgaaaaagacaaaaatgggaagacggagaaaattttttagctgaagccttacgtatttctgggcgtggctgatgggcgatcgctcgccccatcccctatatattcctctcccccttcctcctccccttcttctcttcctactacaccataaatttaaaaaaaaataaaaaaaattagaaaaatttatgtatagaaatactatatataaaaaatatttgaattcaaattcaaatttgaaatggaaaaatatttgaattcaaatttaaatttgaaacgggtatataaactttttacttataaattttgggcctataaactaatatttgaatttaagttcaaatttgaatcgggtatgtaaacttttgacttataaactttgggtctatagactagatgtacagaaatactatatataaaaaatatttgaatttaaattcaaatttgaatcggatataattcaaactccaatttgaatcggatataattcaaattcaaatttgaatcgggtatgtaaacttttgacttataaactttgagtctataaactttaggtgtataaactttagatgtatagaaatactttatataaaaaatatttgaattcaaatttaattttttttgtggagataattcaaatttaaatttgaatcggatatataaacttttgatttataaactttgggtctgtaaactttagatgtgtaaacttgaggtgtacaaacttcaggtgtataaatttactaaaataggaaagtaatgcggtgcaaaaaaaaaaagaaaccacgtgaaggagatggggggcaacccgatcgctagggccgatcgatccccatcaggagtttcgcgtatttcttaattaggtactagcaaaagtgtccgtgcattgcaacggaaagaaaaaacgagaaaatttaattaaaacatattaaattctaatttgatgaaatatcgcagccatcgtttcactaacaaaaagtaatttgtgaataaaacttttatatacgtgttcttagcgatcaataaaaaaaatctcaaaatcagctccaaatttaaaattgaaaattcaaattttggttgataagaaaaaagcacaagtgaaaagatgaggccctatgactgtaagctttttaaccattatttctatatttgctgaaactgaattctaccctattatttaccaattgatttttacatccttatttctcattgatcggtcaggattgtcccaatccaacgcccgacgacgctcccacctccctcacccccttcctctctccgccctcccagagacccggactcatcctctctctcgcgttcatccaaaaaatcatgctgccccaccctcacaccaactgcacagcgacgcctcctcgcaacccctccgcccacgcatcgcgccgccgtcgatttctgcctcgagagcatcgttgcacgccgcgtgtcaccagatcggcgtcacagtcgccgacatcgatctcgctccactatcggagtcacaaacatcggcaatcaacccgaggctcagcggagtcggcgatttcgctgcttgcagtaccctgatgcaccagtgcaccactagccaccaatccaccagaggctctcttcatctcttttatgctaaatgcaacatttgtgtgctaccttgaaaacagtagtaactaattatgctaaatgcatcattatagaaataatgattttttattatactggtagggattgccgatactttccacgagtaattcttttcgctttttcttccgttctatttggtgtttttcagggttttcttacctgtcaggaatgtcaacaagccacggtgcccaggcatatatgcacatgcataaccaggtgagaccaaggaagctataacctacattagggattttctttttttgcaattatacacttcttattatgccaaacatttatcaaactatcgcaaattgtatatttggtatcattggttgttttccgtttatatgacacattgtaaacggagagatatgtggcatattaaacttcacatttatatggtctgtttaatatgcacagtgggaaaacataataaattgagataatccattgtatgccactgagtttgtcataggtctacaatttgccactgattttgtcacgttctataatatgccatcgatttttgcttaacttctacgatttaccaccgccatccggttagtctccgttagtactgtacactttcatccaaatgaccaaaatacccctgagacaaaaactttcaaattttggataaaaattctgaaatgtcagactttaagtttttggacaaattttgaatgtttacaatcttatgtttataatatgg

SEQ ID NO: 57310 - DNA, 2645 bp, Oryza sativa
tgatgaatcacacgaagaaagctagtaagcagcagtacaagatatttaataatttgatccttcccaagtcgggctcccattatttaatatatcttagcccgcttatggtcccatatatctgtttacatctaaatttggcacctaaaaataaaataggaaaaattgtcaaagtttgaaagtccgccggttttcttctaagagggttggtctgaccgccgtatgtcggccggtcagaccgctgctagtagactagtcagaccgacagtgtgtagtcagtcttaccggtagaatccgagtccagttctgtttttgtcgggactcgagtttccttgctcggaaagacatattttgggtttccattggtttttagcccgagttggacgtggaggagagcctgtagagggcaagaccaacccctatataagagacaagtccggttcattgtaaaaagacaatcaaccatcaatcaatcgaatcgttcttttacttttgcttctaattctagtttagtttgtccatctttgttgatttgcgctgtaaatcatccgccgtcgctgcgagagtgcgacacatctttgtaggtttatcctgaaaaccttccgttttgcccacgagacgggtagttatctatcgttctatctagatcggctccggtagccagtttagtttatcaaaacccatcttgatttagcttttgctagattgaggtggttggcgactctaggatcaccgcaaagctttaggtgctgtgatcgtgcttatcaaattgtcaaaaaagttaccaacaatatcatcctcacacgtgttagttaaagtaaattggaaactaaaaagtgtccaattattgaatttctccgtgtttcacatagctcgaacaaacaaaaaatatctacaatgattacttttttaatatataacgccattgaatttttaagatacgtctaatcattcatcttattaaaaaaatataattattatttattttaatgtgatttgattatcatcaaatgttcttgaagcataacttaaatatttttatatttacacaaacattttgaataagataaatgtttaaatgtttgtaaaaaagtcaccgacgccatatattaaaaaacgggggtagtataaggggtgttccgtactactgtggttaccggacccgggtaatttttaatacttggatgttttagcttatattaactatattgtattagttaaaaattaaagtattatatgtgttatgacaggttaaggaccctggataatttccgttctaggtttgccactgtgtagtactccctccgtcctaaaatataagaagttttggttggatagaacacatcctagtatgataaatctagactgacaatctatctaaatctgccatgtgtcccatcgattcaaaactatttatattttaggatggagagagagagagcatgtagtgagaggataggagatcatgaaggatatcacaagatcatgccgctagacaccgtagacctgtgctgggccttgcccatggatgggcctactctacaatccggcccactcgagccagccctattagtctgcctgggttgcacgagcctaggctgggtggtaagggcttttacatgtttggaggtgtgctaggccggactgcctcgttctagagtggtggaaattgatgagttcacataactgaaaaggtaagttcctctaaaaaaagtaaaaaaatagactgaagagttggtcatgcattgtttgattaattaatattattttctctggttcttactctctctgctttatattagaagacgctttaaaaaaattttagtcaaacttttttttacgttctactaaatttatatttaaaacatagcaatattttcaatataaagcaagcgcactattaaaatatatttaatgttagatttaataaactaatttagaattttagatgttgctaaaattttctataaacttaaataaatttaaaggtttgacaatgagaaaaattaaagtgttttataagtgaaaaggagggagtacaacttagtggtgtaataatttaaatggcaaccatatttaacatcctcaaattttaaactaaaatttgactgcatcatgctggcttttgattaaatttgtttggtttaaaaatctatttgattcttaaattggttcaagtatttatttcttagagccctactaatttaccctaataattccctttattccaaaccctagtgaatttgagcaaattctctcaaatttcaaaccatagattattttcttagttcatcgaagatttgctatacttcaaaccctagtgaaactctttcaaattcatagattaaattcattctttttataggaaatattcaaaaattctgaaattcactgttcatcgcacacaaggtgctcgatgaaatgtctagcccaactagagcagcccaactcctacccaatcttgtgcaaagtctagatttggtcctaggggaccacaacccactcaaaacccgggctttctttgcctcatcctccccttcacgcgcaccgcccgagcattcgacttagccacgcgccgtgtcgccgcgcgtcggcctcagggccgcttgcgcgtgcctgaccgcctttgcgcaccgtcgcccgtccga

SEQ ID NO: 57311 - DNA, 7763 bp, Oryza sativa
  unsure (1)..(7763): unsure at all n locations
ccccatcaaccaccatccctcgtcggtcgaacaccttgtgcgcgatcgactccacccctctccatccatcctccgccctaaatatcccttagaacaccttatatcaaccatgttctagcatagtaagccctaaccgaagctctgcgtcgagttttacctcgccgcaccaacccgagcaccgccgcccccgcgctgctctgttcttcaccgccgcgaagtttttctggccgcaatccgtcgtttcaaccgatctcggtgagtttttccgtttcaaccatctacatactacctagattccattttagcaatccctttgcactaccatgctcccctctaagctgccgatgtgagcacggccgccgcctatggaggcgctcgtcggcaactattctccgcaccttgccaaaggtcggcaagctgccggaatccctctagacacctcgtagatgctctagaaccccctcccctagccatgtctaactcatatcaccttgatcaccattacagcctaaccgtaccaccgccgccctagtcgccaacccatccacataccaaattagctcctccgccgccgatcgccgtcgccggagatacctagctccctcccctcttcggccgcaaccactttccccctccatcgccgccgtaatcccaaaccctagcaccgccggctgcatttggggaaacggccgaaggtagaagaagagaagagagagagagagagagactgacaggtgggacccgcacacagtgccatttcacttttatttgatttttaaactttagaagctcatatcttttaaaatatagatccaattccaatgaaacttggaccaatattcttctaaaatcattctctatcttttgagcccctttttgctatttttgcattttattttattttctctatttttcatatttttggatttcatttgaattccttttaaatttgaattttacatatgtctaaccctaggtcttgaggattcttctgactcaatagataatatccatcaatctcaggacatcgagcaaggcaagttaccatataccttttgatcattcaagcctatattttataaattatttacttatagccttctattcaatattctattttctatgcataaatcaatcatagaaacccagataatttagtattgcttattttgcttacaatctggttaaaataccctatacttagattgggacagtacgtaagatttggctgatttccgggtggctagtactgtctcaatcaatataagttttaccagatacttatgttgaacgaacgagtacgaccgcagtttctagaatagggacagacctagttattatgttaattagcaatatggcacctctgtatagtggttcttatttttaagtcctcgtgcaggaggcaactatagccgcgaagggaaactttaaccattaccatgtacaggtaaatggtttgtgatactcgagtataaactatatggtatatttctaaaccctgatcgagatgacgtggtgtcatacgatcagttccccttaaataccttgggaacgccagaactcctcttgctgctgttaacattacattcagagcatatgaggatatgagttcatggaacaggtgccacaattgttaatgacttaatactggaccatgactaaagccgatgattatcagcaagtcatggactgcgggtaaagcgtacatctgctacagtagaatatctttgaaactattcgaatagccgtactcatggagttgagtactgggactcatatggtaccctggttagaaatctaaagtttatatgttttataaattcttgctataacttttccagattgtctagtactgctttttgcaaagaaccctattatatgtcaatgcataacatattcccatgataacttgctgagtattgtaaatactcacccttgctcttataacccctttttcagatctgggtcaagaggaggacccttatgactattactacgaacatcccgataacttagagaatccctaaaggttatacctcactagtcagaatgtatagaaacttctgttgtgtattaattagttaggtgagtacctattattgtaaaacccttagtattgtaagactttttaacatatgcaatgaagaaccggttatattgtatgtatcaatatttactgatccagggattgattcattaatctcagtcggattcaagttattagttttgggctccgacaccatatgtgcctttttcctctataattattccatcgcaacacagggcttctcaggtctcagctacactggtggagaaactgtttgtagtctcggttggtaaccccctttagtcccggttgtccaaccgggactacgaatccgggactaaagataactatctttagtcccaggtgaaataaccgggactaaagatcgatatttattcccggttcgtgttaccaaccgggactaaagattgatcagccacgtggccggccaaaccatctttagtcccggtttgtgttaccaaccaggactaaagatcggtgcaccatttttttttatttgcaaggccctgtttgctgcatggttgattatatatatatatacatatatatgcataatatataggcatatatatatatatacatatgttacaatacatatatatgcataatatataggcgtatatatatatatatatatatatatatatatatatgtgtgtgtgtgtgtgtgtgtgtgtgtgtgtgtatgtataatcataatattacacagacatatgaataatttaaagcacttaacattttatgtgcatatatatatgtcaccaaaatatatattaacacaaaagtaaatgtgtacatatataaatatatatatacatgcatatatagtacaattcatttgctcggtagctatagctacgactttgacgccggtgttatgtcagaagaggaaggaccgacgttatgaattgtcgatccgtcgtagtagaattcaccgtcgagattaaggacttcttcgttgatgaatcccatcagttgttcttgaacagccgtgataaaatccttgtgtgggagattatccctcatgtgaatacgctatcgttcgaaaaataatgacgtatgaatatatgaaattaataaacaacttaacaaatcgatacgcaatgaaattttgaatggtttatgtatacgtacatcgagctctcgtgttgtgcatatttggtttgataggcagtgggcatactcgcatacgtagtagccgcataagttagttccctggtcctgctttgcacactacatgagaaacgatgagagatttaatatactctttatattaactgtaattagagattcaatccaatataattttggatcatgcatgtactcactggaaaatcaaacctccgtccaagtttttctttccaagtcccgcggaccaattgacggaaccgatcccaagccctacatatgcagttgcaagctatgattaattaattattacttgagatcaacataatagcaatagattccccgcgactttggaatagatggcattatattacctgtctatcagtttgaagaccttatcaaaaatcttctcctctttattcattgagtcgtacacagtgactctgcatgcgtccaagtcgaagaataacaggacccagtggaatctggaatatgcgtgagaagagatatatatgatcaaaaatgtacatgctatatgtatgggaacaaaatttgttcgaacgacaataaaaactcactctgtgttgtacggcagtagtatgtacgtcttgaaatgttgctgcgttaggagatggacgagattgtcctctgtgtctttctcgtacttgtcgatcatttcggtgttgattttccgagggtcgatgaacccagtatcgtagacccccgccgtcgggccctttgaatctccattctacaacgatgaaaggaaagtattattgcttacatatatgccaggagctaattattgaacgaaacaaatcgaactcaaagatactcacaaaatccatgcgctcagaagagagacgtcgagggcgtccaactggtacagatcgaagagatccttgaaatggatccagagaacatcttctccttgcaagaagtcggggtttctgatcctcgctccgaacatctctctacccttggcactcatttccatgtaccattcatggaatttgtacatctgtgtcggtagggactgcagctgtttagttttgacaagcggtttaccgagttcaaacttgtatgccacttccgccttcgggattggtgctcctccaaccaactgatccacagttagaccggtgtctgaaatgaattccgttatgccaaaatcttcgccggtcaccaacggctcgacctcttggtttggttgttctccaagctgagggactggtttggacttcttgtgataggctctctgaagtgttcggtcatagtccgatatctgtaacgcctccttgtttgttgtggacattcccttgaagaagttcttcacgctcgggtcaataggtatcttcttttcaggactccaaggcttgagttgcctcttcacctctcctgccacataagcatcaagctcctcttgactgcaatcgtacggtggctccttgtctttggtggcgtcaactttcgccttctttgttgcccttgtgcgggcaagcagtggagcttggcgagaccttgtcttgggaggtgcaggcgaacacggtggaggcggaggagctacaggagccggaggagatggtgcaccagtgaggtggcggaggaaccggaagagatggtgcacgagacgccgcttgtcgcccaggaaggatgatgtactgcttgcgccatagtatgatggcgtggcttgtgtctcgtagatgcgtctcaccgtctcctcctgggtagtccaactcgaggtcctcgtacgcggcttccaccaactcaacttcgacactcgagtatcctgctagaatcggcctgtagtggtaagtcccggaagggtccgttgggatggccattcctgacgccaccttcacgtgatgagaggttatctattagtaatcaacctaagcagcaacttgcggaatgtacaagtcaaaaatcatcaaactatgagcataccttgattgataagttcttgaagggaatatgcagctcacatggtgtccgctgcgtgatctcatcaacggggcaggtggtttcgtcctgggtttgcatggcgtccatgctctgtgatccgacctgccccgttgagacgcagctgctacgattgcctgatgggctgaccattgcaggatgaatgtacggctggggatcctgggaccgatgtgcggccatacgttcatccaccttccttgccaccttctcttgcatgctgagctcgtagctcgataccctgtactcaagatctgcaatcttcgcctcggtatctctcttgctcctcatccgactcctgtacgtgtggatgtcctccttaaatccaatcttccagggaatcacacatttccctcgtgttcgtcctggatgctcgggagtctgtagggcgagtaacagctcatccttctctctgtctggtcggaatgtgccctgacaagaggctaccactgcgtccgttagtcgactggcggcctcgtgtatctgatcgctaaagacaagggagccatcaactagattaagcgttccaccgtgagcatagtaccagaacttcgatcgatccggccatttagtggtggccggttcgatacccctctcaatcaaacttgcctccatctcctcccacttcggcattgcgacgctatatccgcctgaccccaagtggtgatggtacttcttcttggcggcattttctttgtttctggccatcatcgcttgcccttgtcgccctgtcttgtaagcaacaaactcatcccaatgatcccttagctttgggaatacgtcgaagttcggtgttagtcccttcaggatgtatttcttgtagagatctcccttgaagctctggaactgttccgccattttcttcagagtccactgtttcactatgttctccgtacccgcgggtagcgtgaacgtctcaagcattgtggtcccagcatctctttcttgagtccgggcaaactgtcatatccctgcgtgcccttgttttgtgccagtacaccgtgctgacaggcacgttgtccctcacaacccaaccgctgtggcgtacaaaattcttggctgcttctgccgaggcactaggtcggccgtcttcgtccacctcagttatgatgtgccgaccctctatcttcttcgcggcacctcgttgtccgagtgccctcttctgtccagcggagggatgacttccactagcctcctcctcatcgttcccctcctcgctcccctccgcatccctctccacgttcccctcctcgttcaagtactggtttggatcctcgttcccctcttcttcgttccagtactggctgcttctctctgcgattgtatcgtatagtatctgttcctcatcgcgatcagccatctgtgcatacaaaaaatacttgttaggtatataggatgtatttgctaaccgtaatattaaaactctactaatcttatattaaatctctaataatcttatattaaatcgctactaatttcatattaaaattgtaataatcatatatatatgctaagtataacaatcttatattaaatcactgctaatcttatattaaatctctactaatctcatattaaatcgctactaatattatattaaaattgtaataatcatatatatatgctaagtctaagaatcttatattaaatctctaacaatcttatattaaatctctaataatcttatattaaaattgtaataatcatatatgctaagtctaacaatcttatattaaatcgctactaatctcatattaaaattgtaataatcatatatatatgctaagtataacaatcttatattaaatcgctactaatcttatattaaatctctactaatctcatattaaatcgctactaatcttatattaaaattgtaatagtcacatatatataataagtctaacaataatatattaaatctctaacaatcatatatgctaagtgttacaaacttatattaaatcgataacaatcttatattaaaattgtaataatcatatatgctaagtctaacaatcttatattaaatatctaacaatcacttctttacatcatttgcctgcgcgaattccttcgatggctagctaccacttcggcttgagggacgacgacgatgtcttctctgcaacattatcaggaaaatgtattagtctaaacgggccaagttacatatataatcatatatgtattaccagtaaatcgtattagtataaacgcgttcgttctcacacttttagtacaagtgcatacacgttcgtaagcgtttcgtgcacgttcgttcgcgttccgtaatcgtttcgttcacgttcgttcgcgttcattaacgtttcgtgcatgttcgttcgcgttcattaacgtttcgttacgttcgttcgcgtttcgttacgctcgttcgcgttcgttaacgtttcgttcacgttcgttcgcgttcgttaacgtttcgcgcacgttcgttcgcgttcgttaacgtttcgttacgttcgttcgcgttcggtcacgtttcaatcacgttcgttaacggtcggcaatnnnnnnnnnnnnnnnnnnnnnnnnnnnnnnnnnnnnnnnnnnnnnnnnnnnnnnn

SEQ ID NO: 57312 - DNA, 2018 bp, Oryza sativa
  unsure (1)..(2018): unsure at all n locations
nnnnnnnnnnnnnnnnnnnnnnnnnnnnnnnnnnnnnnnnnnnnnnnnnnnnnnnnnnnnatctttagtcccagttggtgagaccaatcgttgatggttacgaacagcagcgctcgtaggttaaactccttctgtttgtcctcatcccacacggggacaccttccttcttccacaacagtttaagatcttcgaccagtggtcttaggtacacatcgatgtcgttaccaggttgcttggggccttgaattataatcggcatcattatgtacttcctcttcatgcatagccacggggggaggttgtagatacacatcataacggaccaagtgctatggccgctgctcatctctccaaaaggattcatgccatccgtacttaaaccaaaccgtatgtttcgtgcgtcctttccaaagtctttaaattttctgtcgatgtttcgccagtgcgaaccatcggcggggtgtctcagcatcccgtcctattgacgctcttcagcgtgccatcgcatcattctagcattccccttgttcctgaacaaacgccttagccgtggtattatagggaaatacaacatcaccttaacaggaattcttttcttcgttagctgcccgtccaacttctcctggatcatctcgtctaatcttgtatcgtagtgctttgcaaatggggcatgcttctaggttctcgtactcctcaccgcgatacaggatacaatcattcggacatgcgtgaatcttctgaacttccagtcctagagggcagactatcttcttagcctcgtacgttgtctcgggcaatttgtttacctccggaagaatgttcttgacgagtttcaataaatcgccaaatgccttgtcactaacaccattttttgccttccattgcaagaactccagagtggtatccaactttttgtgcccctgctcgcaacctgggtacaacgacgttctgtggtcctctaacatcttggccaatttatgggcccccttttcactttcacaatccctccttggcgtcctgcaacatctaaccaagatcatccgcaacgttgttaccatcagcatccctttcctcctcacccgttttatttccttcaaatccagcgtactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttccgattcttacacttattgcatggacaacaaataaaacccttttgcctgttagcttcagccactctcaaaaaataatgcacaccatcaataaactctttggaccgacggtcagcatacatccattgccgatccatctacatgatatgaaaaaaaatcgtacacacataattattcgtacaataatgacagtcatacaataattataaaataattacaaactctttcaacagtcacacaataatgacatatcattattcatacaaaaattatgaaatattacactgaataattatatatttactatttataaagttttaaactaatattaatgtgttgtacttattttaatttttcattttactttgttttctattattcaagattaactttcactatattttccttctcagctattttataaaaccttctttagcaaataaactaaatttctatatattctttcttctccacacaaattttctctctcatcaactaacaacaaaattttggagacaaaaaagtgtgcaaaacatagctccaaatgtaatatgaaaaaaaaacattggaggataaagttgctaaccttttaggcacctccgatttgtatataatcaccaaaataaattcactagaaattttggcatgacctcccctcttttttgaagaaattttgaagcttgctcgggctggaggaggaagaagacatatatataggggtgggactttagtcccggttggtgttatgaaccggggctaaag

SEQ ID NO: 57313 - DNA, 9869 bp, Oryza sativa
  unsure (1)..(9869): unsure at all n locations
acaaaatgcactcatcaaggttaagaaaagataagagccaaacaacctaagattagagaaaaaaaaacagctccctcaatatgaacatatttattatttgagtaaaagcataacaacactagctatctaaaccgatagcaattaggattaatttgttcggactccagatagcaatgatcaattagcatgatcccagggtacaaggtttgtgttgttctgccagctgaagtgatcatcagcagccatgcccgaattccagctgtacaaagcagaatctggaacagttgatgcaggttctagagtgctgatgttattggtcaccatttcagcagttgaggttgttgcagttcccaagctgtcaacatacatggcattctgagatgcagagctgatcatgctttcctggctcatctcacttggctcccatcctgaattctccatcaatccctctgcttgattgatatagcctgcaaataataaggtccaaggaatcaatgcatgcttttttgaaattaaaaataaagctgacaaagtcagggagctacagcaatttcattacttggcatgcctgaagaaatcatgggcttttcatcatgaaatggaattaagcttttatcaacaagtgccatctcattctgcacttcctccatctgatcccactgttggtatgcttggctgaccaattgcttgatttggacctgcaattgagatcaaagcaaatttaaggtaatcttaagaaattagtaagacaatcaaatttcattgaccatacagggattaattaatttggtggaatgaaggaagttaccatttggtgtggaagcagttcatgcaaagagcacatccgaccgccgaatctcactgctaagatctctcctacggggttgaatttaatctcacaaccttcagatttgaaaacatagcatttccctcccatgtcacatgattttgcttgcttcaatgtcgcgctccactgccgatctgacatgccaacaagctgaacagtgtgtgcacaacagaacaaattaaagcagaaataatttgtattatacaaattatgaactataatcccccaaagtgtttgaacaaaattgaaacaggagaacctacacttttaagcttgttgggattcatggtgttaagcttcaaaaagtcctggacgttcttgatcccctcggcctccaatctcttgtcgattggcccatctttgcctatgttcctcagcctccagacgttgtccgtcagcaaaggagggaaatgcttcttgtacactgcaggtaaaaggaactctgtgattaataatttgttccttctattgttgtacttaatatgatctgttcatcgaacttacattcgcctcgatgatctttgactgtgaagctctcactcactgcctcttggatcctcaatccgcaactgtctgtcagcatgacaacgcgcacaccgattctgaacttcctgctcctgatccagcttgaattgtcagtgaatgatacatcatcaatcactgcaactccatggttgctcatggtcacactgactgtacccactagcaatggcctcctcccttcccgagccttgacgatcgcggtgctgaattgatcatcagtccacctagcgccgtcttcatcgtatcggaaatcgccatctaggacaagtacttccagttttattgctgaatatcctaggtgagtgtttgatggtgttacaatgaggttggtccttgtgtcaacaagctggatttctattggattgttgtcgatgtcgacgagcttgttgttggtgaagattggtagcttgagctgcttggtgaagacaagcttcaatggaggtgagacccctacatcttggatttgtaatggaagagatctgatagagatggttttattgtcagattatgtgttgaatatgtttaacaagtactatttccatgcgtattgctcaaaacttgtttttgtacatccaaatttgcagaataaaaacgtttgccatttgtttcagtaatcttacaaggtttcattatactaacctctggccttgtgctatatatatgcatcttgttttaattcaaaacctcgcaattaattttcagagatagagagagattgagaaattttatttcaccatacctatgtggtaagtcatgaccatactggggaaatatgttccgaatttcctcacgcacctaagaaggtaaaaaagaaaaatcatccaaaagaaaaagggttaaatgaatgttcatatatgtgcactaaaaactgaaaagcataatgaaattcacacatacaagagaaggaaatggtatacaactacaagaagaacaaatagtcattcatatgtgtggatgcataacaggtaatgtaagttttattgattctagacaaatttattaaaattcgctttctctacaatccacagaaagtgaataacttaatttgaatccaacgtctcacacatgaaaaataatcattaattatttctccattgaaaatgactaataaatcgaggcctaatacatgggaaagggaattgctaaaaaattatcgcgaattcaaatgtgactatagtatacttgtactgtatagcatagttgtagtgtatagatgaattaatattaacttaccaccctacgaatgaccggttccaggttaagaacaatttgttgaattgtttccgctgccactgcccttctcaccaccctgcagaaagagcacacaactatcacacacccagttcgcttcaagtaattattgaatttgttcgaagttccagttgaactaaattaaaataagcatgcataatatgcaaatataatagatacaatactgttcatatctctacatatccagagtgatcaagagatcgagattatgatttatatatctcaatggacaggagaagaagcatggaactgaatcttgccaataaaccgtaatcaaatttgacgaggcttgcaaagtgatcgatcgatcaacatgaaaatttgacgaggaaaaaattgaagagaaatgagttgaactaacgatctgaaggagagcacagggcggagacgcctggcgccatggcgtcgctgctgatgttcctcggccgaaccgctgctcccatcctgatcatcgtcgtcgacctcctcctctacccgtggccttcgcaccgacatcgatcgatcttcagaaccaagaagtaaaatcgatcatctgcttgcagggcgtacgtgcaagaacaatattttcagaaatagttacacgagcagtaatatgtaactaatgactgaaaataagctcgattgctaattaactagacgaatatttatacacacaataattaagatgagataaaaatgaacgcaactgaaagtacctgtctgccgaactgaacaattaatcaaactatatggctagctagctaattaagcttagccataattgcacactaactatataatatggggatcctctagagaaacgggttgttggtagcagtatatataggccatggagatagagggccctggtcatttcctaggaattgttacagaggaagtgaagaagttgctgcaagttttctcctgcagtcgacagaaagactgtggatggatgagagacaggagaatgttccggggaggccgcaggaaggtagctggaagctatgcctcgccgtcgcatatgcatcccaatttctcgcgtactactagtagtagtagcctgcatgtgcggctcgcgagaggaagtagctgcagcttttgcagcagttatatttaccatttacgttatatatactccttggttctactccatttttataacaccaaattagtttcattaaaaactataattgaatatattttcataatatatttattttaagttgaaaaggttgctatttttttctacaagattagtcaaacttggaacaggttaattttgaaaaaaaatcaaaacgacttttaacttgaactggagagagcagaatataagcttttttacttatgaatctgaatatgtctatattctttgtaaaaattactactccctccatctctaaatgtttcacgccgttgactttttttaaacatgtttgactgttcgtcttattcaaaaagtttaagtaattattaattcttttttctatcatttgattcattattaaatatatttttatgtatacatatggttttacatatttcacaaaagtttttgaataagacgaatggtcaaacatatttaacaaagttaacggtgttaaacatttagggaatgagggagtatatattttgggatagaggtagcatatccattccattataagtttttttatttatttagcaaacactaagattaaaaaaatcatttcagtcatctaaatggttaatttttttataaaaaagagtaaatttaagcatacctaggttttatggtcaaaattgcaaaaaagaaatcataggtattattacatgagccacttaaccccaaatattatggtttgaaagttttacaaaatgccaccttaagcattttgagcacaaaattaatatataaaatttttaatggtgaagttctttactaaggttgatagtttaattctttcctattttcaaaattttgtttaaaatatgctgacatttatcaagattttaattaaggtggggttttatacaacattgagacattatgtgtcatacatcatataagcattggttttctacaactttaaccataaaaacacgagattttccgaaattttttagttaaaagaaaatagaattgcttaaattcctccttgccagcacctgattggcgcaaattgtatgtattttgatgcatgcattgtaagaacctgtggcatataaatgtctatatcgtggtatgaattcccaattttatatgtctacaacgacaaaactttactttgggtatgtattttgtagacaacgaaactttcttcggctgagttcttatcccaatttttccaactcacatctctcgttttcagcacgcacgcttttcaagctgctaaatgatgtgtttttttgcaaaaatttctatacgaaagttattttaaaaaaccatattaatcatttttaaaaaataagttagttaatacataattaatcgtgcaataacgtgtgctctgttttgcatgccggggtgccgaacacagcctttgaaactttttattaccaaattaaatactccatatagcaatgacgactgggagcgggatgcatggtataagcactaatcagtcaagaaaggtgctggcagaaacgcgttactagctagtacgtgtgagtccggccaggagcatggatgcagcttcttgggcatgacgaagcaaatacgtatacgtgtagcatggatgcgaccgagcgtgaagactcggtcggtcggtccgccgtgttcatgttacatgcggcgacggtttcatgactagaccacgaccaccacagacgacggcatggtcgtaggttaacttccagggcccttctgtcaaactaaccactctgggacgagatatacgtagtgcaaaacctagccaacatactagtatagtagtagtggtgtagtaggagtactactgtacgcacttccacgaacattctggcctttctcggtcacatttggattttggagatagggcctttttaatccctggcaagttttttcctcctatcatatcgactgtttggacacatgtataaaatattaaatatagacaaacaaaaaaactaattacacagattgcgtgtaaattgcgagactaatcttttaggtctaattgctccatgatttaataatgttgtgctacagttaatatttgctaatgacggattaattaggcttaataaatttatctcacagtttacaggcggaatctgtaatttgttttgttaatagactatgtttaatacttcaaatgtgtgtccgtatatccgctgtggcatggtaaaaatgttcacccctgaatctaaacacagccataatgccaatatcattaacgtgatgtatcaatcttagctaggttgaataatatcatagataaacaaaaataatatatagcttaagttttccttcgagaaaagcaatagcagaagttcgccgagagctgacaaaattctagatcggtatgcgtgttatcctatggaaatgtaaatatactcaaattaagttgaatagaaaagttacattaaagttcgaattttgatttaaaaaaactacttcttcacatactcccggcccttatctccactaatcacaatagtctcttatttaatttctcaatttacttttccacctcaaccaatcacaatcatctctcattaatttcacttttttttatatccataaaaatctccgtgcaagttgaaactattcgtgtacaaatttaattaggtagctaataaataagaaaaagactttctccatttcaaattactcaccatttgttgtaggtttatcataaataaaatatgtgaacattaatttttgaaaattcgtgtagtttaacagcatatcaattatatactaagaaaatatttctagtggtgaatctataaataaaaatataaatcttatgatattaaatctatatagaaattggtatttacatattaaaatatttaacttacgacaaacctagaatggacgataagtaattggaaatgaaaggtaggaaatagtgtttttttttaatttctgcttaaccttctttcaatcgtggtcgcttcgaacggttaattttatcagatatgcaatttcgttgttattaaccagctagttgacaggcgactggacggaccgacgaagaacgccgcatggtcagtatctaccgaccaaagctaagcttccaccacttttctgcattcctcaatctctaacgaaagcaactactggtactagcgtttttttctacatctcaaaagttacactttggcatgacatctccttaatttggagagacttgagtagaccacgccaccatttaaattaaagtgcgttgatcgccggtcaactaaacagtgtatgagtatgacatcagacagcgactgttaattgattagcaaacaaaatacatcaaatcgagcaagcattcaggtatacttactactctaaatctattataagttacatccacctaaaatcccttacaatttaaaataaagggagtacctgacgttcatgttcctagttttcatcagcgaatgatggcatgatcaaatcctagccacggccccacccaccctgatagaaagatttgttcttttaagagcaggtacaatagcaagctataagccagctgcaaacatattttaagaagataaataaggagagagaagagcagcgggatacagatttgtagccaggtgtagcacgggctccaagacgtaatgtgtgtatgacaggtgggaccagatattaatagtgtaatatgtaactattgtatgaatgagctattagattggctatatatgaattggagctattagttggctatactattaaactttctcttagacctgaaacaactagaattacatatgttaatttatttcgagacaggtcaacacatgttaatttgaacttgtggaaccatacagtaataaatctcctacaagattttgcaactgattttgatcgataccgttccgtcccaagctagccagtagcaatatcagttcagctgtttttcatgtgcccgatcctctactttagccctaacttaatgcagcttgactttgtaccggcagtcaaggtcaaggtcaagtatatatgtagatagagctaatttaagtctacaagtagaaaagaagaaccaaattaacaaatctccctctctttctcggttagcagaccaaaagaaactgaacgtacaaaagttccattcttctatctttttttttaaaaaaaaagtaaagtaaaacccatgacaaaagctccatttttattttaaaaaatttatcaaatcccatgctttatggtaaaaaattaaaaaaatcgcatgtattatagcttgtaatacatataattgcatgttttagttttgtggttcaagtgttacatcagtcttgttgaaatctcaattaattttagtgtgtcggaaacaatactaggttttgaagtagtgaagagttaaaataaataacctaataaagaaatcaaaaatatattttacactcaatactctaaaattttaagtaaatataacttcaaaactcctgtcaccagaagttcagaatacctgaactttgctaaataaaaatatgttctataatccaggccaggatgggccgggatggatagaagcatgcccgtatgggctggaaattgcaataggaataagttcactttaggtcccttaatttgtcagctagtctaaatttcgtccctgtttcgcaataccagatatggcacgtcccgcaactctcaaaacagtataaataaggatctaaggcagtttggatggcggtttcggctgacgtgacacttatgtggtgttgatatggcacttcaagcaaaaagaaaccgttggacccacgtatcatccggttaaaaataaaaacaatacagtgggacccacgctatcaacccatatctttcccttttatcactcttcctcctctctcatcctacccaaccgtgcgcccaaacccgcgtgcgctctttggagcgtcggagccgacagtggcacgcccctggggtgcgcctgaccggccatcgccgtcgcgcttttcggcgttgggttcctcctccttgacccgctcctcgacagcatccactcccgtgacgcgctcatatcctggtgacagtgactcgtccatccttcatccacactccttgtccacgcagtacatggaggaaccgagcgagtttgtacactaaccgtcaccggtggtgaacgagtagaggttgcttgtggcaaacgcacccttggcagcccatccaagcgtcatctctgcggacaacatcgcaaagaagggcacggacaccacatatgtgtccctccagtagatgtcggggtcgtagttgagcgcgcgggcacggatgcgaccagtagaggtcaaggaggccttagttgggtgcgcgagcgagtttctcaacgtagaccctgaggccacgatcggcaatttgctgctgtgggaagaggagcagcagggaggtggggcgcaggaggaagaagaagagggagcggaggagcatggtggggacggggaggcacgccatggccgtcttccaaatctcgctctgcttgcttcagatggaaggagccaccatggtctcgctcattctgtttgcttcacctactctctcccgctgctcccctttttcacttccacgaccattctcctggggctttccatcatgaagttggatgtggacaagagcggcgacaacgcgggggcagctggtcttctgttgcttctagtggcgcccgctgtgtccgtcataggtatactgctttggctcgcgcgtgcgcggtcaaacctcgagcccgcctgtcctcaccctcagcttcctctccccacgcccgaccatcttcgtctcgaggcatgtcgtcccccaccgtgcgctcgtccggtgcaacaccgcgtttgccagccggccgcctgccattgtgcctttctgcgtgctcactactagccagtgcaccgtcagctccacaccgtgtcccaacatgtgggttactcactaacacgtgggtcccactttttatctaacttgaagtgccctgtcagcgccacgtaagtgctatgtcagccaaaaccgtcgttcaaactatgttgagaccttatttgtattggttttggannnnnnnnnnnnnnnnnnnnnnnnnnnnnnnnnnnnnnnnnnnnnnnnnnnnnnnnnnnnnnnnnn

SEQ ID NO: 57314 - DNA, 1261 bp, Oryza sativa
  unsure (1)..(1261): unsure at all n locations
ataatcttgactaatttctggcaggtagaaatacaaaactgcagggtttggctgctgctatactaaagctttgggaaaagagccttatagcgaaggttgcagtgaaagtgggtatccaaaataccaatcatgaacagatggccagaaatcttaaggtgtgtattgttctcatgaaatatattagagtcattaggatttctttgatatccatatgttcaatcttcatctgtgacactgaatcttctcagtgcagcgtcttacaggaggaactgtcatattgaggaacaaggattatattattatatatagaggcaaagattttcttcccggtggcgttgctgaatcagttattgaacgggagtctcaggtacatgaccagcaggcgaaagaagaggaggctcgattaaagatggctgactcacttcaaatgattgttggactatcatcggagagaagttatgtgggaactttcagagagtatcaggatttccatgatagccatgcacgtagaacaactgaaaacaacttcagaattcaactagaggcaaagaagcatcgattggaaaaggaactgaaagaccaggaatggagactttccatggtatgctttgatctaactcgtcttgtaccttcttttgaattcccgaacttccaatggtaatgtaaaaatggtacgtactgcagcttaccaagaagattgaaagatcaaaccaagtgctggcaaagcttcatagttcttggagcccttcaaagaaagatggagacagagaactcttgacagaggaggaaaggaggatattccgaaaaattggcctaaaaatggatgaacatgtgctgcttggtatagccttttgtatcaaactgcaatattccatgcctatatgtgtctctatccttgaaaccaagaaaagctatttaccatcctatgatgaaaggtattcatccatggttttcccttgcagggagacgtggtgtctttgaaggcgtaattgaagagattcatcaacactggaaacataaagaggttgtgaaagtaattaccaagcagaaccaagccagccagatcacgtacacatatatgatgcttgaggttgagacaggaggcacattaatagcaatagagaggttcactaccagccatgccataatactttaccgaggaaagaattatcgtcggccaacaaaatcagcacccagtaatctcctnnnnnnnnnnnnnnnnnnnnnnnnnnnnnnnnnnnnnnnnnnnnnnnnnnnnnnn

SEQ ID NO: 57315 - DNA, 1743 bp, Oryza sativa
atgtctggatttataataaattatatcaaattttgaaataataatttttcgatattatgtcaaattgtcatatttgtaaaagttaaattgctagatgcagctacaaaataggggcaaatacataactaataaataaattaggggaaattgagagtatgaatgtcttttcgccaaaaatttaatattgttaacatgtctatttaaaataggggcaaaacttagttttgtttgaaaaaacaggagtgaaccgatataaaaataggggtaagaacgagatttccccttatagtaaacatgtaacatattacactcatctatgtatggcgtgaatatattatacaaatagcaccggtctataccactgtttatgttttttttataaaactaataactgattttagattgtatcaatgacgtgggtttagacagtgatcgatatggttttgtagagtattttccatacccaaccttaggctggcctgaattcgagagcgagccttgcctactaacacggaaaaccaaacaaagaattagtacataattaattttaattaagtattagttaaataaaaactttaaaataaattaatattgtttttttaaagcaacttttctagagaaaattttcgcaaaaaatggtaccgtctactgatagttttggaggcttgtacacgaaaaacaagatatgggagactgggaaagttgagagaagaaccgctccttgcccccgtgaaagagaagccatcctgtacaaccaccatcacaccttcacaaaaggctcactattcattagtcaactaatatttctggaactatctatctatatattggtgatttctaaaaaaaaacatacagattttttctacccttagatttacacccaaggtactataaaagaaaataacaaaaacatatttacttgcatattatttttatcaaaattactatgaacttacatatcatatcagctgaatttacaaatgttattttaatgttttcctttacaggttaaagtccaaattacctccggactattacgacagtttgaattactcccctaaactacaaaacagaacatttaacactcaacttttttggactggatgaataacccccagtacaaatttggttttgatcttacgtggcatagaacgtgacaatataatccaatttttaatcctaggtggcagtgagccagtgaggcccacccatcatcttgtccgccacctcatgacgcctgtcacctcctctaggtcatgttgggtgtgtatgagatagagagatagagagagagagagatggatatgggaggtgaaagaaaggagaagattggaagtaggttgtcaacaagccgagctcaagtgagctttcacgtctaggctcgagctcgacaaaagctggagccgagcccgaattgagcctaatcctccttcgagcttttaagcaggctcgcgagctcgaccaagtataggataatatataatttgatgataaaattttgtaaaaataaaaatttaattaataatattgaagaaaaatattaggtgtcacaccctgagaattcaaaatatgtaaattattgtttaaatggaatttttagaatttatttttaaaagcctagaaaagaagatctaattttaattaataaattccaatataaaatggggccagataaaaattcattaaatacttggttaattctataatcctagatttttctgggatttatttgagctaaggaag

SEQ ID NO: 57316 - DNA, 749 bp, Oryza sativa
  unsure (1)..(749): unsure at all n locations
ccacccaaaatacaattcctaatgtgctattatacttcggaatcttatttctaatttcagatttgcaattttcacactctttcattgctagggtatttcatatataatgtattggagatattcattatcatcgtatgcagcatctcattttcgccattccttgatgtcagttgttcagaggtatcatatccgtcttgcatttgttgaatatattgtaagccattaagttttgtttctttatccaataattgtgtattcctgtttgtagctcctgtagccatgcatgggatgcatttcaggttgcatatgctacttttcaactgtattgtgtaagaaataatgaggtgcaacgtcttatgcttgggcctcatctacttggggatgctccaaggatatatatcacccctcctggaaacgaaatagccgaggaagaagatacctcggaatattttccagacataaagatatatgatgaagatgtgaacttgaagcttcttatttgtggagcacattgcacccttgtaagtttaagcgatcatgcctatatttttcttctaaaatatggcatttttcttattccaaatcaatgattgtacttccatctcttttacaggattcatctctattgaactcactagaggatggtttgaatgctcttctcaatattgaagtatgtgtcaaatcctcttctagttaccatgtgttgctgnnnnnnnnnnnnnnnnnnnnnnnnnnnnnnnnnnnnnnnn

SEQ ID NO: 57317 - DNA, 743 bp, Oryza sativa; identical to SEQ ID NO: 22705

SEQ ID NO: 57318 - DNA, 771 bp, Oryza sativa
  unsure (1)..(771): unsure at all n locations
cagtgtcgctattctcaattaagcaaaattttaactttattttttttcttcaggcatcattcaaaccacacactagcgggcgtcgtagcacagatcattagatggggttatttttaaactcaacaatctgtttttgatttatttatttttaattttccgacatttattctaaatgtttaattaaatgttttccatttttttattatttggattcaaacacttttttttatcatgcacgacaagacagttattatttaagtggaagggatttaggcattgtgtgtttcttttttttcggttacaatggtgtgcacacattgagttattatttaactcatcgaagcaactagatcacataatgagttttcagttatattttaactgttagcgacttaggcatgggttgtttatttaataatcgatgcggatgcacggcgagttatttcttaactcgacacgcaatgtattgttatttacgattcctttttttcccttgcagctacagtgcgaatagcagcgaatcttcagggtctagtcttttcaaaccatcggagttatcgtcttccccacattttacggccagttctttcttctccgtcgaccaagaagaactctccctcctctcttgccgcctatgccccggagatcgccggccccgccgggattgattcccactgattttcttccacaagtcggccacaggtaaatgtgatatnnnnnnnnnnnnnnnnnnnnnnnnnnnnnnnnnnnnnnnnnnnnnnnnnnnnnnnn

SEQ ID NO: 57319 - DNA, 3806 bp, Oryza sativa; identical to SEQ ID NO: 22709
  unsure (1)..(3806): unsure at all n locations

SEQ ID NO: 57320 - DNA, 2983 bp, Oryza sativa; identical to SEQ ID NO: 22710

SEQ ID NO: 57321 - DNA, 1928 bp, Oryza sativa
cattttttcatcctcatatctattttaccccattattttattgcttgtggtcaagccataagcttaaagctttcttttgcatttaatgacttatgactttgtttcacaatgtatatggtcactataaaaccttatggcctcttcttatggccacattgtggctgcctagggacatttatatttatactagaaaaatgcccgtgcgttgcaacgggtgaagtctattttaatcttattattgttatatggttaagttaagatgaaatttaatgtggaatttcgcttggatatatatttttagaaaatcaagagctccaattagtagttcgatcttctcaagttagcatgcgagttttttaaaacatattttttatatgattccttatgtattaaaaaccgatcttaaaaaccgactcaaatacggatatgtattttcaaaagcaaacaaacttaaaaactgactcatacacgaatgacataccaaaatatcggcaaaaacatctttaatttttataatagtagagatagagatatcctttttagaaacatagtacaaacatcagcactcactatgtatgcacacttacccttacgaatacatacacatcctatcattacgagcacatccgaaaaattagaccgtccggtatattttgagaccgatgaagtcactatgggtaccctgccatggacgggtacatcgccgatcactactactataaacacacatatacaaactatattcttatgagcacctctaaaaaattaaattaggctggtacatctttgagtgcctcctgttgacaagtatgtcatccaccactaaaaaaataaggaaaaaaatctaaattatccctgaactatcatggcagaacaaattaccacctcaattcaaaaactagacattctttaccctcaattttttatactagacgaattatctcctgactgactccggaacggttttggtcttatgtggcgcacatgtggaagtctagtcagcataaaaaataaaaaatgatgtgacccacttgtcaattttgcctcttctctcggtcactagatgtgagccctaccttttttatattttttattactgactggactaccacataagtttcacgtaggaccaaaactgctctgaagtatatcagggggtaattcgtccggtataaaaatttgagggtgaagaatgtcttacactaaactatctggtttagtatctggtttttgaattgagggggccagataattcgtaccttcacaataatttagggattaattcggcctttttcaaaaaaaaaaatgtaaatgcgagcacctacgtcaagttattgaaccaggtgcaggtacattttattgtattttgaggtgcgcacatacattttattttacttcgcttgaatttattttgaggtgcacatacattttattttaacctttttaatacaaattttatttgacaatgaacgatcaacagatagcttattttgaacataacctttagtaagccacaccgcatgataagatgacgcatcaactcacactggtgaaagaagaatgccatttttggcttttcagagtgtttgcgttgtactatgtaattctcaaaaaagaaaaagtgaaataagttgtaattctgaacatgaaatcctttacaacaaacctaggtaagctagcaatattggtgtaacaacggtaacatttgttatgaaaaaaaactggatatatctatctgatattgtcaaaacttatactttaaatgaaaactatataccctgtccgttttctaagttgatgacaccgttgactttttatatgatgtttgactattctcatatttaaaaaatttatataaatatcagttattttgttgtgatatatatgttttaacattaaaggaaatttaggtgtgatactttaagcat

SEQ ID NO: 57322 - DNA, 2684 bp, Oryza sativa
ttcaaaattatgtgaaacttacaagtcacagtgtagttacatgcaagttacagtgtaattggatataagttacagtgtaattacgttacgattgtactataattacatctgtcaaatttttggggaaaaatttgtcgataaatgtataggcagtcccattatctattacttcctccgtattttaatgtatgacgccgttgactttttgacaaacgtttgacctttcgtcttattaaaaaaattatgtaattataatttattttattgtgacttgatttatcatcaaaggttctttaaggatgacataagtatttttatatttgcataaaatttttgaataagtcgagtggtcaatcattggttaaaaagtcaacggcgtcatacattaaaatatggagggagtatatatatactacttaaaaagtataagatgcttccttcgtccatataataaaaaaatccgcttctgattaaaaaaacaccgttcataagaaaacagcgtgaaaaaaaaggccttctagaaaacggcatcggtaaaaaaaccccgcaaaaaaagtaacccccacacgcggcaaaacgccgttaggaagaaagacggaaaaaagaaaagaaattttgattccgatttaaaaaaaaccgtccccaagaaaacggcgaaaaaaacatctagaaacggcgtcagtaaaatatccggcaaaaaaggaaaaaaaaaaaaggccagaacactatcagcaagaaaaacggcggaataaaagaagagagaaaagcaaaaaaaaaatagacaaagagaatcttaactaattaaaaatttggtagctttcgatcatcacatcgatttttagtccgtactaccattttccgtccgttcgcaacatcgcgcgcaccttttctccaaatcccacataatcaaaatccaagtccaaccaaaaacataatctcaatccaaatccaaatccaaatctaaatcggaatcatcacaaaatcatccaaaatattaagagatgttgagaggagatggaggggcgagcgggaggccaccgttcctcctccgccgtcccgtcattgcatcggggatcagccgagccgccactgtgtcgctagggagccggggagtagccgcggttgcgttgggaagtcgctggctcgcctctgcgccaggaagatgctgggagggagagggaggagccaatcctgagccaccatgccgccggggagccaccgacttgctggatctggcgaggagtgggatggcagcagcaccccgacgaggaggaattaaaggagccaatggttagggggggagggagggggagcggcaccgcgggagaaaggagggcatggagaggcaccaccggtgggggaggggcgtggagaggcgccaccggtggggaaggggcagctcgcggtgggaggagtagcgtcgttggtggggagagaggaggggcgccgctggtaggggacagagacggcctgcggtgaggggagggaggggaaaatgaattagggttagggattttttaaccgcgacgattttgatggattcaaaatcgatctgagccgtccatcaaaacgaacggctcagatcgatcccgtgttgggccagcctccatctttaggccgcatcactgctacgcagcacgctggccggctggtccaacaaagcacttaggttggactttcggttgggggccacacggcaatgagaggaggagtagggggagccaaattacacttcctgttgggccgaatgctttcctacaggttgagacggaggggaggagaagggataaaagcgggctgaaaatggcctagagaccaaggttgatttttttatttaaataaatgctgaaataatgcttgtactatcaaaattagctattaaactctagaaatttcaataaaattccaaatattgtaattaatcatggagacttcaataaaattaaatccaactatataattttatttcgcacactaaactaatttaattatatatctacctacttaaaaaataccaaatattttcggaaatttatatttcaattaattacataatacatatctttctcaaatttttctcaattttctagtctttacaattcctgttgcaacgcacggacacttttactagtaaatatatatatatatacatgcgtgtgtgcttgtatagttctgcaaaagaataaactcgatcaccagcgtgcggtgtgcgcttatatacacacacatatatatatatatatatatatatatatatatatatatatatatatatatatataactacaatagggcacctaaaggtgccacggattaaatggcacctgatacaacctcacaaccactctgccccacataccgccaccgaccacgcagcccgcatcacaccagattaatagtacatagttaaaagttaactcagtgttgtacaacatccatcacatattttacagtgtcgctattctcaattaagcaaaattttaactctattttttttcttcaggcatcattcaaaccacacactagcgggcgtcgtagcacagatcattatatggggttatttttaaactcaacaatctgtttttgatttatttatttttaattttccgacatttattctaaatgtttaattaaatgttgtccatttttttattatttggattctaacacttttattatcatgc

SEQ ID NO: 57323 - DNA, 1151 bp, Oryza sativa
  unsure (1)..(1151): unsure at all n locations
agttcgtttcttagtcatggttcttatgtccaagctcctactcccagacaccgacttttacatacccaagagtgatgtatgggttgccgctgacctcgatcgggtcgctgccatcgattggtcgaaggcagtgttccaagcactgagcgataccatcagatgttggcgacaaaagcccacatcgtcaatcacatcttgtgttgtatttttggtggtaagctattccgttaatttcatctattttacttctgtttctaccaattttattcattttatgcatacaaacctaggtttatacttccgtcatgaattttttttattctccatcatgatacttctttttgtacaggttcggttctgtatcttgacaacatcctcgacgtccgaatcaggtgggttgaggtcatcaatgtccgatggtggagatgggcgtggagttgacatgtacccaaaatcttcagcgaacatcgtgtcatctgcttccatcgagggcgacagcaggaatgggtctggggaaggcggtggtggctccgacacacgaaactcttcgggggagttcacatacctcctcacggtgctccgacgtggtattaacggacggagctggaacatgttcttcggaattagtcgctttggcggtagatgtttgggcaatctcatccatgggatgagttgggtctgtgttgggcacttgtgcagaagccgtgatagtcaagtttataaaagggaatgcaaaccttgcaacagaaatcacgggatctgatccgtgctaatccagggagtaatcgaagatattttctagcggattagttagcttgtacgtacgtacaatcccgagattcgtggctacgcattatcacacaaattagcgaacccctaattatattatagttaaaaaaacatccatcgaatcatgcagggtacaaatcaacaaagttattttttaactcaataacctatacaccaaatccacgtcacaaccgtgtataagtcaaatattaactccatcaccataccatccttttaaaagtaaaactcttatctaacattaactaaaaataagtaaaaatttaactcttcgcgaacggaatnnnnnnnnnnnnnnnnnnnnnnnnnnnnnnnnnnnnnnnnnnnnnnnnnnnnnnnnnnnn

SEQ ID NO: 57324 - DNA, 1922 bp, Oryza sativa
ctatccttgaaaccaagaaaagctatttaccatcctatgatgaaaggtattcatccatggttttcccttgcagggagacgtggtgtctttgaaggcgtaattgaagagattcatcaacactggaaacataaagaggttgtgaaagtaattaccaagcagaaccaagccagccagatcacgtacacatctatgatgcttgaggttgagacaggaggcacattaatagcaatagagaggttcactaccagccatgccataatactttaccgaggaaagaattatcgtcggccaacaaaatcagcacccagtaatctcctgacaaaaagagaagcattacaaagatcaattgaggttcagcgacgaggggtatgaattgacatataattctcccttctccccttaatttccaattttctggctgtctgggtatctcatttcctcattcgttttgcagtcaatgaaatacttcgctcaggagaggaaaaagtccattgatgaattgaagagagaactggttagtttacatgctgtttatatcaatacgacgaaatgaaacttcatatgcttaagcaactggaattttatgtacttgatttatcactcttgtgttacagaggaatgtgacatgggaaatcaggaagctaaaccatgatactgaacagtcttggacagcatgatcgctatcaacattgaagattggaataacgattcatcctctcttttttttttcgtttttaacatgataactacaaagaacaaagtacacagaggccactagatctggtaggtatggtagatatggccacaatgaattatcttgcaagtgtgaagatgtttttttttttgtttatgtacatgtgatacactaaagcacatgagagcagaatcattcaatttggctctgatactacgacgaaatacgaactgattactgggtgttgattaaagctcggggagtttgctgaatatgcttagcgctttcatgttctaaaagaaaacaagtcgtatgacctattgaagagaaactaagaagattcagaaggatgctgtactatctagttctacatcactgttacaaagttactataccttttaagggcgaggttacgagggtacaaaaacatgtgctgaaattctttccccaagcaaactacagaaaagatcctgcctagcaaaagcggtactagtcacctggcccctgaggaaattttacaggatttttggaagatttgaactaagtcctgttatccggtgaaaattctgcaaaattattgtgttcgaagatcccaataaactatgcattggtcgcccaaacgagagcactcaagcagaaggacacagagaagcacaagtgctgaagaatctcactggacggcagatggcaagctttgcattcatcagcttcattgttcttgccgtcccgtccttcatggtttgcgaggctctcccctgaactgctgctgctgctgctgctgccgatgatgatctctcttgggcctctgcggcgcgttcttgggattggtgaaccaggtggtgtagaggaactgcttgtgcggcccgtcgtggtcgcagatgaggcggagcttctgcttctcccgcatccaccgcatcatgatcttcatctgcctcttgctcgtcaggcccctcagcccaacgtcctggacacgaaaatgccaaagattttctcgctcgtcagggatgcatgcgatcagggtggcaatcagaggaacacaagatcgttcagggatgacagtttccatctgtcaagcactgctggttcattttgacactgtgagacattacgtcgaacaggtggcgcgcgccaccgggggggccagggcgaacggtttaaaaggtaacgggtgggcccggcggacagggagaaggagcagcagcaaggatgcggcggcggcgatcgagac

SEQ ID NO: 57325 - DNA, 1594 bp, Oryza sativa
tagttggttcaagtctctaattttttctaaaattgagatctacatgttaaaaatatccacatgtactgttcatgcttgtttatgtgctgttttggtgtttttgctcttttctgtttagattccgtcgtttccggagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattactttattccttgataccttgggttattataacttgactagttgagctttatatattggttcaactagatattagatataattgcttagccctgcttagaaacattagctcactattgggataacttatgactcactgttatttaatgatggtttaatgatagttcacgatggtcaatcgtgactggttaattaattaatgtgccaactaaaacctggtaatggtgggttgtgagcacatggttttgatggttgtgctcatgacaattaaggaccggttcacgagtttcggttgtgaaacattaaccgtgccaaccacaagccagcatgggcaacggctttatcttttgtgtagcatggttcattgcggggcaccagactgagaagtggcggagataagcccacgggggtcgctggggagtccatgccttgtttataagggggtgattatgatctaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccacaatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccgg

SEQ ID NO: 57326 - DNA, 1397 bp, Oryza sativa
gaggagagagagaaggtggggggagattcaaaatcgaatcccgcccctctcgtgcgctggcgcggccgggagacgcggggagagggcggcgacgtggcgtgggcgcggcgacgtggcgtgggcgcggggaaagcggaggaagtgggtgcggcggcagcggtttcggcgggacggcgcgagcgggagaggcgggaggtgggagacgggtccgacaggtgggccccacctgtcggcgaccccgggagggagggaggcgggcggccggctgggcctcggctgcggccggcccagcagggaggagggggaggaaaggaggagatgggccggcggcccatccgaaagaaaggaggaaaaagagaaaaaaaagaaaaagaaaaagaaaaaggattttttttcctggaattaaaattgcactttggtgatttttaattggttaaaattatttctagggctctgaaaattccactaaaaatcctgttagtgagtttcgacatgtagaactcaagaaaaattccacatgccaaatccgattattatttgcattgattaaatagggattcatctctaggttaaattaaacaatttcttcggacgatttattttatgaatttagagcaagggaggggtacttcagggcgtgacacctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccttctaaaaatattggaaaagtagaactgttctcctccctttctcttttaattgaaccaaactaatggcacatgcacttcataatctcttttaatggttctcattcaaaaatttattccagtgttattagtaccgtacatctattactgtactaatggctcattttatcagcaaaagttttacaatattgttttatttaatcttgctgcaataaaataaatttagcatgttgattttataagtttctttcatttcttttgaaaccagttataaaaaaatacaaaatttgtaacctggtttccaactgtttcaacttatctcgcaaagcttggtttac

SEQ ID NO: 57327 - DNA, 4057 bp, Oryza sativa
ttcacagggaaaatacctgattatttagggaccttgacaaagttggtggaactgtaagatttattgttaacttatcagtttaatttatgttatttatcctatacaggatacaaatagatcgattgtgcaacatatctgctctgcatatattattttcatttgaattaggagaaatattcatcaacacaggcatctgcatgggcaatatgttttatttttggtggatcagatatttatttatttttctgtagactctttgtgttttttgcatatttgatcagtatctaacaaaaaatagattctaaccatccatgccaagcagttcatacatgtaggctttcttcaaatagcttttgtgactaactcaaactccatctcaatgtatgtgtgcatggtgttttgaatattttcttagttacttatattggggactcaagacacttgtataaattttaatagaactcaaacatatttgttagggtatctgtgcaatacaccaattaagatattgatcctcttcctatctaaaggatatgctggttaaatagattggattgttagggtttttctccttttcttgattattttgcgaaattttgattaatataggaatttctgcccttttagctatctacgagtaacgtgggggtttctaaaaaagggtcctggagtatagtgtaaagaaagccaaagtttcactttccagttcttgctatcttttgcttgaactctgaaatttgtcattccaagctctttgaaatgcagagcatacttcttatgttaatttatttagcatattcctaccttttcttaaagtgtaaacttgtaggaggttccaaggaaattcttttcaaggcccgattccagcaagtttgtctaatttgtccaacttgacaagcttgtaagtacttctttcttaggtgacattttccccctgatggttggcaaggccaagcttgtcatgataatttgtgttctaaatacacatatgcagacgaattggtgatattgtaaacgggagctcttcgctggcctttatcagtaacctgacgtctttgaatatcctgtatgtgacatgttttaaagttttattaaacatcttacagttttatacattgaaaacttgtttctaagtttggatcttttggtctttcagaatattgaggaactgcaagatatccgataatctcagaacagtaaatttctctaagcttggaagattaaccttgttgtaagtttttcttgacatagtaccacgttctattgctattggttattatttctcgtagttttatgtgtgtttacttaagtaatattgctaaacgtatgccatagggacttgagctttaataatatcacaggcgaagttcctcagtccatccttaatctgaacaaccttggatacttgtaaggaattctttctgaagattattgctgttatagaaacgcctgttaagctgacatccatgttttgtcgtcttgaatggtgactcaattcaggtttctcgggaacaatagccttacaggaagcctgccagatgcgaagagctcctccctaaccaatttgtatggctgccaattcaacatatatagtattatagccaaaatagatttcagcattgcaatgatatattcatttcatatgttagtaatcttggatttttgcagagatttttcatacaatcaactcacgggaagctttccttcatgggttaccaataacaatttgcaattgtaagttaaaatttctgatgaaaaatggaaataaagacagactatgttgtatgaagtttgttgcctgacaagttacacgcgttgtttgtacaaggaatttggtggcaaataaatttaatattcgtgagaacaacaataggtacttgtgtcatttatctacaagcctatgttttttacaaaacctttttgaccattattttttaatgttttattccattacacacagtattctaccttcaggactaaactgtttacaacaagacactccatgtttgctaggttctccagaatgtatgttatttaaaacttaatcatttgtagcagttgaaaggattcgggaatttcagtaatggccataattttgtacatcttaactgcagactattcttttgcggtagactgtggcagtaataaatctatgaaaggctcagataatactatatatgaagtagatgctgcaaatctcggagtcgcatcatactatgttaccagaaatacaagatggggtgtcagcaatgttggaatattcaatgatgcctcaagtcgaaactatgtaataaatagttcccaacagtttcaaaacacattggattcagaattattccaaaccgcgaggatgtcaccatcatccctaagatactatggtctaggacttgagaatggaaattatagtgtcaagcttcaatttgcagagtttgcttatccagattcaaagacttgggagagcacaggaaggcgaatttttgacatatatgtgcaggtagatacatatcacaatgcgcattaatttgtttacctgattttttttctttatatgaaaatgttcacttgacatttgcatagggtgttctgaaagaaaagaattttgatataaggaaagcagttggtggaaaatcttttactgcagttaacaaaatatataatacaatcgtgtcgaaaaacttcccttgagatccatctcttctgggctggcaagggcacttgttgtattccaactcaaggttactacggaccaatgatatctgcactaagtgtcaccccaagtaagcccaacaattgaataatttaacctgaataatggattatagtatattctaattactaaaaccctttttccagattttactcctaccgtgagaaatggagagccaaaaaagaaaagtaaggcaggtgtgattgtcggaatagtgatcggtgcattagttttaggatcagcagccttagttggaatctttatgttgataagtaagagaagaaaagcgacccaacagcaagaaggtatcatcatttattagtgcagctattcaaaaattgaaattttcaaatggtttattctttcccatgtgtactgaaaattgcagagctgtacaaccttgctggaaggcctaatgtctttagtaatgctgaactaaagttagctacagagaatttcagttctcaaaatatggtgggagaaggtggatatgggcaagtatataaggttagtggccccccaactcaatccgtgaaacttatcttactaagttgaactgcctttgcaatttaattggtatataatcaaaatatgtatgtaacctagagatcttcctttggcagggtaagctacctgatggaagagtcatagctgtcaaacaactttctcaatcatcccatcagggaaaaagcgagttcgtgacagaggttgcaacaatttcagctgtgcaacatcggaaccttgtgaaattgcacggctgctgcattgatagtaacacacccttgttggtttatgagtacctcgaaaatggaagcctagacagagcactctttggtaagttccattttgctcatcactagcacctgttaagctccttgcttcatgcactctcgagaattatcttctctacattagaccatcatcttaattatcaagaccttatttctacatgttcaggaagcaaaagctttaatctagactggccaacacgctttgagatcgttttgggcgtcgctagaggcctaacttatcttcacgaagagtcaagtgtgcgcattgtgcatagagacatcaaggccagcaatgtcctacttgacaccgacctcaccccaaagatatcagactttggactcgcaaggctctatgatgagaagaagactcatgtcagcacggggattgcgggcacattgtaagcacatttcaccatttctcttgtggttgtcctctaaaatgaaagctaactaaaacttgtctaaccttttgtcaagtggttatctggctcctgagtatgcaatgagacgtcatttgactgaaaagggtgatgtttatgcattcggggtggtcgcatta

SEQ ID NO: 57328 - DNA, 1038 bp, Oryza sativa
agggtgggcgtgatggagttgggtcggctggggtgccgggttgtccagctgctgaattcaccgcggcacaagaggggaccgcccactgccttttgaggggtgggggtgaaaccttagcgtggtgtggatggttaggggagggttatgcggagggtcttgtcacgatttccccctttgcagtatcatggtgatacttcggggcatggagacatgtgtggaatcgtgtcttgtggatacagttgtacacctctggccagagtaaaactattcgaatagccgtgcccgcggttatgggcgatcaccagattcaccgtgattagtctcacccctagtttagtttattgaactggtgtagttcaggtggttggttgggcctgttgcagcgtggtgtaacattggacagtgatttggttaatactgcttaattactacaatcgtttcactgttttcaactactgctttgaaatgcctgctttatgcaaaagaatctctagcctcctttggttatatcctgtatcatacctactcttccggtatgacttgctgagtacagtgggtagtactcagtcttgctctcttttcccccacaccagagttgaagttcttctcagttggagtcatctcagagaggttggtttcgtcgctgccgtcaaggtttgcctatggagtggagttgccccgctgctgaagtcaactttccaagtctagctcgttttatcttttccgctgcatttataatcttttatatttttgtaagacgtggatctgtatgtcaacaattgtcgtttgtgtaccctggctggtcctggacagggatttaatgcacattcagcttaaaaattctggttcgtgaatttctaggtgtgacacaatctaaccaactaagatggatgcactaaaccaactgagagagtagtagttgcttgtttgaatgctacacccaaccgtatttaatatggacaaaaattgaaaacaagaaccctgcttaatgacctctttgttttcgaaaatgggtccgaaatgactaataaaaccaac

SEQ ID NO: 57329 - DNA, 1156 bp, Oryza sativa
ccgccatggctggcgagatcgatagccatactagtgctgctgctgccgcccaaaccgcaagatgcgcggcggccgtccgtcgatcatgatgaggagctccatcaagttctcgttgggcggtaggcaggtggcctgtaccaggaacatgtcacaaccacgcacgcttcctcgtccgtggaccgcttgatctttacccgacccaactccatgccaagatagcacgccacctcctgcgccagcgtcgggttcgctgtgccggaaaagatgcgcagccgactgctagagctcggttgcgatagcgctgggactgggagcacgtccgagctatgcttgccgtccggctgcgattgctagaggaagaagacgactggatggagatcgatctgtccctctcatgcaagtcaacgaaatagccataggggcaaaaaagtccgatcatagtggataacatttgcaaataaccgaaattggatgaaatggcaatgtggcaagatggtgacgtttgaagatggcattataccgaagccacgttcggggatggcattctagcgaaaccccaatccgagaatggctaaatgtcaattttctcatgctagagagccgagaggaccaatcatcaacagaacttggcccggcccggaccaactataaactaggcccggcccggcccggcccaactatgtctgggcctctacctctccgcatcacctcgggccgccgccgccgccgcttcgtcgccggcctcgcccactcggaaatggcggaaatgggcgccgccgccgccgccgcggtgccggttattccggaggacgtcgtcatcgagatcctcgcgcgggtgccggacccgacgtccctcttccgctgcgccgcagcgtgcaagcggtggctccgcctcatcgccgaccaggccttactccgccgccgctggccgccgggcacccgggtgccctccctcctcggcttcttcgcgcagcgccaccagatccaggccaacgcgaggcggaagctcaccaagctcttcccgacccgcgcgccgccgctcgtcgcagcgccgagcaggggcacaggtgacccacccgttagcaccgggcgacgaaggcggctgttcctcaccgacttcgtccgcaacgccgccggcgccggcctcttcgaccag

SEQ ID NO: 57330 - DNA, 864 bp, Oryza sativa
tgtgtgcataggggaggagagtggcaccatgctcaccctctacctttcggaccctaacagcgcatatgtgctcgacctcccatctgggtcgattaccagtgtggacgattggaaacgctggttcaactacatgacggctgtgtcctttgagatcaactggcattcattcttcttgactcggctaggggacttctggtacgcatagatgaccagacttttgtaatttgcacttttaatgtgtttaaacgcatgttttgctgtgagattatgactgaatcttgtagaagttgacatattcagctggcaaatgaatcccatctgatctcacttactaatagagtagaatagtagatcttatgcatcttcaggtaagccgtgcatttaagggagtcctttattctgcaaatactgaaccatgttcttttggcgtttattatctaaatgccatgattggaataaagaagtgtccatgtggtttctagttttgttgcccaatctgtgtcaattgtagctgtagttggtgggtttgaaagattgttttcagaattgttccacggtcatcttcacaaatgatatggcaattacatggtttcttcagatatattcatcctgtaaattagttcttcgtatattaaaagagcctcatttctattgcctgcatgtatttcactaaagtcgtaacttgaatcatgattcatgaatatgggacagtttatatgttcaattacactttgctataactacctgggctgctgggcaactgccatgagctacgtcctacagttcctgcatatttaatacaatcaaatttttcttgtaactgattctgtggtctagtcaaattatctatcagaagctactccc

SEQ ID NO: 57331 - DNA, 782 bp, Oryza sativa
cgtttgaggtcagatgccccttgggtggagcaggatcccccatgattttgatgattttttcttgatgttaggaaaaacaagttcaaaaacctctaaagtgggtttcatgcttttggctgctttagtttggtccctttggtcaattcgaaacgacatgatccttaggaataaaatggtttcatcatcactaatggctccttttcgtttgattggcttgctactgcagtggaagattctgctgaagctggaagaagtacctaccctggaacaaacaactaaggcgattcaggaagcaattgatgccctgcgaccttcgtgagctggaattggttagccttctctttaggatctgttttttttttctccttcctgttagtgtgttttgctgctgctcagtcagtttgttctgaaaggttgtgatgttgtgagggttgatccctttcacccttctgcttttgttttctgtgcctatatgtcaagctggcgaccccagcgctatataaggatcagtttgcaaatacttcatgctttctataaaatgcagggcctcgcgtggcctttcctctaaaaaaaattacaaaacaactgagaagttatgttggtgtacattccttaggaatataatactgtgagttttgtttcattggagcaggtatgttctgtgcaatcttgcatgctatgtatttcctcatgggatataagatatttgtgaggtgggctctggattggtctgactttttttccatttccggaaaaaaaattgaaacctattttgtaactct

SEQ ID NO: 57332 - DNA, 3047 bp, Oryza sativa
gggaaaaaaatttgaaacctattcggtaactctatatgtcacatgaaactttgtgcagattgtatccaattggtaatgccataattcaataatcttgcaaaggtgtatctcgttagtgtgagttaaatgttttgtgtgactactagagctgccttgttcctaatgaaacatggttgatttgtacctgatttggttgattgcaacatctttgtttccaaaatccggggcatacatgctcgccagattgtgtaaaaaaacagaagggccaatcccttccgtccatctcatcagcttttgtgaaaagccctttgacgctgtccaagcagaagggcgatccaggcggcaagttcaattgttttgaacaaaatcattttggaatgtgatagccagattctcaaacaagctattatgagcaatgactcccaactttgaggtgtcatttttttaggataccgaaagcttctttttgttaatgtttaatgatgtacgggtaacacattcccttgtgtaacaatgtgactcacttcatatgcctatgtgggctgtgtacgaaacaatatgctgtgtcttttatggattgaccggtccccgtcttatgtaagagaaaatccaaaatatatcattgacaaatgttcaattaaaaaaattgttatcgacaagtacaagttcttgaaatgttattatacaagcgactttatcctaaaaataacacacctaacagctctccgttaagtgctataggataaacaatgcatttaacgacgcgggatggacgaaactctaacggcgatgatattttttggacaaaatcgcttatatgatagtactttatagaactcacactcgtcgatagcatttctttgatttgtgtgtttgtcgatagcattttttagattctctttatgtaatgtgtgttggtgaccaatgacctaggctgtgttcttttctgcatattgggtgagccagttcctcaattaccatagcacgtttatcaaagtgttaattgttaaaccatgcaatctttaaaaacttttcatacgatttttttaaaaaataactaaaaatatcatttttcaaatttacaattgtcaccctattttgcctcccatatgttgccaatgatcaaatcatacccccaatcacaaagctaggtataacgactccatctttaaaaccggtgcaaatcaactcctacagtggttttggaaacggtttttgctgacttgacaatttaactatgaatgactcgcttcagtcagcgtgtgggaccatcttatcatcttccaatagcagtaaaggcagggagggcacatcggcctaggataaggaccatgtcctctatccaatggtcctgattgtattggtggagtgacatggtgaaatccccaagggggttgatagggtgggtagggagggtagtagtatggtgaaataaaaggtcgatgcatggaatttagatgattgtaaggtggggtgccttgccaatttggtgggaatggattgtgtggtggaattggaggtggtggtggtggcatggcaggaggtgtgtcaaagaatactgatgtattccattcaacattatgactctgtgttggagtggcatgaaccgttggagtgaaaattttactacccaaactagctgaagcggatgcatcccaaaatcagtcacaggcatcaaacaagaaatgttcctaaaatcaaaagcagacgcctttggaggaaacaaagcattgcctttagctgcctttgccttctgtgtcatcgagaaaccgacccctggtattcttgaagtctctcctacttcgattccctgacaactcttggacagccccaacatctcctgtatcactttcaagttttgcattacctcatccttatgtgcctgagcttgcatcccttgattctggatcagctcgtgaaagaacttgatgtcttcttcagatttcctctgaaactcctccaaattgattcaccacagctacccactccggctcctcctcaactacttgatccaccacctttgctcccctcaccatggtgaataagaacaaatccggagattttacaaagagaacgaatctccccaaccctctttgttcctactccaatttcgcctctaactaagttccttgacctggttacggaatttcacaggagatacttattctctcaaccctcatcagtcaagaacactcgatccacaggcttggtcaagaaccagactggctctgataccaaattgtcaggacccgagcctgaattcacacccaagtctgaacgtttcttcagatttggctagtagctacctatctgggttcggattggaagggaaaatagggaatttaacagtaaattgcaaggaatcgaaagtggtagccgcaagacaagtgaaagatagagttagggttatattcttgatacccaaatacgtggatttgatcggcttatatggagtgcgccactgctaggatacaaaatagctgagctcgcttcagtctcaagccattcccttttcggccacgattacagaaacaataattactactagcggctcttcagcgttggattcacatcagtgaaccggtatggagcaatctcagccgtccatctatcgcatcccctgttcccccatccaatacttcagagattagcaggttcagaattacagagttctaagttcaaaaaaaaaaagaattacagagttctctgaagtaggagagatggggttcaatatgaacccactgtatgaatagtactacaacgggaggatagaattttagggaattttattgcaaacttgatgtaagaaatggaggatgttagtggagtgccatgtgaaactcttgcaaaataaccttaagcgggtatgtaatttccttcaaattttgtgtttgaaacgatgccaaaatctactgattatttgtgctagctaactcaaccccttatgtcagaatagttacttcagctgctacattgcttatatgaatatcatataaatataaatggagaacgaattgtttttttttcctttttgttgttctgggggg

SEQ ID NO: 57333 - DNA, 1084 bp, Oryza sativa
tcgtcatacttgagaagttctggagatgggcaccaacatttcaagaaattggtggtaccagctattacattggtttcctgaattctgcttctgaatttgtaagataaggtcataagggaatttcacgatcaactgaacgttggaaccaaaacatcacttagttcgcattaagattgaacatggaagtgcacatatgcgaagcactagatcattggcatttgaactttgaaccagtatataaccatacaaagtagtgctgaacaattaaaattgtccgaaaagcatcatcactccaataggtatacaatgtcagaaaggagatggtgtcttcttgcattatcattgacaagctaatgttgtattcatgtttgcgttttcaaagtaataccataaacctaagtacctaactcactcttctattagcttgagatttttctaagatggaaatgattaaccattacagctgtatgttgatgagggagcactaagctatcccataagcaatagaacacctagaaaaacagaaataggtatgacactttcatgaagaaaacatgttatcctataaaaaccacatgagtaatttagagaacaacagggaacatgaacacatctaagttttgaagtaaaagtgtaactgtaatgtgagtgcaggtaccatgctacaacaacaatactacctcttgaatttcctatgggatatgattatgataatcttgaagcatccgatgcatatccaaccaaaagaccaaacctgcatatatgctggaaatattgtagttcagccttcagacattagagtcctttggagatgataccaagctttgcttctcctcatctaactcagctgtatcattatcagccttcccttgtttagctacagcctcacgctgcactgaagaattcccttttaatgtaactgattgctgatagagtaccccgccagccagagtgaagagcaagcaaaccagaccaaatgaactcgcatgcttatcccagatcataacattgattgcaactgtgagaaacttgttgacaacacctgttactgtaaaagccgtggcggagattgctttccttgctg

SEQ ID NO: 57334 - DNA, 6008 bp, Oryza sativa
cgaaaaccagctaaaaccgtttggcttccacaaatgactgaccacgggcagtttaaaaaaaccgatcggtttttgttaatactgctctttggtcactggtccaagtactggaatctgaggttcagcttcctgcaagatctttagttcttaaccttccacagctgccatctgccttccattatagttggatctggctgggatccggttgagtaagtccaggcagccctggagagatcaaactaatcaatcgtcaattttgtaattctacgcatggtgcgcaaccatagtagaaattagacccaactcccaagcagattttctgtgaccaaacaatattgttgggatgtgtgtgtgtatttttcccatttttctgtgggggaccagggctgtctatgtgtgcctggtcaagagttagctcatatattggactaaatagtaaaaagtatatatgatctaatggtgtagattgatttaattttttatttaattagattgcaatataaagtttgaaagggtaattttgtcttttcttggttattctataatcaaatcgtgctatcgtcacgtgctttgtcatcaaatggcgctcaggatgctcctcccctagtgcacgataagatccaggaccgggtactctcaattagattcaatttaaaccaaaaattactaaagtgttgttttattttctatcaaattcctaatatgcccttttatatactgccagtatatactggtagtatattgtaccgtaaaagttctctagaaattagctcttatcacagccattaaggagacaggtaaaaggacttgttgatttgccttggggagatgaggcatgggcatgatgataattaaaccaagggttattatgggtagttcaatggtaaaataagtactaaattgctactatattagaataaaatttgaaatctagatgctatattttgggatgaatggagtatttttctcatgtgaataattttctttttttgtttatttattcaggagggtatacgcattgaacgttgtcggtcagatacctgcagaattgcagaacctcacctacctaacttacttgtatggtatctagcttttctcggctctgccttgatgatgaactactgttggatatatactacatattcttaatatcttgcagcaagacatcaattcaaagtgaacctcatgtttgaaattcatcgctgctaattgacttgatgtttcttgttcttttcaggaacctggatcaaaattacttgtcaggccccataccatcattcattgggcaattgactgccttgacagaattgtaagagttgtactttaagttttcctgcattgtccttattagttagtgttttgtttgaatcatccttcttccttttgtaataaaaaaaaggcacgtgggattcaatccactctcaggatcacttccaaaggaacttggaaatctcacgaacctcaatttgctgtaagtgttcccttcttgcacagattaataatggtctaaagtatttcattatatggaaaaatctagatgcataagttctttctacaaatttctagaaaatcacaaataaaatttaagcaccagtgtaattttacttttcaaatggtgtcttataaatttgtgtgaaatccaaaatgtgaatattgtggatcaaaaggctcgtcagcacatacaatgctacttttctcaactagtagcattgcatgcacggaaattatatcactcttgagcttttttttttttcaaaggcattagtctgaccaattttacgggtgaactccctgaagaattgggcaacttgagcaaacttaaatatttgtaagtttctaaattatatcactcctgaaatatttcattttgtttcagaggcattagtttgaccaatttttctggtcaacttcctgaagaattgggcaacttgaccaaacttcgacaattgtaagtttgtaatccccctctttctaacttgaaagatgctacttctagaagaacaaagtttaatttggaccagcaagatacttacagttaaacatcaatgatttctgcattgttttaataacaggtatactgatagtgctgggttgagtggcccattcccttctacgctctcaaggcttaagaacctaaaactcctgtaagttcaagaaacagaaccacagtggtcatgttcattttgtttttatatgctcaacactaaacatgtttttatgcttgtaggcgggcatcagataacaattttactggaacaatacctgattttattgggagcttgtctaatttggaagatctgtaagatttattattagctttttaacacatcattgattttatccttaccacaagacaagtggaattgcaacagaaattttctgcaaatgttctatctattttaattcaaactgtagcatttttttttctgtttggtcatcacttttaagaaatgcgcatacctcaacagtgtcttgatatgtagatgttactttttcctatattctaatggaccttaaatctcccaacttttgtctttcttaaattatgaactcacagggctttccaaggtaattcttttgaaggaccgatcccagcaagtttgtctaatctaaccaaattgacaaccttgtaagtacttcgttcagtggcaacattgtcatcccctcttgtcacgataactggtgtactaaacacaaatgagcaggcggattggtgatattgtaaatgggagctcttcattggcctttatcagcagtctgacatctttggataccctgtatgtgacactttttaaattctaactatacatcttacaattttatatattgacaaagatataagttgttaataccaaatatttttttacagcgtactgaggaactgcaagatatctggagaccttggagcagtagatttttcgaagttcgcaaacttaacttttctgtacgtttttcattatgggtcatagcacagtccatgaaactttttggtaatttttcttaaattttatgtaagtgtctgttcaagtatgctgtcttctggcgcagggacttgagttttaacaatatctcaaggaattgttctaaatcaattctgaatctacaaaagcttatattccctgtaaggaattctttctgggggttattactatctactgaaacacatgttataattgatgaccacgtttcatcatcttgtcttctttccaactcaggtttcttggcaacaacagcctaacaggagaattgccagatgggataagcccttcgctaacgaacttgtgagtaaacaattcatccctgtaatacagctaaaattagaatgatgcatttatttcatgtttgcagagatttctcatacaaccagctcactggtagctttccctcctgggttacccagaacaatctgcaattgtaagaagaaagttctcaaatttgtgtttccaagggaaaaaatatgttatactcaaccttttattttttacaaggaatttggtggcaaacaactttattcttggcagcaccaacattgggtacttatggcatttatttgtacattcataagtttttactaatttctctctcaccacttttaatttcgagtcaactatctccacagcatgctacctccagggctaaactgcctccaggaagatactccatgttttcgtggttctccaaaatgtatatgtctcacttttcctcaaccatagcagctgatatattgggtcttgaaattctaatactattataattttgcacgtcatgactgcagattattcctttgcggtagactgtggtagtaatagatctatcagagtttcggataatactatgtacgaattggattccacaaaccttggggactcatcatattatgttacaagtcaaacaagatggggcgttagtaatgtaggaaaattattccaggccccaaatgacagtaagataatacatagtggtgagaagatccagaatgcagtggattcagaactattccaaactgcaaggatgtcgccgtcgtctctgagatactatggccttggacttgagaatggaaattacaccgttctgcttaaatttgcagagttaggttttccagacacgccaacttggcaaagcttaggaaggagattttttgacatatatatccaggtataaattgagtccattatatagtaatttgtttactgaatctttttcttatttatatcaatgtattattgacatttctacagggtgaactaaaagaaaaggacttcaatataagaaagatggctggtggaaaatctttcactgctgtttacaagagttacacaacaactgtgtcaaaaaactttcttgaaatccatctattctgggctggaaagggcacttgttgtattcctattcaaggttactacggaccattgatctcagcattaagcatcactccaagtaagcgtaataattaagttaacataaaaatgattgcattggattccaataaatgaaatcctctttcagattttagtcctactgtgcgaaacggtgtacccaaaaagaaaagtaaagcaggtgcaattgttgggattgtgattgctgcctcggttttaggatcagctatcttattcggaatatttatggtcataaagaagagaagaagaatggcaaaacagcaagaaggtaatagtttttaataatacaataattcagacatcaaaattttaatacgatttattgtttctggtgtgccctgaaaaataaatgtagaattatacaacctagttggacagcctgatgtcttcagtaatgctgaactcaagttagctacagacaatttcagttctcaaaacattcttggggaaggtggatatggtccagtctataaggttgtctatttccactaatttagtactatgcaatttcaattgatttgtttttaaatttaactttattgcaaacttgttggtctatgcttcgaaatatacatataactttagcaatgttcttctggtagggtgtgctacctgatggaagagttatagctgtaaaacaactttcccaatcatcccatcagggcaaaagtcagtttgtgacagaggttgcaactatttctgctgtgcaacatcggaatcttgtaaaattgcatggttgctgcattgatagtaacacacctttattagtttatgagtatcttaagaatggaagcttggataaagcattatttggtgagttcacttttgctcaaaaccaacacctacaaaattgtatttttcttcacatgctctttgggagaactcatctcttcattttgccatcatttagttcacagagccttaaagttatttttttacaggaaacggtagcataaaactggactgggcaacacgcttcgagatcattttaggaattgcaagaggcctaacttatcttcatgaggagtcgagcgtgcgcattgttcatagggacatcaaagctagcaatgtcctacttgacacagacctcaccccaaagatctctgactttggactcgccaagctttatgatgagaagaagactcatgttagtacaggaattgcgggcacattgtaagaacatttcaccatttctcttatatttgtaccttacaaacaaagctaacttaaacttatctaaccttttgtcaagtggttatctggctcctgagtatgcgatgagacgacatttgactgaaaaggttgatgttttcgcattcggggtggtagcactagagattgttgctggtcggtcgaacaccgacaattctcttgaggaaagtaagatctatctctttgagtgggtaagctgatttaacgatctttcaatataatccaagatcatattagttcattcattcatattatcttctagttactaaagatttgcctatgttaatttacaggcttggagcttgtatgaaaaggagcaagcactcgggattgttgacccaagacttgaggaattcagcagggatgaagtgtatagagtcatccatgtcgcactcatct

SEQ ID NO: 57335 - DNA, 3719 bp, Oryza sativa
acaataaaaagtcttcgaacttattaaattctcctgtcctcacttctcactatgatctttgactagctactttttcagatcacgtttagatcagtttgtggagccgtgcaggttgctggtaagtgtggatgattattctaactttccaagggataattggtttagtgacaccaaaagattatgtgtttagaaattaaatataccgtcgaaaagttgccgttacacctaaaatgcgtaatgcttcggtgttatcaaacaaaatttcccccttttttttctagataacagggtttttatatgtacaagtcgcagttgacatgcttgcatggatctcttccagctatgtcaccatcagttcttgatggggatgaattagtccatatgtcgtacaaattgtaaccttaattctccactcctctcgctatctagttggatacggaaatgataccttagcaacttagattacaatatctatacatcgatcatatgtttatggtcttacctcgtcttgcgacttgcagtctatggcgaagcaaggagtggcggccaaattggaccacgtgcgagcatctacggtgtctgatgttgatgttttatgatggtcaacacagactcacctaataacgattcgcagtaaaaacaatagagttgccaaaattaaaagatcaaaactagttagtggagtcaattttaaggttaattcactttcgtggaatcacaaaactaatttacgagtaaatcagaagagaaccatattcgtatttaaatgaccactagcttttgagcaaactagtaaaggataacctccttgtttttcaacataaaacgacaaagatcaacttaactctagggttgctagagcttaaccatgagaaagaatagactctcacgagctaccatcagagttcacaaaacctattggttttaatgaaaccgatagggagaatagctactttagtcactaaagtttctctgtaggatcagtttagtccctaaccttttaaatggtccaaagaaatccttaacctttatcataaggtctagaatagtccttgggtccatcaaaaatcatcatatggatatgccatgtcatcattcatgcaaaatctatgatgaattgaccaatttacccttacgtatatcatagaaaaataaatataagggtgaattagacataaccataggaaaaaaatacttctttttatcacccttttgaggtatatttttgctcttacatataccatatatttttttaacttattccttttttctccttttcctatgtgtaaggatgaattggacaaatcatatagattttgcatagaaaggtgacatggcatgtccatgtggcgattttggtgggaccaaggactatattagcccacatgacaaatttaaaggacttgtttggacaatatgaaagattaaggactaaaatgactcaggagtgaaactttagggaccatattagctattctcctaaaccgatatggttgttggtttgggaaagcaatatttgtacaatatttaccgaaagttgtcggtttacctttttttattttgttcagttttcagtaaaccggtgggaagcggttttcacttcaaaaggtaaaccctggctaccatacatgcactcgcaacaaatctacgcaatactcacatgagctgcatctcaccatataagtgatcagcaccaacacaaaccaaaaaaaaaaaaagactcaactgatcaacacatcaccatatatatcaaattaaacacggcagcctcatcccaactaatttcctttcctcggtggatcacaaattcctacacgcacaaacttaatttggtccctcaaaatgacgattgttccagctatcacaaataatttggcatttccatataaaactaattactagccaaattatgccacaaacatctaggggaattggagggcctgatgaaggacgagccatatccaccgtgaactcctcgccggccggagcggaaaagctccgcccggcacggctacttcttctaattgagtaggcaaaaacatctactggttgagatgaagctcaaggcgcgcaagggatcaccgagaagatgcgattgcgatacagcttaattagaatgtgcggccggcgccgaccaagtgctcaacgatatgtcggggctctggcgtggccgctgcgcttctcctcctcggtggcatggagatcctagactccgtgaacaagatcttcgttaccgcctctggcatcttcaatggcggcgcggcagaatcgcacccgcaggtggtgatcgacaccccacgccacgcacagccagctgctgggctgctcggtttgggctagtcccgggtcgaacacctagatggcaatgaacagtgtgctttgaatttttgtgagtaataaagagggaatttagatagagagaaagaaaggggataaactgcaaatgcaacagccaagatttgatttgaattacgagattgcaactgtgagtgcaaaatgcgccgctagaaattgggttttgatattttatttttaatattgatttaaacactccaatgacaccactatcgaatttaataatgacttatttgcacgacaacttattttcatagttgggttttttgaatttcatttggattattgctattttggttttagtattacgatggaaacaaaattaactttccaaaatagatttaaatacttaaatttaacttgtattttgtatgttacaaattgataattagctttcctttaattgggttgctcttgctgtagatatggtccaatttactcccgtaaactattttattgaatcaatcatctaaactatttttcgactcattttaccccctagctaagttcactttactggttaattacattttccttatttgtttctctttatacaaattatattttaagcttaaaatttttaaagccatagatgacaccattattaaagttataaaatagttttaaaatttttcatgactatttacttgaaatttaaaacctctacgtttaaattagtcttagtagttacaacctatgtaaacaccgattaaaaagtttcaaaataaaatattgagagataagttataatgtatatatcaataccacctaatttccctaaatattgagagataagttatattttatatatcaatccaccaaaatttcattgcaaaatatgacctatacatagatcagagacgaaaaagacaaatattgttagggagtaaggtcacccattttcaatattttggggtgtaaaatgagcccaagaaattatttaggaggttaagtgttccagtgcaaaagttcgaggaagtaaaattgactttttttttctcaatataatgagttaactttaatatatatatatatatatatatatatatatatatatatatatatatagtaaatttgtttggtgctccatggtgcccgggcatctttgttgaaattgagtatatacccaattcaaatgagtataaacctttttcaattacttaggtattaacattaactactttactaactagtttaaagcaagtttgaactgaattttgaacttgtttttgttagattttgattctaggtatatagcatccatacatataattagttaggtatgtaatcatggattgtgaaataaagttaaatttgagttgttttgttgataagtataggtatgaatcaaattattataacta

SEQ ID NO: 57336 - DNA, 2161 bp, Oryza sativa
gataagtataggtatgaatcaaattattataactaggtatatactcacaatctgaaaattgggaaaaatttgagtgattttgtgcattagataccatggtgcccgggcaccatggtgccccatatgagtgtcatatatatatatatatatatatatatatatatatatatatatatatatatatatatatatatatatatatatatataaaatgtgaatctcccactgtaatcttgtagcgggagattcacattatatatattcctcaactttgattttggactttttactttccatttggcttggagatttctattatttgagtttttcattattttgaaaatatcacgcaattatgcaaacatacatactcaaaattaacaaaaatgattgtatagtactttgtacgatattaacgaagatgcctgcacgcggattgacattctagttaaacaggtgtgataaaatatgtgtatgtcctataagcaatacgcatatctaagtttgatcacacttacagaaaaaaaaaaggtatatttatatcttataggaactgttcactactgaattttatcttttgtttctccgaatgtacaataaatctagtctttcatgtatgtatataaacttactgcattatatatattctacgttaccaatttcttaagacttttttacattatgtgagccacatgtaagctatatatagatatacatattcacctagatgtaaaaaatcgtggtccggtattttactgcaacccttcattagtatgaacacagagagagatgtcgttgttgttgttgcagtagtgtgcccttggccaacttgtgtgaccggtagttggtacatgtgcgtcaagtaggatgaaagaggacaaataatggagcaagatgaattgaaacattgatatgataagtcgtagaaaataaatgaagcatctaataataacttacgagtaaaaattttatatacatgtcatagctatttaaaagctaaagctggaaaatagatcatgatgaaaacccttaaattaactctagggtaagttttaaatttacattttatcagcagttgataaaccaatagtcatatatatttatattaattggacactccgaaaaagctctcacatcaattaaaaaaatatggccattagttagttggctcaaattattagaaccctatatcgtattaagaatttatattaaacacaatgtttaatagatttttaatttttactactgtatggactctttggatttcgctatcctacaacttgtatatatgaaattccacccatttgagctctcaatttagtagattattttttaattctgaaatccaaaattaataattagtaggttaattgcaaatgcgctatgccctagggctacagttaacaataggtgccgacaggcagtcatcgaaattcgaaagtgggtaatttaaaataatgatttccattccttcaaaaataaatattttctttctataaagctatgtccacaaatataaggattttttaacagataaaacataaggatttttgttatgtatctaagagcacattctataaatataaatccaagtgcatgtatccaggtgcgtagtaaaacatcctatccatggacatggacagaggtactgcttcatattttcagcatatctagagcgatcttattttcagttgattcattggatcgatgtcatgtcaaaaaggtcatgttgcatctttttttgattattttttccacggaaaatgatgtaatcttggaccactctctgtgacctgtgttatgacttatgactgtgctgcaaaggggagtatgaattattgttctcaaaactagagatcactcatgctccaggaagccttgaatttgtcttgatttatactgaaagtaacctggattcataaaattcttgtgttcgaagcgaatggttgaggaattatcgtttcattgagagagagatttcatctcagctagaaaagttaatacataaaaaaatgttgctagatacctcattgaagacagtttaacaccaatggaaaaaaaatgttgcaacatatacctcattttatttcaacattgcagtattaaaagaaatcttttatatatgctccttttaaaaaagcatcaagatgtacaagttttt

SEQ ID NO: 57337 - DNA, 1174 bp, Oryza sativa
aatagaagtcggggtactcaaaatcgttcatatgcttgacaagagagtcgagatgatccaaagtaaaccaaatacaagattattcgattcagattgaaaacattggttaaaagatagttcaaagcaaaacatcggtaataaaagatgatttaaagtgaaatttgctcattattatgataatagctcgtttgatttacgaggttggcgactaattaaggcttatttagttcccaaaataaaaaatttcacgcagtcatattgaatgtttggacacatgcatggattattaaatgtaggaaaaaaaacaattacacagattgcgtataaattacgagacgaatcttttaagtctaattgcgctatgatttgacaatgtggtgctacaataaatatttactaatgatagattaattaggcttaataaattcgtctcgtagtttcctagcggaatctgtaatttgttttattattagactacatttaatatttcaaatgtatgttcgtatatccaatatggcaacaaaacccaaaaattttccccaacttgtttaggcctaagtaatgcatggatagcaaagaccctatctcgcatgtggtatgtatgattaatttgtcccggccaaaattttgttttaacgcttacaaggttaatatcataagttgtagtacagttttagcaaatcttttggacaaaagcatcggccaataggaaaattgacatgcttgacagcagggaaataaactcatactttaactgtttagttgcaaatgcactatgtattgcggcaacaattaacaatggttgcagagaggccgtcctgcaaagcaggtaatttagcactaaaggttccatgcctccaaaaataaatattttctttccagaaggttatggtgtcgacacagtgtaagagcaagtgctgattcatatttcctgcacatgctgttttcacagttgattctttggatgtcatgtcaaaagatcaagttgccacttttctgattatttttcctacaaaatgatgtaattcactcactatgacgtgttatgacccatgactgcactgcaaaggtatgaattattgttctcaaaagactacttcctccgtttgataaaaataaacctaggggatatacagtttagattcgtagtattagaatacgtcaaatcttatat

SEQ ID NO: 57338 - DNA, 1725 bp, Oryza sativa
tcctctcaaaagctaatctcaaatcggctatatgtccttccataccatctattttgacaacaatatcatcaatatagatctctaagataatacctagcaaatcatggaagatcaaattcattgccctttgatacgttgcaccggtattcttcaacccaaaagtcataacaacccactcaaataagcctacaaatcccggacacctaaaagccgtcttgtacatatcctcctccgccataaagatttgattgtagccggcattaccatctaaaaagctaatcaccttatgacccgaggcatcattaatcatcatgtcggctataggcataggatactcatctttaggagtggctttatttaaatctctaaaatttatgcaaactctaatcttaccactccccttcttctccaccaggactatgctagaaacccactccgcataacgacatggcctaataaaccccgcctttaataaccgatcaatctcctctttgactcggtcatataataaaggattaaaacgacgaggtggttgcttataaggcataaaacccggtttaattggaatccgatgctcaacaagctcacggctaagacccggcatctcatggtactcccatgcaaagctattaacatactccttaagtagctcgattatcttaaccttataatcggctttcatttttttgtttacaaaagttggccttggtttagttccatcacctatgtctacttcctccaatggatcggccgatgcaaacccttgtccaagcttctccacttcatcaaaatcttcaacagtttcaccaatatcgttcttcgtagactgatattcttgcaccctcttttgtaaccactcaaaactagcctctttactcattatacaaatttatatggcttagccgtgctacactagccggctttacagagataggtacaaatctgccatcggagatactaataaaatcatagctagaaagatccctccccgataaacattggatattcccatgacgccactcaaaagtagcatcggccattgcaacctcagccgatgtatccgcttgcaaaaatttaacatcatcgccgtcccattggattaaacattgatgcaaggtagaaggcacacaacaattggcatgaatccaacaacgacccaaaataacattgtagttaccttgcacatcgacgatgaagaaagcggttggtagcgtcttgtttcccactgtgagctccgccgaaaagataccccttgcttccgttggttcaccgttgaagccattgagaatcatgttagtcttcttcaactcatcatcctcgcgccccaacttcttgaacaacgagtacggcacctccatccactagcatcctagagaccggcttcccatcaacatggcctttgaggtagagaggcttcatgtgacggtttgattcatcgggcttctcaaaaaccgcgtctttaggacctaatgagaattgagcaacctcggcttcatccatagcacaaaactccataggcaacatacataccatgttgatatccatgtcttcttttggagatgattcacttttatcaaccgattgttctattttcttctctacaatcggttttgccttctctatggatttaagcctcataccgggggtggtcgcaactcatgaaccttttatctttttgctcttcggccttttctccttagttcttgggcttgaagacgttgcaac

SEQ ID NO: 57339 - DNA, 3096 bp, Oryza sativa
  unsure (1)..(3096): unsure at all n locations
nnnnnnnnnnnnnnnnnnnnnnnnnnnnnnnnnnnnnnntcatcctcgcgccccaacttcttgaacaacgagtacggcacctccatccactagcatcctagagaccggcttcccatcaacatggcctttgaggtagagaggcttcatgtgacggtttgattcatcgggcttctcaaaaaccgcgtctttaggacctaatgagaattgagcaacctcggcttcatccatagcacaaaactccataggcaacatacataccatgttgatatccatgtcttcttttggagatgattcacttttatcaaccgattgttctattttcttctctacaatcggttttgccttctctatggatttaggcctccataccggtggtggtcgcaactcattgaaccttttatctctttgctcttcggtccttttctcccttagttcttgggctcgaagacgttgcaaccttctcttttgagtagccgtcaaatccttaggcatctacctaagattcggctctgttctaagaggtaaataaagtcctctattaaccttgcttggagacgatgaagccctcacatcggcctttgcagccctcttatcaaaccggcgctggagctcggtcagaccggctgtagaccaccggtcagacccgccagacgcgtcggtcagacgaacgtgtggcacacggttagaccggcctgaggcgtcggtcagactgtcgtcaggtcggcggtcagaccggcctgatggcccggtcagaccggcaatatggtcgcggtcagaccggccagagggcctggtcagaccggccgactgcgaggagctggtaccggcttcggattttttgcttggggactttccaactccatctccagaaggtataggcacatcatgggaccctattttgatagtaatcacctccgaagtcctttcttccaccttggtgcgctttccttccctcttctcttcattaacccgatttttaccataaaatcggcttttgtttggcgaagacaaacgctcatgaattggcctccgtggtcctccccatccttggttgaattgcattggaggcatatgattgtacattggcggcgttgccccccacggcctgaagtgaggatacggataacccggcggtggcattggataagaacctcatgacatatattgtggatgaaaatatggaggtgaacgcgatcgtcttggtgaatgaccaaatcgctccctaggaggtgatcttggtcttttccctttgttgtgatccctctcaccaccttgcttctcacacttctccaaaaccatatcaaaggttactttggtcttcctaagagccttagacgttgaagctccacccttattctccttccaaacgccaacctccggcttctttggcaccatcatcttaggccttggctcaccaatgaccacttcctttcccttagtagattcggcttgctccggccgaatcaacacctttttatcattgaaattaattgtattcaccggaaaaggatcatgatcaagcttcatcttggagccatcggtgaatttcaatcgtccttcatctatggccgattgaacctgtcgtcgaaacaaattgcaatcattagtagagtgagaatgagaatcatgccacttacaatatgctcgacgtttcaactcttcttgtgatggtatgacatggcctttaggtaatctaatttgtttctcttgcaaaagataatcaaaaatcttatacttggccacctcaaaactatatttaacttcactttgccgatctttgcgaggagtcggcatcaggttagaacaaacaaaaggcttatttttgttagtccatgaccattcggcaacataaatatcatgatcaccctccttctcactatcactagcctcagggtaatcaattacattaacattaggcttttatcgaatggtctagcaaattttttattatccttaacccggctttcttgagccagagccctttgcatgagttaactaacatcaagaaattgttggccatctagtttttctctaagaggagcaactaaaccattaaaagcaagaccggctaaatctctatcagttatattcaaagtataacatcggtttctaacatctctaaatctcttaatataatcaacaacagattcattatacttttgcttaaccgatgttaaatcacataacctaagctcagtttccccagtatagaaataatcatgaaatgttcttctaattgagcccaagtatgaatagaatttgccggtaaagaaggaaaccatgtaaaagcattaccagataaagataaagaaaacaagcgcaatttaaaagtatcactattagcctcaccacattgcgctaaaaattgacctacatgctcccatgtggtcttaccatcctcaccactaaatttggcaaattcgggaactctataatttctaggaaacggcacattatcataataatcgagatatggctttttgtaagctctagcacgatttctagtttcgatcccgaatccattcctcataatatcgctaatcatatcttccatgttattaggcccttgtggatttggtggtaggtttggtggtctaataggttgggtttgtggcgcaatatgattatattggccttgcctagtatcgggaagatatcccctagaaacatcattataaatgttaggaatatgtgggggaacttgaggattagtggtagcagtagatacaggaggatcaaatgttctaaagtggtacaaataactagcattagtcattggatgtataccctgtattgggacaattgcgccggtctgaccggcccaaggcccggtctgacgggcgtcatgttgcgcggtcggaccggcctgagagccggtctgaccggtgggataatacccggtctgaccggccatctggccagtcggaccgacggctgtatcacggtctgaccggccatcaggcccggtcggaccggtcgtgaacaccattccgctggttttagaccccattggatctataggagattgatcaacannnnnnnnnnnnnnnnnnnnnnnnnnnnnnnnnnnnnnnnnnnnnnnnnnnnnnnnnnnnn

SEQ ID NO: 57340 - DNA, 3352 bp, Oryza sativa
tggtttttacaatgaaccggccttgtcccttatataggggttggtcttgccctctacaggccctcctccacgtccaactcggggtagaaaccaaagaaaacccgaaacatgccttccggaacaaggaaacctcgaaacccgacgaaacagggtcggactcggacctgctggtcagaccggccacataccgccggtctgaccggccctcaaccggcggtctgaccgcccaacacatggcggtcagaccggcccactcggaggaaaccggtagatttctaaattttggcaatcttttttattttaatcctagatactaaatttgggtgtaaacagtatggttcatttgttgagtcctgtatttacccggacatatacgtgcttgatcgaactaatcacaaatttgtgatgtggcagcacgttaaatttcctcgatcaaaactcattaggggggtcaggactcaggaggcaggccccgaccacgcagacgtgcgcgcgtcggaaatcccatcgtcttcctttccgattcctctcttcctcccacgtggacgcacacgttttagagccaaaccgagcgaaacaatggtttcggctaaaaattagcgcgtgcaagcgaacgcgaagcggggcgctacgctaaagcggaataggataatactagaaaataaccgctgctttgccgcgcgttagtatatataggccagctcaattggatgaacccagtacactgttaattatgaagctaggtaaatacgaattgatcataactaaatctgtatatccaaaacaaagggctacataatcacaaaattttacattcaacttacccaataatgcatagtggcttaggaatggtttcgattataagtagtccaacatttttcattgaacaccctaaaaattagaatcagaaatagatataaatggtttgtacactttgaaaaattgaccatatcaaattttagtaatgtcgaattttgacatattttggtattatcgaattttggtaacattggctttgtttggtttgatgcctttactacattttgatgcctttaagagagaacttctggaactgccaaaattgagtaacattgtaatagttgaagtgtgtttactaccaaaatttggcaatgctaaaattcggtaagattgaaagtggcaacaaacttaaacattccccaaatcatccttccatagtcttttccaattccctactttcctattcaagaaaatcagcgtgcctgttggaaaaccaacttatagctagtacatatttacttatttaaaatagttattgttgttgctgttaagagtttcgaatgcaatatttttttttgaaaaaatatatacacttgttcatttagaagaaactatttaatgacttttgaaaaggttgaggaacaattaacctgtagtaaccatattcatgtaaagattttaagctttgttaaagcattactacggaaaacaaaattaaaaaaactttattttcttttatttgtaatacttgtctatttactttcaaaccttttcttgtgctaattaatctattagtgccacatacttacctctatggtcagtatatgatattccctccatctatatttatctcacaatatagagattgtcaggctgattagctaatcataggtaaaatagaatacaattagagcaatattggccctgtctggatcataggtatgttaatctatggttaacggatgattactgtagcatcactataacaaatcatcatagattaatatacctcgttagattcgtctcgcaaaatagtctacaggttatggaatgggttttgtcagtaatgtacgtttaatacttctaaatagcaagattccggaggactatttaatagcccttcggatccaaacagggccattgtcaacaattagagtaaatatggttagtttatgcatggctaattcttatgtgtcgtatttagttaactgtatttgtctggtgaataattatatttcaactttttaaaaaagatttgtaacggatagttaactactttaagtgtatctgtatgcctttaacaaatactactttggaagatatttcttttaaattagtaggatttacaaaatttatcaaattacgtgaaaattacaaaatttagattgcatattttttaaataaataactcctatcatccactcaatatagagtcataataatatgttactctttgtacatcagaccaaacaagtcttgaaaagtcaaaacttctaaggtcctaaacataaatactccctccgtccttaaaaaaaccttagtttccgtatccaacgtttgactatccatcttatatgaaatttttttataattagtatttttattattgttagatgataaaacatgattaatactttatgcgtgacttatcttttcaattttttcattattttttaaataagccggacggtccaacattggacacagaaatccaaggtttatctttttttaagtacatgagtactaacctaggggtattttttttaaatattttgtactccctccatctacttttgatagacatatttccaaatcttaaaatctatttttgataggcatatttcaatccacaacctatcatcttaatgactttctcaaatttaatgtgtgactctccattcttctacataagattggctacataggcatcgagaaatgtaaatattaatgaatcgtttgtttacgaggaataactagtagtatgtttaaatggatgataagtataattatttatccttggtctgtgtgccaagatgaaatatgactatcaaaagtagatgatggagggagtatttagtaaagtataggataaaaaatactattaggggtgaaatggaaatttttttaggagttgatggcacgggtaagttagcaggtggccattgggaattgggagcagtgacgtgctccatcctccatgcatgcaaatgccccgtcgttccacctatgcttttttttttgagagcccacctctgctttcaatcccagttcactcttattctctcgtactgcacctactgcgctactattgttgtggcttgtgctttccagcatggatttgggctgagaaagaactgatggatgaggccgcttgcaaatgcaagaggtaactggcttctttggtcactgggttcaaggcttcttcaagctggccagctctgcatgcatcacggaggcagcggaggtggcgtacgtggtccaacggcagcgggttaagaggagccatcgggctgaccgccggccgtcctgccaccaccagttccgttgtctccgcctccgatctccggcgacgagctgataggtcccggtggtg

SEQ ID NO: 57341 - DNA, 1182 bp, Oryza sativa
ggcgcatctggcggcgtcgaaaagtgtgtgcgatggatttggctcgggcgggtcgccgaagccggtgcgcgggtggtgaggttctgcggggagggaggagcaccagcgacggcggtgcacggtgagacgacgattgctcgcgaagggtcggagcaacggagccggtgagtacagggaggagtggtgccgccggctgctttgcacagatgggtttgggagttcgccgtcgacggcacgggtgttctgctgcttgacatgtttttttcttttttctttttgtttttggtagccataaatttgtgccatatatttgtgtttgtggcaatttaatatatgctaataagtgcacacaactgcattgaataaaaactttgagataccgggttaaattcaaaagggtatagatggaacttccgtcttgagttaataccgtcatattgccttcacggaatagggtcaagtctcatattcgtttataaaaaagagggtcaaatgagaaaactcgaaaaagtatggccaaattagtagttagtcttaaaaaaaagataaaaacgcaattgccccatataaaaattaggagtaaagtatacgggcggtccttaaacttgtaggggtgtgtcatctaggtccctaaactcttaaaatgtatatccaagtcccagaacttgtcatagtgtgtcatttaggtcccaaatcgccacaaccccatcaggatcctacgtggcattgatgtggcttgccacgcgaacatgacgtggtattattttgactgacaaataggacccatttaaattttttcttttttcttttcccccctttattctcctttctctatgacctgagcagaagaaaggaaagaagaatgagaagaaaacagaaaagaaaaataaaaataaaagaagaaaatgacacgtcatgtccacgtggcatgctatatcagcgccacataggatcctagaggggatgtgtcgattcgggacctagatgatacactttgataagttctaggacctgaatatgcattttgagagtttagggaactatatgacacaaccctataagattagagaaccaccagtgcactttactcaaaaagtagtaaatgtattttctatacatcacatcccgggattactttctacgtatttcgtttagtctgtcctttcctaatgtatctgatcg

SEQ ID NO: 57342 - DNA, 1270 bp, Oryza sativa
tttcaccgttcaacatttggtatctcaagggactacaaatttttttgtacctctaagtactttctagtgcaaaatttagtactttgaggtaccaaatgttggatatagtaaaattgctcttctaagaaaaaaaatggaaaatggtaaagccgtaaatgaaaacgatgttagaaatatcagaaaaccggaaacataactatatagatggaaacatattggtatcgttcgaaaaaattgaactgtagaatcacacacacttaactttgcataactttctaaatataatgaaataaattttaagtttgtaataaattacaaatggtcgtccatttaagcttatacttgagttaaaaatttggttgagtagtcgatgagcttctaaactacgggtcaaataaagaaatgaatcagtcaatgagcttataaactatgggtcaaataaagaaatgaatcataaatattgatgtataaaaagtagctacttttaagaacattgatgcatttagaaatatagtaattaccataatataaaaaatagtaattcgtaagaattcggcaaaattcagaaatagttggtattttaataatttttaccattttcatttttgtttttgttggtaaccattaatccatattgctcagttggtaaaagtagagacgagggtcgattagtcaagaattttcgtggacgttttcacccctatatgtacataacctatgggaaaaaaaaggaccctatcaagttcactgaactattattgagtttcctttcggaggcttaaaagagtttaaggatcaaatctccatacagcctttaattatttcacctcatcccttcttgtggcaagcatatgtgcctatgaacccatgaagttgtcctccagccaacaaatttcatggacagtttttactattttgctgcagaatgtgctcataaacatgcgaatacgttgattaatttctaagatatatactaggatactactctatttgacctgttacaaattacaaggagtaaatacttttatcatcatacatacttcagaataattaagttccactattagctccgtcttacatttacatacaatcatttcaaaccaagatcacctgcaggttgcagcattcaccttccatcatgactagatccggtgattgttggcgacatggtgagagggtcgatctccttctgcctgctgaactctgaggtggtagattctgagttggtgctgtttccatctctatattgccactcagtgatgtagctcgg

SEQ ID NO: 57343 - DNA, 830 bp, Oryza sativa
  unsure (1)..(830): unsure at all n locations
annnnnnnnnnnnnnnnnnnnnnnnnnnnnnnnnnnnnnnnnnccaaggaatttactaatttttctattaaaatttgttcaacaagttcatactctaatgattaagccctactcttaacataatcctggcttcgcccctgcttgtagtgattgggaaaacaaaaaaaaagaagagaaagaacaaacgttgcaagctgcccgtggacgagccgctcgacatgcctcgtcgacgagatgctcgctcgccgcccaaatcgtcgcgtgctggcgtgcagctgccaaggccgccgccgccgcgagctcgcgcactgccgctggagctgctcatacacgcgtgctgctgccgaggtcaccgcatggtccgcatccgcgcccctcacctgctcgcgcgctgccgccgccggagcgcctccttcaccgcctggcacctgctcactcctggccgcgttgggatgcttcgcgcagccgcggccgtcgcctgatgctcggtgcgtcggcccgcctagagcaacccaggctctaggcatctgctgctcctcgcctcgccccacccagccgccgcgccgctgccgcagccgccatgtcgttggtttcagaatgggggagcgggtgaatggtgccacggaatgggtataatggtccatttctactttctttacagtttcatatattcttttcacactcttattccaggtccaccaaacgatctgagcgtaaataatagcttcatttaaaaaaagtaagagcaaaatcacaaactctagaaacaaggggtaaaattacaattgcttctgaaagtaggggcaaaaatacaattatcccatcaatta

SEQ ID NO: 57344 - DNA, 2697 bp, Oryza sativa
tcacttccactcttcctctgccactgaggcacatagctagcccacatactcatatccccctcactcatctcggtatcttcagtaagcatggagccgtcttttgacatcggtgggcgttgctcaggcaggcccacggtgcaaaggagaataatgttgatgacacgcacaacctcttcctcgtcaaatcttgcaagtttagggtccaacatttcaagagtctgacttcgctcatgtagccgccaagcctattaaaatcagtttagtttgatgatttgatgtttaaccatggaaaagtacttctcttaatcaactcacccatccaagcagatacttcttatcatcctcgaggctctcatcaaagtttggccttcctgcaataatctccattgccacaacaccataagcgaagacatcagccttctctgtcaagtggcccatcatggcatactcgggtgctagataaccactaaaggtaagaaaccaaatatatgatcaatgatcattttttttgttataggtcaattaaaataatatcatcaggagagtttcttacagcgtgccagctactcctgtgctaaggtgagtcatgttgtcctcataatgcctagctagcccaaagtcagagatttttggattgagatcaccatcaagcaagacattgctggttttgatgtccctgtgaactatccttgtgctggactcctcatggagatatgctaggcctcttgcgatgcctacgcatatgtcgaagcgggttctccaatctaggttcatatttgtcttgcctacaagtgaacttaaattttagggaccttggaatttgctggtggtgcatattttattattacagaagtttaggaagtcgagagaagcaaaccagtagcaaagatagtttgatcaaggctcccattttctaggaattcatagaccagaagtggtgctttgctctcaatgcaacaaccatacaacttcacgaggtttcggtgttgaacggtggatatagttgaaatttctgtcatgaactcccgtttcccttgatgagatgttggagataattgcttcacagctaccattcttccatcatatagcttaccctattcatggaagatatagataacaattcaaaatgatgaatgaaattatgcaaattttgctacatgacactaaaaaatgctggtagacaacgtaaagacgcgtcggctgaaagacaccctaaaaaaccagtaatttgctggaggacgctttcggctcaatatgatgagagaaattctttaaattataaagacaagactaccttagggccaaaagcattcgagttgaggctagagtgaatatggaatatgatatatgctagcgatgtatttgggtgatggcaaatttagagttgtatagtttcaatttttcactccaatgccacatttgaagcatgtggccctaggggcattctcgtcattttgaagaatgtctctcttccagtgttcacctagtcgctaaacgctagtcggacggccacctactgactagcgactaggctgattaggcggcgactagacggattaggcaaattagacgttttttctatttctttcacacaaaaatacttattctagacattcggtacttggtaaatataggcatttaggcaaatagcataaatcatagttaagttcagaaatcatcaagtccatacaacgcactgacactgcacacgaagcattgggtttagtacaaatctatagggatagcgaacacatcagtatagccactgtacatgcacatcataattcataaatcataactttatagatctgaggggctagagctaggagagaggaagaaaaatttatctggaactggaagaacagaggaggtgaggtggtggaggggagcctgatcccctgatggcctgatttagggttggcgtaggctgcttgagtggtttcgtgcttgactgcttcaatcggtgtgtttgccaccttccattgatggcaaggatgaaggatgggagggagagcaggagcagcagaggagggggaagaacgtggagcagcagaggaggagagggaagaacgtagcggcacggtggaagatcgatgggcgcggcaacggagtcgtcgctcgtggcggtgtgaaaaaggggtaggcagggattgcgctctctctccaggctctcaaataaggcaacctaaatccccttctataccgagtcagtcccacgtggtgcttctaaattttatcatgcccaaattttgatttctatcacctagtcgccacctagacgcactgtcccgttgtctaattgcgcccaggcaccgtcctgtccaggccgtccaggctgcctaggaccgactaggaccatctaggcggtaaatcgactaattcactgcctaaggtgtaaactggacaaattgtcgctgaccagcgattaatcaccgtctagacgggctaggtggctgtttaggcgaacattgctctcttcaatcgagccgaatgttccatctagcaaattacctatttcttaaggtgtctttaagccgtgacacattttcgcaatgtctacctgcaaattacataaattttaagtttctagtagcaaaatttgccaaattatggtgtaactgatcatgtagagtaacatacgagctactttacaccaataattagattgaggaatattataagatagaatcaaattgt

SEQ ID NO: 57345 - DNA, 1126 bp, Oryza sativa
  unsure (1)..(1126): unsure at all n locations
cagtaagtaaactaaaaagggatttttttaatataaaataaagctgaccttgtaaacaaggccatagcccccccttcctagaatgttatcctggctaaagttgttggaagctgattttatttcaccataactgaagacatctggccttccaactacactgagaagctctgcaaaatccttcacattgtcagacaaaacaagggaatcatataaggctatgtttagttcacgctaaaattgaaagtttggttgaaattagaacgatgtaatggaaaagttaaaagtttgtgtgtttagaaaaagttttgatgtgatggaaaatttaaaagttcgaagaaaactttggaactaaacacggccataaataagtcccactttttccaaagagtaaacagttatgtaattttaactacctcccatctccgcctccatttttttccttttctgtctccaaagaaatgtccctgtggataaaaggcctaaaactatagtacagacaacaactccagctaccaaagctattttacttttaccagcactgtttttaataggaccaggatcaaccttattgcctgcaggtcgactctagtaggatccccatgaaacaaaatagatgttaattataagatgatcacatagaaccaatggctcttgatcaagttaggtaatgaacagtaccataaggagatacacttaatgctgagattaatggcccgtaggatccctgtctaggaatgcaacaagttccttttccagcccagaaaaggtgaatctccatgaaattttctgtaactctaacaacatactgcctcaaaacaacagtataagattttccatttggttggttctttatatcgaaatccttttctctgagttctccctgcagtaaattgaaaaataaaaggtgtgaatgcacaagaaaacgtgcaacataactgttgcacactattaaaaggtatacttatttttcaaaaataacattcgttggacctttataaaaaattcacctgaataaatatgtcgaaaatccttgttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57346 - DNA, 916 bp, Oryza sativa
ctatattgttgaacatgctaattactatgtttcaataacaggtatattgatagttctggcttctctggtccattcccttcgacaatttcaaaacttaagaagctgaagatcctgtacattcaagaactgagccacagttattatgtttattgtgtcttcatacactcaatgctatatatgttgttgtgcttgcaggtggatatcagataatgatttcacagggaaaatacctgattttattgggagcttgactaacttggaggatttgtaagatttttgtcaacctcttaacataatcatttattatatcctatcaaggagatgaatagaaatcttgcaacataacttttctgtatgtattcttttcatttgaattaagagaacaacgttattcattttttagtcctcaacttcgacataaatgctacgttatgaataaatttacattttctttatctattcatgcaagatgttaaaatgtatatcttaaggtggactttacatcttcctaatttcttaaagcatgaacttgtaggaggttgcaaggaaattcttttcaaggtccgatcccagcaagtttttctaagttaaccaagttgacaagcttgtaagtattctgttctttggccacatttgtcccttgactgttgggaaggccaaacttgtcttaatagtgccaaatacacatatgcagacggattggtgatattgtaaatgggagctcttcattggcctttattagcaacctgacgtccttaaatgtcctgtatgtgtcctgcttttaagttctaacgatagatattattgctttttttattgcaaagtactattggagtagtattttctgagacaacatattctttgtttcagaatattgaggaactgcaagatatccgataatcttggagcagtaaat

SEQ ID NO: 57347 - DNA, 821 bp, Oryza sativa
ggatctgtatgtcaacaattgtcgtttgtgtaccctggctggtcctggacagggatttaatgcacattcagcttagaaattctggttcgtgaatttctaggtgtgacacaatctaaccaactaagatggatgcactaaaccaactgagagagtagtagttgcttgtttgaatgctacacccaaccgtatttaatatggacaaaataggaaacaagaaccctgcttaatgacttcttggttttcgaaattgtgtccgaaatgactaataaaaccaacccggagggagtagcatggttttgtattagcttagaagtgaagatttctagtatttagtatttaggattaggcatatctatcagactcacgtaaagttgatggacggtaagcggacttattcctaggagagatcctaggagagatgttcacgattccataaaagcgaagtgcggatcccgcacgatgtgcctggtctacgggccaaaaaccgtgtggtaaccatgaagctgcgtagattagcaatctcgcaatgtttgtaagcatgtttagctgtagattgtagattttagagaaccactgtaacattgtttataccttagggtatctgcatatacattgatttgtggtctgaattcaaagaaaaaaaataatatgtcgatttagataaaaacatggttaaattcatttctggaacagtggcatggcactatgctagaggagaaaattgacatttagccatcctcgggttggggtttcgccagaatgccatcttcgaatgtggtttcgttataatgccatcttcaaacgtccccatcttgccacac

SEQ ID NO: 57348 - DNA, 877 bp, Oryza sativa
ttttcccaactactccctccatccaaataaacaaacttatgattagacgtgactaatataataaatatggatagattcttagctatccagattcatggtaataggatatgtcagtcacattaattttagagcaattctacggtccttgagtaggtaccatgaggtaccaaaattttagtgtaaaatttggtaccacctcatagtacctaggtaccacgaggtaccaaatttacaatagaaaaaatggtacctcatggtatctcctcaaggtccgtaaaattgatcttaattttaggttatttttttaagatgaatggagtatgttaaacataaaggtaattagcatgttaccatcatgggggcactgcacgctggtactacgacacttgagctagctagtactcccatcgacgacctgagggttgacgcgaggtgtgcatgcatgtgtcatgctatcaaattaattaacaaagcgacactacatacggcgtacggctatgtttggccgcgtaacgggagtggttagttgcaggggagaggctctctctggctgtgttttgcatagcataactatactttctttatgattgataaacactaacaaatattagaagctaatggctaacatgtaaatcgatcagctttacatatcatcattcattaataattagtccgtactattttagagcattttaaatcttatgcaatatacgtagagcttaatatataagtatgtcaaatcatttttctcacatcattttcacaatgtttcaaattttatcatttctataatatttaacatatattcatccataaatttcgcagcaaattaccacggggtgtcacgtagtaaatatatagatattactctgcccgt

SEQ ID NO: 57349 - DNA, 1724 bp, Oryza sativa
cacatgcatccgggcgtgttgatcagttactccgtttgtgctttttttcagtgtcaatgcacatatatgtagtatcgatttgttctaataatatgtttgtaaaaaatatatatattggaaatatagttatacatagcttgtaaaaatttgattctgccatccgttaggatttatcaacattctttggaaactattctggaacatgtaacttttaccacatatgtttactccggcaaaattggatttctcacacactatttggaaagatcgataaagggttaactaattaatatttatatcaactagcttaatgcccgtgcattgcaacgggaattaaaaagggaaccaactgtacattgtaaagcctaaaaaattaaaaaaaaaatatttgcatcgtaaaataaattttcattgtttgatggcttagggttgtgagactgtttgagggacccacatggtagtggactagtggtggtgggtggtggcagattcaccaccatcaccattggaatattttaaaagagtatggagtatagatactccacatcttgaattttgaagtactacacaactttcttcagaagcagtgatccctcttttgccatagactgaagatctttgctgcaagaaagccattgcccctcgtaggactgaggtccatacaaccttataactgtcacttgattcatttgccattcattttaattaatttatgcaatgccaagcatctgtgattacggaagtgtgctctagccaacaaattcgtcagtcatttctcaaaaaaaaaatcaaaactaatttaactaaatgaattttaaagcacccatgcaaatacaactggcatatacaaattaccaggatgacttggttatgagtatggaaaatattcagaacaaaataaatccatatatttgttgcaactccacaatgtccaaaaatatcacttgaagctaaaaccagaagcgatttgaacatatttgcattcaccttccatcatatgtgactccggttatcgttggagaaggggtgagtggggaagtctccctctgctctctaaattcaccagtagtagatccagagctatagttgctgcttatatagctggtgttccctcctctgagttgccactcagtgatgtagctcggcttcgtcaccatctcagtcatctcaatgtctccagtaagaattgccaggaccctagacattggtggtcgctggtgtggcgacccttgagtgcacaaaagtgcggcatagatgactctgaaggcttcctcactgtcaaactcatcgagttttggggctacgattctgattcctggctctctttcatatagcccccaagcctagtatcaattatcatacggacaacgtgttggatgtgagaaatagaatcagccaatgtatttccttggatgcaaagaccattgatcaacttacccattcaaagagatagatcttggcattatcaagggaattgtcggtgtttgatcggccagcaactgtttctagagcaacaactccaaatgcgaaaacatcagccttttcagtcagatggcctctcattgcatactcgggtgccagatagccgcttcaaaaggtcagacgagataaaattagcttagacttcaaaggtaaactcataagaaaagaaagggtgaaatgtgcatacaatgtgccagcgattttcgagctgatatgggtctccttttcaacatagagcttgg

SEQ ID NO: 57350 - DNA, 1154 bp, Oryza sativa
actatgcgctcaatatgtacctggacatatatgtcaaaaactctccttccgatgctttgccaagtctttgtgtctggataagcaaactctgcaaattgaagaagaacagtgtaatttccattctcaagccctaggccatagtatctcagggacgatggtgacattctggcagtctggaacaattctgaatccaacgcattttgaaattgttgcgagctgtacattaggtaacttccatttggggcctcattgaattttcctacattgctgataccccatcgtgtttgccccgtaacatattatgatgcagctccgagacttgtagcatcagcttcgtacacagtattatccaaacctctcacagatctattactaccagagtctactgcaaaggaatagtctgcatgcagttaagatgaacaaaattataaccttttattgaaaatcctgagatattttcttaaatgctaaaatcgatgaagagtgcaaaaatatacattccggagaaccgaggaaacaaggagtgtcttgctgtaggcagtttagtcctgaaggtagaatactgggcgcataccagaaacaagaattaaaattttgaggaaggtgacgtcaaaaataaatatttgcaattatgtaataggaaccaatggtggttgcttcgaatattaaattggttggccccaaaatccctggcacaaaaaaataggtctaccttgtcagccaatattttcacataatgtagagagtgtctaaatcaatatatatttgtctgaaatttcagaactttcaacttacagttgtaaattattattggtagcccatgaaggaaagtttcccatgagttggttgtacgaaaaatctctgcaaaaagcctaggattacgaacgtatgaaatgaatatatcattgcaatgctgaaaatcattttagcatacaaattatttagtgaggagctcttcacatctggcaggcttcctgtaaggctattgttcccaagaaacctgaattgagtttccattcaagacgatgaggcatggacattagcttaagatgtatttctataacagaaataatcgccataaaagaattccttacaaatatcgaaggctgttcagattaaggatggactgaggaacttcgcccgtgatattgtta

SEQ ID NO: 57351 - DNA, 4305 bp, Oryza sativa
  unsure (1)..(4305): unsure at all n locations
gggtttcagtatattaaacacactaggaaaggaaaatgaaattgaaatgattaagtaacatgagaaatcgtggaagggatatcttacaatgagatgagatttgtgaggttcccaagttcctttggaagtggtccagataatggattgattgctaagctcctttttaaaataaaacaagaaagaaagaaagaaagatgattaagagaaagcaccagcagatattggatggtacaaaaatatataacttggaatttaactcttacaagtactgcatgggaaatttgccaaagaatgatggcacaggaccagtcaagtaattttgcatcaggtttctgaaacaacataagaatcgccaagcaagttagacagagtacaaaaaggaattgtatacctgatttctgatatctatttatccgtgttttgtctggcaagtgacaattgaatgttcaaagaatgggactgaattagtatttactgcagaaacatcgttcaacagattgtgttcgatcatcaaatgttaagacagacatgtgttccgtcatcaagacagaggcataaagagttaggcaccatacaagttagctagatgggtgagtttctccagctctgcaggtatctgaccgacaacattcagcgcgtacaccctcctgcataaacatcatcagtaaaattcctctgatgacaagtaaaaaaaaaaactatatatgctttgctaaatgaattaggtgatagttatccaaattcaattcatcgtcacttgatcccagagcattcctgcaaccaccagcatcctaattttggaggatcgcatggcctctctctttcagtcaggcaatgcgtcgaacaccttgcctgcagctgagacaagaggtttgagttcaggggaggatacgtacagcttgacgatgcggcagacggtgttgttgttgaatgtgcagtcgcacttgatgccggggttgacgatggggttgttgtcgatgtcggtgtcgtcgacggcggtgccggtgcaggggtcgccgccggtgatgttccacgttttgggcggcttcgttccccatcgccccagaatcgtgttcagcgccgccactgcgttgacatttgcacacgaatccaatcaatttttttaccttttattctctccgttttatattataagtcgttttgatttttttacaactttaactaaatttataaaaaaaacatattagtttttttaaaaaaaaaacttattatcgaaatatattcgatcttagatttaatgaaactaatttattatttttaatgtttctattttttctgtaaatttgatcaaacaagtttatctacgaaaaaggtcaatttttaatgtttctatttttttctggaaatttgaccaaacaagtttgggtagaaaaaaagtaaaaagactttaatttgaaaggaaggaagtatgtgtgaagagaaaactagcaaaaaaacagaggcgagaaaacaacgtcagaaagagagaaaaaattgactttttaacggtcaccaaccacaccaaacagaactcctctcctccattagtcaacaaaacagaaacagcaggaagaagcaaagatttggatggtgtatcaaacttgaacttgatcactgaacttggaaaacagaagatgtctgatgctgttcatcgccgtaatgatgaaattcttgctctgaactttttcttttactgttcatcacaaaaacgtgggtgttctgacctttggtcttctcttcaatttaaaaaaaaaaaacagtaaacggccaagaaaggaacgaattaataatatccgaggaatccgaggattaactctcactgctaactgctaatttgtctctaagctgttgcaatttgcaagttgcgtcaattatatccatgctaaatgctacacatcaactcatcaaacatgtagtaagtttcatgtctctctaaagtcgcaaggaaaaggaaagaagatccaggcccatctctgaacctcaagaattagagacccctaaatattacagtttcaactgtaatctgttgcaagttgcatcaactgtacccatggtagatgctactacaaacaaggaagcatcatcaagcatgtagtagtcataactcataagccatgtctctctgaactccgaagtctcaaagaaaatggaaagaagagaggaacatgcttgtgtgcaaccatgaaaatctatgtcttttctccaagaacatctctccagcagaaaagaacagcggtgtctctgtaatctgtgaatgcatgtaattaactgataaatacatatatacataccttcgactggatcagttgttgctcctgccggcttctgagcctgagctcgagctactgcaacccatgagcacgcgatcaccagccagcacaggatgagctgatgaccaccatggccgccgctgctgctgctgctgcagcgtatcctcatcatctctttgcctctctgtgtctctgtgtcacgttatctcgctctgatcactctgtcggcctgtctgtctgtctgtctctctgctgcctaaaaatcgattcttgtgacaggtatatatgtacaaattaatgtacttttatcagcgtgtgtttctgggtttaatttagtgatcgatcacatccaccatcatcatatacatatcgatcgggaaggacgacgacggggtcgtccgatattttttttccaagaggcgaccttctgtggttatatcaatcggctacttgcaacccatcgttgtggctagtactgttgcactggactctaaaatgtacaccccggaagaatgacgaggtcatcgtccaatctctctcaaggacttgtgcatggctgggtgggtgccaatctcggtcctaaggctcagccactcaaccttgctgggacacagggccgtcccgtgaaattccggggccctgtacatatactctctccgtttcacaatgtaagtcattctagtatttcccacattcatattgatgttaatgaatctagatagatatgaatgtgggaaatgctagaatgtcttacattatgaaacgggggaagtagtggataaaccaaataacgtacacattaagggcttattcgtttctaagaaaaaccaaaggatttccaaaacagaggatttgaatcctgtatacagcattcggtttacaggattgagctataggaaatttgaagggaaatttccttttgtgccagctgtatcggtaaaacacaggaatttttgcatccagtatgacctcttgaaaattttcctggcgcgaaaagagcgcgccacgagcgcactgcgcgcgtaatcttttcgctctcacgacaaaaaaggtaggtaccgctgaaaggaaaataaaaaaaatcacaggaggcaaacagactcgcatagaagccatcgcctttgatcccatctcctctaccacttcctctcctgtctccacgattgggtactggacctcctctcccacatcgatcgccggcaccggatgcaccttcgccgcctaggtgacaggacgcaacggcaacaacgggaagagccacggcagagatcggcaaggacgcgttgattgcaggtttggtgcctcctcttccgttgttatgcatagatctgatgccccatgctgcttctttgcatacaccttagcatttgggtcgctgcggatggggtcgtagctgtaacacacaagggttcatagtgtctgcccaatggcaatcttgtttggttcagagaagttgttgccggcgggcggcggcgatgagcagcaacaagtagtaggcgagctagccctgttcatagtgtctaccgtacgttctgccgtacctatcggctgccgctgccatctgtttgtctacccctctgtcggctgctctcatcctttgctgtggtgtactgtggtctgctccttgattcgtcctgtgcttcagcgattgaccgctctctcatgatgagtattgaattttagggcttattcgttttaaaggattttttcattcataggattaggaaaaatgaaggaatagagatggttgtggagttcaatcctatgggaagctaaacctcaggaattgaaaaaaaaatgtgcattcggatacaccacaggagaagtgtaggaaatctgccatttgaaatatatttttttaagtttgcatcaactgacatcggccctcaactagctgttagctttgaagtgcataaatagccctcgttagccttgtgcaccattctcccctgttctttctatttgctcatcaactgtggannnnnnnnnnnnnnnnnnnnnnnnnnnnnnnnnnnnnnnnnnnnnnnnnnnnnnn

SEQ ID NO: 57352 - DNA, 1122 bp, Oryza sativa
gtacgttctgccgaacctatcggctgccgcttccatctgtttgtctacccctctgtcggctgctctcatcctttgctgtggtgaactgtggtctgctccttgattcgtcctgtgcttcagcgattgaccgttctctcatgatgagtattgaattttagggcttattcgttttaaaggattttttcattcataggattaggaaaaatgaaggaataaagatggttgtggagttcaatcctatgggaagctaaacctcaggaattgaaaaaaaaatgtgcattcggatacaccacaggagaagtgtaggaaatctgccatttgaaatatatttttttaagtttgcatcaactgacatcggccctcaactagctgttagctttgaagtgcataaatagccctcgttagccttgtgcaccattctcccctgttctttctatttgctcatcaactgtggaagaagcttgctgatcctttgttcttctcttcactatctgcataatttttccagaagctttactcatcgtctagccaccatagctagacgttacttgctcgtgtaacaacaaggtactgcttgttcatctggtgcaccaaaattgttttttcctcagcaaaagtcttgatttttagctctcttctatgtgagttaacagcatcagtttggtagcatctgcacaccatgaatcctagctaccgacgtatatcagaaagtgatgatgagttcattcattttgttatgcctactttaggagattcatcacaatcatcttgtattaggagaccaatgcacacgtcaaaacttacagggggttgccgtgtacatgagattttaacaggacatgaaagattatgcaaaagaaacttccgtatggaggtcgacatttttcatgcactagtcaataagttacgtgagaaagagtacctaactgacacaatatatgtttcagtagaagagcagattgctatattcttatatacagtggcaaaaaatgcaaccaatgaaacacttcaagattggtttcagcatagtccagatacaatacatagatatttcaaagcagtgctggaagcagtcacaaatctcacatctgtctacattcgtgcaccatccctacacccaca

SEQ ID NO: 57353 - DNA, 1763 bp, Oryza sativa
aaaaataacaaagaattaaatggacagctttacaaggctgtatggatcataattatgcaatggcttgcttgcagtgaagatctaatctacagagaagaggggattgctacttctgacgaactcaatgtttgtaacaaccaaaatattaatacccatcaaagccctatataaaaagagatacgatcagtgatactatgtgtaaaacatgtacgatgaccttagtaggttgcttaatataacattattaaacaaggttggctatatcttgggggacagggggagtattaacttctaattaagcaggtgtgtattgccaaaaactttattaatatttagacaagattgttgtttagaaaaataatattcagacaagatacttgctcaaatgccatcctctgtcactatcaatctacatatatatttgttggtgttatgaaatacctaacgcgcgttccattgaatttgtcaaaacataactaacgttcaagcacaatgtccagcaaattataataatactgacaattagtaacaataaattaaggtactgcagtccttttcggtgtttactagagccaaatccatatcaaatccaaatcaatcgccatctttcagaagagtatgttggctcgagtaaataaatgtttgagatagtactatattttgagtaaactagagccaaattaaaataataccgacaactattagcaaggtacttccgtccttttcagggttaacttcaatagtacaacatccaaatatatcccatataatccaaatcagtcgccctctttcagtagagtacattgtctcgagtaattaatgtttgagaaaataaataaataaataaaataatgtttgagaaacctagagactttcaattaaatcttttttttattttttaagggccgctagctatcaagatttctcaacacttatccgttgatctatgtggtagttacatagatgttgtagcccaattggtactagaaagtagaaaccacagcattagttgtccacttggaaaaaaagtaatctcaaatttaattatttagattggttcaccaaagtaggttgctacatatttatagagtaaagttggagttgtacatatttatagattgcggacatataattttcacatggttgctacggcatttttctaaaattcctgcgtgcgagtcatgtgaaccgagtacataaacagttaaaaacccaaagaaattaccaatcctacgaaaatccattcaaaagcccaatggtcaaactagaacaagaatgaccaatacacgtactaattatctaattattgactcatatagtaattaacatggtactccataatttagctagcattcaataatcttcctagggtcatgagatttcaggaaacacaacatagatatttcactgaaaaaaaccctatgaacctaatgagcctatagtcaactgttggtagcactgcttgttccttcagctagagatctttttgtcgttcatataggcacaagtcatacaacgagagttcacatttagatatgtatggtcaaatatgaaaatcttgaaataaaaaaagttaagattcattatatacaaacaatattaataggtttttcacgaataataaggaccctatatatactttcactaatctttataaatatacgattaaaaagatatataaagtctataagtgtagtaaaaattgtgccagtactattctcgaatcgagacagagacaaaaagtgtagagggagagtatactt

SEQ ID NO: 57354 - DNA, 840 bp, Oryza sativa
acatagattgtttactagtattaacaacaaaagaacatactggacaacgatccgtggtgacctcgagttgatttttttttcttcaaaaaacggacagattggattgaggctggcgccgcacctgcttatgcatagtcatatatatatgaatcaggggcaaaaaagaaccgaagccgaatcaaatgcaaatcaatcgcgggacgggacacaattgagagttgagaggctattcgagtaagcatggaaacaaattaaatgatgggctggaaatcttgccggggatcggcctgtcttggtgaaatgggcagcccatgtagaaagaaaaggcccaaattcgggggaagaagtttagaggcccaaaatagcattgcagcctggactgaccattggatcggaccgaccgctttcatctgtaagggccgatctgcggcgatcacgaccgatcactttacacctccatcatctcgctttccacgggaatgaaagggagatatttaacaatggggcaattatattcttacctctactttcgtatgtaattgtgattttatctctcttttttagtttgtaattttactttttttaaacaccggtttacccctactctgtgaagatgacttagctgtgttcttttcccctctttcccaactcgctttcctcgttatttacgcacacgcttttcaaactgttaaacagtgtatttttgaaaagatttctatatgaaagttggtttaaaaaattatattaatctattttcaagtttttaggctaatagttaattaatctcactataatttttaggctaataattaattaatctcactataaccacgtactttg

SEQ ID NO: 57355 - DNA, 789 bp, Oryza sativa
catgagtatggtcctataacattaatctgcgaagttgagagtggctcaacactctcaaaacatgtaaacgaaagacaagaaaaacaaaggtaaaggtactcctctcaggattgaaaaatttcgacggacttccaaatagagattttttcgttcgcatcactgaccagctgctccggccttttgaacctgtgttcaaacactcttctgtttcgctcttttcagaggagccaacacaccatcaagaagagtgaatcgaacgccatcttgtagcttgtccgaaaatggcgacgctcctgctgccaccaatctgcgagcagccagtcgccatggcccggagacgtaagtccaccctaatccagtcccgaagcaaagaccaaaccctatattggtgtaggcacattggtgaactgcaggttgttgcagtcctcgaagatggcgttacagagggcgcaaagctgtttcgtgtggccacttaaattcagatttttacaataccattttaaattttgaagtataaaccggtccctgtaggttttccaaaaactagcaaaaagttgatatatgatttttgatcagttctgtataaaagccaggtaaaactgctcggattcagaaaccggtgtccaacgttttcatgaaaaccaataaaatttcatatagttttcgatcagcattgcaaaccttgcataatttcatctctactggggacatccatgtgtccaggccggtaatctatctagctaggtcaggggccgggaggagctcgtctacgcccgtcattttcccaac

SEQ ID NO: 57356 - DNA, 914 bp, Oryza sativa
  unsure (1)..(914): unsure at all n locations
nnnnnnnnnnnnnnnnnnnnnnnnnnnnnnnnnnnnnnnnnnnnnnnttaggctaatagttaattaatctcactataatttttaggctaataattaattaatctcactataaccacgtactttgttggaatattgcccttccgaacacagccttgacggtgtcaactcggttataaaaacacatatacaagctttaacacttgcccatacttttctaacaagatttgtatattttattaaatttaacgaaacactgatagatttttgacaggattttcacaaacttgcaacgggtgcaaaaaaaaaaatcttccaaaagtattaatcacattcaccataaaaaagatcaccaaataaattccttgtagtcaggggcggagccaggtgtggagcaacttgggcccgggccccacacctggcagaaaaaataccaaggaatttactaatttttctattaaaatttgttcaacaagttcatactctaatgattaagccctactcttaacataatcctggcttcgcccctgcttgtagtgattgggaaaacaaaaaaaaagaagagaaagaacaaacgttgcaagctgcccgtggacgagccgctcgacatgcctcgtcgacgagatgctcgctcgccgcccaaatcgtcgcgtgctggcgtgcagctgccaaggccggcgccgccgagagctcgcgcactgccgctggagctgctcatacacgcgtgctgctgccgaggtcaccgcatggtccgcatccgcgccccttacctgctcgcgcgctgccgccgccggagcgccttcttcaccgctggcacctgctcactcctggccgcgttgggatgcttcgcgcagccgcgggcgtcgcctgatgctcggtgcgttggccccgcctagagcaaccaaggctctaggcat

SEQ ID NO: 57357 - DNA, 1376 bp, Oryza sativa
aagtgcaagtggatgcacgcaggttagagttgcgtggaagcagtagcgctaggtgcgagtgcacaagacatcattggtggcaacggaagaaggaggttgagctatagcccactcggggccatgcaaccgagctagaggagtagttccagcaagcgacaacccaagaaccaagcgtgtggtgggtttgcatggagcaacgaggttgttgcgacggggctttacgccatcctcaaccacattatcctccatgccacacccgtccaagccgttgagtgcgtcagtgactccgactcccacaccaccaccggtgccatggccgttacggcaaatgacacctattcctgttgcttcgtgacaaaggtgtgtgctatggcgcccatcgacatggaaacccacctcagcggcctcctccaagtgggtgtgcaagtcttgcagcgagcgtggcttcaccgtgttactcctcccccatttaactattcatgtgcgagcgagatagagagatgatagacctgccaatatgggctcgagggtattcgatcaaaataaatattataatgggtgcagtgtccatgagctaatttccacgtttagagattatcttccatcaaaaatcactttgtgcggtatccaacattaaaaccatgaagccataatatcatgtcgaaaaatttgaggaaaaaaaaacaccgtctcactcattggcctattttttcatacctgaggtgcaattgttgcaaacaatgtagaactgttgtgacctgaatttgttcactgactatacagaacctccgctatacaaatcaaggatgctgttgtgggagaaaatatttatgttgtagttgcaaatgtcgtgcgatggataaagctgtttgaacgtgctagaggaattttgaaggaattaagatgtttcttaactagagagaataagagaataaggtttgctatagacttctcaagtgaatgttaataaaaggtttaaattttttctaaaaaaataaaaggtttaaattaagctcatgcttgaaatccttcaaaaagtggaggaagggaatatttccctcttttcagccactccattccaagatcatcataagagaaaaaaaaactcatagggccaataaaaattccacctatgttttgttaattccaaactcaaaaaagcacgcacacaaaattggtgacaaatacatttgcaaactcctacaaaatttgctgtacccatagattgtttatgtttcaaatgtaattggtcaggaattacagaccagatattacaacaccatgtgcatccagtgtttgatctactatacatggaagaaaagaaatacacaaattgttctaaagtaagaaaaattaggcaaacatgattatatgaa

SEQ ID NO: 57358 - DNA, 888 bp, Oryza sativa
  unsure (1)..(888): unsure at all n locations
nnnnnnnnnnnnnnnnnnnnnnnnnnnnnnnnnnnnnnnnnnnnnnnnnnnnnnnnnnnnnnnnnnncttacaatcttcaaatacctcaactggaataattgcccaattgcggtcacatcaactctttcattgcctcctgtcccggtttttcccaagtgtaatatcaacactcggatatacttagacagtggcaacaaagacagggatacagatactccaaacagctgaagtgatctgagttgcaacaatctaggagcaggtgttcctgatattttggtatctcctgaatcaccaactctagagtcgaccaataatcgacggactttgaattcatgttttccagacaattcttctagattgtatgccacgcagataaaattatcctctgcacacctacttaagatcaaatcaagcatcatatcatgtactctacaagaaactacctccccatatttggtttcttctggttgaattaagcttctattgatcagttcattgaaataactcttagcaacttcctctgaactccccccatggaaatgatggacaaagccttcagccagccattgtctaatcaaatcatccttcttgatggtgaagtcctcaggataaataccaaggtataggaagcatgtcctaagatgacgaggaagatccttgtagctaaggtgtaaaatttgcctcatcccttccaacgtgggatttgtgccagacccccaggtgccaatagaattacgaatactctcccaatattctttcttgtgtggtgcaggctgattagccaataggctagcaatggtaatgattgcaagtggtaaaccgctacattttttcagaatctgagcggaaatttctctaaattgggaagggcagccatcttccgagcc

SEQ ID NO: 57359 - DNA, 1879 bp, Oryza sativa
tatttgttgatccgcatctgtcaaccactttataacctgttcccttgggccttcaatacccacaagattagcggcttcactgtacagtgctggcaaccgaggatcaatggccacaaagctagaactaggagtgtcatctagatcaaatttgtacctcttgtgccgttcatttatctctattagctgaatcttgagatccttgatatgctcggcagtctcaagacgggccctcaaagttctgagaaagtgagaaaccttatcgatgaagccagcttccacatcaccacctcccacgtggtgcacaaagtcatcgatgcaatcttcaatatcatatgccatctccctgacctggttcctccaagccttcaccactggatcaagttcatctgcatcctctagcttctcgagtagcgcgctcatggttgggagctcatctttaaggaacacaatattttttgacatgcctacgagattggtgcacttgtcctccaccagcttagtgagcttctcaaaaagggcacctatcacacccttagatgcactcaccgcggtttctgccattgcccctcccaaatattttcctctgcaaatacggaagcaggttagcaagcatatgacaatcgactggttctttaacaaattgcaactggtttggagcttagctcaccggctctccttgaattcgactaggaagcaccagatcaggttgaacccaagcagccagcagcagagcaaaccagcattttcgaagcagaaacctaataatcagacaaccaagaagaacttaaatggaagaaattgggagaattcgccgtgaaggatgaacaaaatcaccatcctctgtgctcttcacttcccttgaaacagtccctgacttggctgaataagtcttcagtggagagtacacatgatgtagacccaagctgggggttggtgagcatcacaaccacaagttttctgaatttctgtaagctttatgatctttgaccagtcctgcctgtctttttttccttgatctacactgaaacggttaaatttgatgatttgacactccatatttgttgccgcttcgatcatgttaacactcttgacaataacatgcgggtccatctgagttggttacagtgggtcacgatgtcgaataatcaaagcccaatttgtggtgtcaaaatatcaaatctctgaggacagatcatgtgggtgattcttccatgaaagctgatcttaagaggattctctggccagctggctagggattggtccgctccattccagaaactctaatcagcgatcaatcgccctggctgttggctagcgatcaccctattcccccctccctccctccacctggtttccttttttagcaccgtattactttcctattttagtaaatttatgtatctaaagtttatacacctcaagtttacacatctaaagtttagagaccaaaagtttataagtcaaaagtttatatatccgattcaaatttgaatttgaattcaaatattttttatatatataatatttatatacatctaaagtttatacacctaaagtttatagatctaaagtttatagacctaaagtttatagacctaaagtttatatacccgttttaaatttgaatttgaattatatctgattcaaatttgaatttgaattcaaatattttctatatatagtagttctatacatctaaagtttatagatacaaagtttataagtcaaaaatttacatacccgattcaaattcgaatttgaatttgaattcgaatttgaattcgatttcgaatttgattcaaatttgaattcaaatttaaatttgtattcaaattcaaatttgaatttgaattcaaattttttatatatagtatttcta

SEQ ID NO: 57360 - DNA, 1909 bp, Oryza sativa
  unsure (1)..(1909): unsure at all n locations
nnnnnnnnnnnnnnnnnnnnnnnnnnnnnnnnnnnnnnnnnnnnnnnnnnnnnnnnntgtgtggtggagagaagagggggaacacacgcgctcgctcgcctcgcctggcctgggcaaggcgtagatgcagcctccttttgcagttttgttttgctgcaaattcggattcatttttgttttggaaacattccgaaaaatccggtgcgtgaaaacggcgtggagtccggataagttacgcgtgacttatccggttcggttatgcgcagtggagatcgtgcgggcgccctgatcaagcgacccttctctatataaaccgacctgccgtcttcacgcaacgcacgcaaaatcaatctagggtttgcctcctactctatgctgcaccgtcgctcgtagattactccatcgcgctcgtcggcgtgcactggcgatcgggagagcaggtctcttgaacctctgccttcgatgtcctgcaccgagagaaggcgacaataaggtttttgggaagcgcttagcgcgactgctccctgttcgtccgcgacggctcgtcttcctcttcgctcgcgtgctgcgcgccttcgtagacgcctgcaattgcgaaatgttcttgccgagcagccggtctttctaccacctcggtacgtgttcaatatgttgcgcatatttgatctgttcatgttttactgcttagtttacatgtgtagatctaatgatgcgttaatgctagtatacatctgcaatgccatgatttatttatggaatatattaaattattatatgcctataatctcaacagccccaagtgcaaaattaaagctaatccaattatccaaacaagctaagaaatggatttaaacccattctgaaaccgtcgtcaaaccaaaatcaaaattggatgctgttgcctgcttgctgatggccacactaccaagttcaacggccgcggccgacgcgttgcctgccaaacagatgcagcacgacacggcaaggcgaaggaggggggcgagaaacgagggcaaggcagcgcgcaccaccgcgttctacccggccgccggcgcggggtacacgacaatgaggtcgaggtcggagaaggccgcgcgcggcgaatgggatggacttgggggcggccgccgtacgttctcctcgaagctggcgtggaggcggccggcctcctgctccgctgtggcttgacgtcgcggtgtgacaccccgcgcgcgcgcgcgcgcgtggcagcggtagatgagcccgcggagacgagctggaggaaggtccgccgccggggccgaggagtggcgcgccgttcttggcgacggccgatggccatgcccgacgccggagttccgaatagaggagaatgagatgatttgggggttaaggaataagtctattttgcgtccccctcctccttttcttgttttcagtggtggcacccgcatggttgtcaagttgcatgcttgttgcattgggagtaataaagcaccgcttctcgtctaggaattcctgaaaaatgggagccttcatcaaactaccttcgctactagtttgctgcttttgggacttcgcctattaatatgcaccattagtaaattctatggtgcctattacataggtccatgtgtaggctagacgaacataaaccgatcgaacaacccgcttcgatatatgcgtaggcatcacaagagacctagtatgtttcacaacgacgtgaccgcaagattgggagcgaggcctcgccctcatatgcctagagcgaaaatcaaagggaagaaaattcccaaagatttagggacaaggtagggagaccgttgggccggatttttagactaaaatcattaaaaatataaattggaagtggattagaggcactattgatgatgctcttattgagttattggtagcgtttaagcccttc

SEQ ID NO: 57361 - DNA, 1160 bp, Oryza sativa
tgataatgagattgagtcaagtggaaccataaaattttttttcttgcttgtggtgacagtggaacctatgggtgtgtaagagcaactccaatagagtggctaaatgactggccaagttaaattttagcaagtatgggagaaaaataccctccaacagccggatggctaaatcgcatacttcactggtcaaacttggagagtctccctgcctggctatttgtgggacccaccactccctctcccacccatctatctcccccggcttgagcacgctcgtgaacggcgacggcatgaaccgcactgcacgacagcgacggccgacggcacataggagagaggcgccggagccagccgcgaccgacgccgtcgtccgcgccgaagcccgccgcgaccaccgtcgtcgttcgcgccggagctagccgcgacctcccctctctgccttcgatctccggccatggccgcgcgccgccccggatctcccgctcccagatgggcgccctagctcctcctcaccgccacggtgctcctttcggccgcacctccatcgtcgtccccatctccgtcatcccctccctcttcgtcgccgtcccgatctccaccatcgtcgtctcgatctccgccatcgtcgtcccgcccaccaccggatcccctaccatcgccagcatcgccgccttcgtccacagccacatttgtcgccgcctttgcccccggccatccaacggcgcgaactcggggaggagaggggaagaagaacggcgccgtcgctatccactgcgcctcctccgtccaccgcgccgtcgccatccaccgtgcctccgctctgaccacgccgacaccgtccaccgcccctccgcctcgtggcctctgccgtctccgcaatcgcattctacatccgccgtcgctgtccaccgcgcctctcaaccgcgccgtcgccgtccaccgcgcctctgctccgaccacgccgacaccgtccaccgcccctctgcctcgtagcctccgccgtctccgccatcgcatatggggagaaaagcgagagagagggggagaaagagtagagactgacttgtgggtcgttgtcatagactcagagtagagagcgtggatagagatgttgttggagtaatctataagtttgactctccaaatcaattggagagttg

SEQ ID NO: 57362 - DNA, 6487 bp, Oryza sativa
tacatccgccgttgctgtgcaccgcgcctatcaaccgcgccgtggccgttcaccgcgcctctgttccgaccacgccgacaccgtacaccgcccctctgcctcatagcctccgccgtctccgccatcgcatatggggagaaaagcgagagagagggggagaaagagtatagactgacttgtgggtcgttgtcatagactcagagtagagagcgtggatagagatgttgttggagtaatctataagtttgactctccaaatcaattggagagttggctatataggtgtttggagagtccgatttgggtagtctgttggagatgctcttatgaataatagcctgaatgaactaccagttgttttctgtgtcaatctgtcaaactgaatatatgcccagcttcacgcattcggataaaagatgaactgaaaccaacacgaattttgtaatctgtcaaactgtcaaactacttgttgtgcattttctgcacatgtgctagagcacaacagcttgataggtttgatacaggttcagtttcatgtattgcaatatattgatggcaaatatgtctcagataagaagctcttgttgcagttcagattttggcagcatgtacccttttttactaaattttggcagcatctacccataacaagagcatacaggttaagattaaaatgttcacaatacgaaaataagcatgtctcattcaggaatacatcaagtatagggacttccagcaagtacacttccacggttcatagttcacagcttgtttggccctcgtccacgatgatgacggcatgatccatggcggcggcctcaacggagatgggatcaatggcgacgacaggatcaacggcgctcgcccgctggtcctgcacagggtctgtcgcgttggaattcgaaacgtcgcgcgtgccggactccaaggcggcagcggcacgttctacaccgtgacctcacaacgggagggtttgcgacatggcggcggtggcgcggcgaaagggcgcccgcgagtcgctggaaggcggcggggactcacgcaggcggcggcggcgaatcgtgtgtgctatagaaatgaaacgacccggggagggcggacggacggagctgtgattaggggggatttgcataaaaaacaaattagtagagatgagtgagggcggttaagtgcaaaagtaacccacctctgtccctagagctgggacttgggccgtgccgggctagcacggcacggcccagcgtgcttcgtgccaaattgggccgttccggcccagcacggcccacttgtcgtgccgtgccgtgtcagcacggcctcttcaggacgcggcccaagcacggcccaatggcccgacgggcctattcgtgccaggccggcacaagcacgacccaaaagacgggagcaggccggctgcgctaagaagaaactctggcggcgacgcggcagcggtggcttgcggcttcgtcgtcccgtcgcggtgacgcggcagtgacagccacgcccatcctgctcctcctcgtcagctcgtcgcggggacgcagcccaccggcgtggcggcgtgagtcagccaacaatcttgccaaatgctagtgctggcctgctgggctgatggccttgctggttgctgctacgtgctaccgatgagccgatgaagaaaacgagctgctacttgctgctacctgctggctgcataggaaatttgaccgtgaatgggtgatggctgatgacctcgtgctgcagcagccattcgcgtgccgtgccggcccaagcacggcccagtggtcgtgccgtgccgcccgttgtgcccgttgtccaggcccaggcacggcccacgtacgggccgtgccggcccagcccatttacggtccgtgtcggaccgtgctttctatcgtgccggaccttcgtgccttgggccggcctgataaagcacggcccaagtcccagctctatctgtccctagccatcggatgggcatcctgtggtcttgattgaaagtttgtaaggttgcacaacaaccctgatttgcaccggatacggtgccttttttaatttgctcgtacagtcgtacgctagctacaacgaaacaagcaaccggccggagagatactgtagctagctgatgatctggtccgttcatcaacaaaatagatggctcctattgcctgcagtatcttaacttgtagtccatgtacaaactgcatgtgatcccaattcgatactgtgggctttcaaaccgcgcgtcgttagcattagttatgcgcgctatatcccaacgtgcgtaatttatacatcgatccaacaactaggtagcttagacatcgctctcttcgtacgttaatgtatttgagtatacgagagtacgagatacgcatgcatacagagtactacatctacagttgtcatcttgtcaatctgagtcttgtcaactacagaattaactccctctcatttatattattatgagttattttgatttttttttcgcgttaaactttttttacgtttgattaagttttattaaaaaaaagcaacatttataacatttagtttcattaaatataacttgaaatatgttttgatactgtgtttatgttgtgttaaaaatgttactccctccatctattttttatagtcatatttcatcttggcagatagaataaggataagtaattctacttatcatccatttaaacatgctactagttattccttgtaacaagcgattctttaatatttatatttctcgatatccatgtagccaatcttgtatgaaagaatgtagagtcacgccttaaatccaagaaagtcattaagagtatagattgttagattgaaatatgtctatcaaaaataaaatttttagatttggaaatatgcctatcaaaagtagatggagagagtattatatttttctataaatttggttaaacttagaaaataactaaatctctaatattataaaaattgaagatatttttgccggtatttttggtatgtcatccgtatataagtcggttattaagttcattcacttttagaaacacaaattcatattttagtcggtttttaagttagttcgtttttggaaatatagaaggaatcatataaaaaaatctctttaaaaaactcgcattctaacttaagatgatcagacttctaattgtagcacatgattttctaacaaaaatatatatattcaaatgaatttaatataatgaatttcaccttaactaaaccatataataataataagattaaaatagtctcttcatccgttacaacgtacggatatttttctaatgatttatagtaggaaacggagagcgtagtaaacaagtcaagcaggttgttgcccagctagccatgcatgcgtgtgggactaatcttattttgttttctcgaagaacttctcttacttaattgaccagagacgcatgcatgcacaattagtactagcagctaggtagtagtggaactggtcgatccaaaactttatgtcgcattctgtaatgtagacgcatgcattcaactcatggatggcgtttactgcttcgcgctttcttcctctataattcggcgatggattattcagatttgggcacaagtcatatttggcatcgatccctgaccgatgtatcgatcctaggatattcctgatacttccaaaacaattgtcactgtcgacgagtcgtcagtcgatgggatataggagtagtagggctgtgtgcatctaaacttcagtccttttttatcccatcaacctgtcatacacatataacttttcagtcacatcatcttcaattttaatcaaaatccaaactttggatccaactaaactcaggctagatgttatgtgaaactcaaaactaattaacctgctagcaactccaattactgtgcagtgagaaaaactatgcatatctgttgatgacctgtacactcttggaactaattcgtgtattgtaagatgtgttgactttagtcaaagtcaaactattttaaatttaactaagtgtataagcaaatatagtaatatttataataccaaattagttttattaaattaataattgaatatatttttataataaatttgtcttgagttaaaaatattattattttttctataaatttagttaaatatgaaacagttttgatcaaagttaaaacgttctgaaagctgaccactgtgtagtactaattaagtacagtactatggaaatcggcgaaattacccttatactagtaattaacaaaacaaggtcaactcgacaccagttcgatcgtcatcactgtacacgtctacactactttctggcgttgattaatcttccaactaatggcattacaaacacatggtgccgttcgattgattttctcgaggtcctcttcacctggagccgccgctgctgctcctacatatctgtcgacaagcaacttgctgctccaagttgcgcatccatttgtgccgacgacagatcgatgattttatcagcttatatatgtacatgcgttgacagacatagctacatagatttttaaggagaggagagaagacgacgacgcagcagagagatttttcaggatgatgaggaggcgctgcagcggcagccatggcaggcagctgctgctcctgtattggctggtgatcgcgtgttcttgggttgcagctgctcaggctcagcaagctccaagaactgatccagttgaaggtatgtgtatcagttgaaacgtgcttttggattgaatatatacatgttcattggtctccgatttgcaaatatgctagctttctctccattttttttcattgagtcttcagagataggaagacagattagagatatgtttgatgttgttttgatttctttttctcttttcgccggatgagagatggaacgtcttcgatcggttcattaagatttagaaagggtttattacatgtgcatcagcaaaaatgttgccgatcttgaagagaaaatagcactgcagagttgatcctggtggcttattaattcatttcttctctctttttttggaagaagaattattttcttcttggctgtttcttgtccctttccttcaattattttttagaccaatagtcagaagcgacctcttttttcatctaaaaataaaaataaagagacctgttttatcttcgacgaaaggtcagttatccctgcttctgttcaaagcagagttagccggatcgtttgttccacgattttcttcaactctataatgtactccctccgttttaaaatatttgacactgttgactttttaagtacatgtttgaccgttcatcttattaaaaaaaattttgtgaaatatgtacaactatatgtgtacatgaaaatatatttaacaataaatcaaatgatatgaaaagaataaataattacttaaattttttgaataagatgaatggtcaaacacgtactaaaaagtgtgtcaaatattttgaaacggagggagtaatactctatcgatcatcacataattaaaaattagaaatttcaaattaagatcacattacactgtaccttcatttaacatatagcattattgtatagcacagtatttggggtagttaaagcgcacgtttcttgattaatttctaccacataatcacattaaatgaaaataaaaggttaagttgtctttgatcgtgatgaaaataatcacaatcaaataaaaataatggagggaataatacattacacgcagttctcgaaaaaaaaatagaggaagagaaatcaatcattaagatgatgaacaacttgtgtaatactacctctatattttaatgtatgacaccgttaattttttttcaaagtttgaccatttgttttattaaaaaaaattatataattattatttattttaatgtgacttaattcatcatcaaatattctttaagtatgatataaatattttttatatttgtaaaaaaattgaataaaacgaatggtcgaatgttggtcgagaagtgaactgcgtcgtacattttaaaaacttttttttttgcactattcgccgctgcttcttcctctctgttttttcttttcttttctttttctatattggtttagaccttgcatataaagaaatggattggtgtttgtgtggaacgccaatgcagtggcggcgctgaacgcgatcctggggagatggggaacgaatccgcccaagacttggaacatcaccggcggcgacccctgcaccggcaccgccgtcgacgacaccaacatcgacgacagccccgtcgtcaaccccggcatcaagtgcgactgctccttcaacaaccgcaccgtctgccacatcaccaagctgtacgtgcacgcctttgactgaacctcttgcttcgaccgcaggccaggtgttcgacggaatgcctcagaggacagaggaaattctagagaaaggccatggggtcctccgatttttatttttatttttggtctggtagttgcaagaagca

SEQ ID NO: 57363 - DNA, 1118 bp, Oryza sativa
catgaggcagatacttgggtgctactcctttggctcctagttatttgttgtacctactgataagataagaagttcatatacatccgtttgaaaaaggatgacgtcctaataaaaaaacatgtgagtaaaacctcaaaatcttaaattattaataggtaaactatatatgctttatattaacagatttttgattgaaacactctttcacttggttatacttttagtaatatttataaatgcataatttgaaaattcaatggtacactaccagactgtcgatgtcgtccaaagcgctaagtaaaaaaaaggaacgtgggaagtaattatactgatactttttgtcacagacaagatatagtcattttcacgctatatataaatcgtagtaagatttgtgcatacattggcgaccgatgtacctctccgcgatagaataaatcaacttttgtacacaaatctacacatagggtctacatccatatatatttaaaagtttgatgatatactcgcatatacagtacgacaaatcgacgatatatatcaacataaatcgaactatacgatttttccgtatatcagtggtcgatatattcctctgtcccaaaataaattaacatttatatactaatctagatatatatgtgctatatatatccatatattcgggtataaaagtttggttgatattgtgctcgcatagtacgatgaatcaacaacatcgatcgatgtgctatttaaccagctaagctagatagatagcctccgtgtttgtttccggtgagagaaatcaagagatgggtggccacgtcattttgtggatattgctctcggtgtgctcatggcggatttcagctgctcaggctcagcaaccaccaagaaccgatcctgtagaaggtatagtaatcaatgtcgccgcgattgattaattttacttctctcgttgcctcaatcaatgcgagtttgatcatttttaatcgatcgatgcattggcggcgctggaggcgatcctggggagaaggaacaagaccaatttccccgggtggagcatgagcggggagccattgccgggggttcccgtcgacggcgttaccggccttgacgggaaccccaagaacaac

SEQ ID NO: 57364 - DNA, 1557 bp, Oryza sativa
ggtttcacttgggagtaactttttttatgtcgccaaataactgctctgctgttcaaatttcaccatgatcactacttggagtaattagagtaaattattttttgtttttacccctcgaacttgcgaaaccaggttaatctgggaccttggtcactggtcagtagtgaaatctgaggttgacaacacatctgtacacaactagctaacgcccactgttttctgccctcttctctctacaagctacaatcacgagtgaaaattggacctaagcagagtttcagtaaccaaccagacatggacatgcttgttgggctgtgtatgtgtgttagtggcgcatgagtatggtaacatactaacatatgtgcatgtatatttggagtaaacagcaagaattttcgtacttatttccaatttttcttactccttgtttatgtaattcaggaaggtatacgccttgaacgttgtcggtcagatacctgcagaattacagaacctcacctacctaaattacctgtatggtatctaactcttatcagctctgcctagatgctgaaacaactgtaggatatgtattaatatcttgcagcaagccagcaaattcaaattcaaacccatgtttgaaattctttgctgctaatgactggatgtttctggtgctgtttcagggacctggatcaaaattacttgtcaggccccataccatcattcatagggcaattgactgccttgacagaattgtaggagttatagttcaagttttatgttcttgcagtattaatcagttgatgtgttgtctgaaccatccttcgttcttttgtgtaaaaaaaaataggcatgtgggattcaatgcactctcaggaccaattccgaaggaacttgggaatctcacgaacctcaacttgctgtaagagatctcttcttgtatacctggtcagttttcaactatagattaatgttggcacaaagtatttaattatatagaaaaatccaaatccagaacattttagaaaattctaaaattcataacttacatatataggcacctcagtgtaatttcacttttcaactggtgtttcatatgttcgaatgaaatccaaaatgcaaaaattgtggatcaaaagggtgtgtttggggtttcgaaagtggatgcctgttcgaggaaaactaaaaggctcatcagggcaaacaatgcccgttttctcagctagtagcatagcatgcaaataaattatatcactcctgaaatatttcttttgtttcagaggcatcagtttgaccaattttactggtcaacttcctaaagaattgggcaacctgaccaaacttcaacgattgtaagtttgtaagccccctctttctaacttgacagatgctacttctagaagaacaaagtttaatttggaccagcaagatacctattgttgaacatgcatgattgttgcatttcattaataacaggtacactgatagtgctggcttgagtggtccattcccttcaacgttctcaaagcttaagaacctgaagctcctgtacgttcaagaacagagccacagttg

SEQ ID NO: 57365 - DNA, 1104 bp, Oryza sativa
cattttcatacttttttcttaaattatgaactcacagggctttccaaggaaattcttttgaaggcccgattccggaaagtttgtctaatctaaccaaattgacaaccttgtaagtactttgttctatggcaacattgccatcccctcttgtcatgatgactgatgtgctaaatacaaatgagcagacggattggagatattgtaagtgggagctcttcatttgcctttgtcagtagtctgacgtctttgaatatcctgtatgtgacacttaaattctaactatacatcttgcaattttatatattgacaaagtaataacttgctaataccgaatactttttacagtgtattgaggaactgcaggatatctggagaccttggagcagtagacttttcaaagttcacaaaattagccttcctgtacgtttttcattatgggtcatagcacaatccatgaaactcttggtgttttttctgaaatttcatgtgaagtgtctgttcaagtatgctgtcttgtggcacagggacttgagttttaacaatatctcgggcaaagttcctcaatcaattctgaatctacagatgcttacagacctgtaagaatttctttctggaggttattacatctacagaaacatatgttatattgatgaccatgtttcatcatcttgtattctacccaattcaggtttcttgggaacaatagcctaaccgaaggactgccagatgggataagcccttcactaaaaaacttgtgtgtaaacaattcaacattgcagtacagctaaaattagaatgatgcatttatttcatatttgcagagatttttcatacaaccagctcactggaagctttccctcttgggctacccagaacaacttgcaattgtaagtagaaagatctcaaatttgtgttggcaaggggaaaaaaatttgttatgttcaacgcttcaattattaccaggaatttggtggcaaacaactttgatcttggcagcaccaacaacgggtacttatgacatttggctatacttccataagtgtttaatattaacaattttttctcacaacttttttcaagtcaattatgtccacagtattctac

SEQ ID NO: 57366 - DNA, 899 bp, Oryza sativa
atgcgagcctcttaagggatcacatgtgaaaatgcattatcgcatgcggtcccttaagaggcccgcctgcggtatacaatacgtctattatcgcagacaggcctcataaggggccacaagccataatgcattttcatatgcgactccttaaactgtcctatcgggtgcaatttttgcaggtgagggtagttacttgcaacttagaaggggtcttatccggaaaaatcgattatatagtagtaccagctcgtcaatttcaccggcgcgcagctcccaacggctattaacattgtcgatttgcagcaacaacaattggtcccaacagccatcgaaacaacaactcgggtgaccgccctatccacatgcacttctccggtgccaactctcccataagcaacagtggtgtgggtggaaggagggcaacagcggcgtggcaaactacccgaagatgacgagccagtcttttctaagcaataacggggagagagagtttacacgtgcacgtcattaactccgtttaacaatggcattgatgactcagcatgctgataggtgggtttggacatctgccatccgtttagggggtgaagatttataatatttagtattagtatatatagggatgtcaatcaaactcaatgtaaagttgatggacaatacttatttctctaatctactatcatcgctagtggcctcaaggctggacaaggaattttataggccaaatttgttttttatttttttaagtatgtgttcaaatgaatttaaattttaaattcaaagtaaaccttcaaatgaaactttaaaaatatcaagtcaaaatttgaaagtttcaacacaaattttgaagcttttgacacaaaattttaaaagtttcacgtcaaatttagaagtcttaa

SEQ ID NO: 57367 - DNA, 4021 bp, Oryza sativa
  unsure (1)..(4021): unsure at all n locations
nnnnnnnnnnnnnnnnnnnnnnnnnnnnnnnnnnnnnnnnnnnnnnnnnnnnnnatatttagtattagtatatatagggatgtcaatcaaactcaatgtaaagttgatggacaatacttatttctctaatctactatcatcgctagtggcctcaaggctggacaaggaattttataggccaaatttgttttttatttttttaagtatgtgttcaaatgaatttaaattttaaattcaaagtaaaccttcaaatgaaactttaaaaatatcaagtcaaaatttgaaagtttcaacacaaattttgaagcttttgacacaaaattttaaaagtttcacgtcaaatttagaagtcttaattcaagttttgaaactttcaactcacttctggaatttatataatttcaattcttatttcaaaactttcaactcacatttttatattctattataaaactttaaaactttcaactcaaattgtgaaaaatttcagctcaaatttataactttcaatttaactatcaagttgcattttaaaacttccaattcactatttaattattattttattcaagaaaatacatttgccactgaactcctaagatattagcgctaagtgctatgatgagcggcgtggaaacacgtgctttacttcgcttctcggtgcagctgcgcgcaatagaacccccaaacatgtaatgccattattcaatcgtgcgaattcattctgagctcatgaattagttataatcaaacagtcaactgcacaatagtagcacatgtcacattcaattttattagctctaactcacataaaaatgcaatttatttgaacacgaataatgtccaaaattagctcttgaaacgaagatcactaccatcactttgcaacttcgcattcatcttccatcatcgataatttctctgttaatctctagggaaggtgtgagaggggatgtctccctctgcccactgagctcatcggcagtagacccggagtagccggtggtgacatggctgctattccttcccctgagctgcaactcaatgatgtagttcggcttcgccaccacatcactcaccggaatgtctccggtgagcattgccaccacccttgacataggtggtctttggtgtggtgagccttgggtgcaaaggaacgacatacgaatgactctcaagacctcctcttcattgatttcctcgagccttgggtccacgattccgagcgcttgctctcgttcatagagcccccaagcctataaggtttaacatacgaagggaacatgtttcagtaacctataaaaggataaactgataaactgatgtattctctaggattcaaagatttcttatcagctaacccattcaaagagatatttcttgtcttccacaagggagtagtcggtgtttgatcgaccagcgacagtctctagagcgaccacaccaaatgagaaaacatcaaccttttcagttaaatggcctctcattgcatactcaggtgccaggtagccactagacaaagttcaagcaagtgcaatcagtacaggttatttaacatatacacgaacatgatagccatgatgaatgcgcttacaacgtgccggcaacttttgtgttaacatgagtcttcttctcatcatagagcttggcaagcccaaaatcagatatcttgggtgttaaatcagggtcgagtaggatgttactagccttgatgtcccgatgcacgatgcgcacattggcctcctcatgaagataacttagccctcttgcaatgcctaaaatgatttcaaaacgtgttgaccagccaaggttgaacctaccatcccctgcatttccaaaaacgaccaagataaatgacatgatgataaagagaagaaaaatataaagagttaagaaccaggtatctcgataacggagtgcagcataagcaatttgataggtgatggtgatacgatgtgaactcaccgaagagtgcttgatccagacttccattttcgaggtactcataaaccaacaatggtgtattactgtcaatgcagcagccatataatttcacaaggttccgatgttgcacagaagagattgttgcaacctctgtcacaaactggcttttcccctgctgggatgattgagaaagttgtttcacagctaccacccttccatcagttaatataccctatcaaaagatgaactttccttattgctagatcagataaatattcacttacaattaacattgagtaaattaggggaaataaccaaccttatagactggtccatatcctccttctccaagaatgttttgagaaccaaaattctccgtagctaacttaagctccgcattgctgaagacattacgccttccaaccatgttgtagagttctgccaaaaaaaaaccatcacatattggaaataattaggaattaaaatcatctatttaaaaagtgaattgctagaagaatatctaccttctttccgttgtgacgttctccttctcttctttagcaacataaataatccaactaggactgctaatccaaagaatgaagcgccgatcactactccagaaattgtccctgctttacttttcttttttggaacaccattttgcacagtaggaataaaatctgaaacatgagttttacattaattaaaaatcaatggaattcccttttcttggttgtacatatatattgactaattggtcagtacttggggtcacgcttaatgctgagatcgtaggtccataatgtccttgagtaggaatgcaacaagtacccttcccagcccagaacagatggatctcaaggaagtttttggacacagttgcagtatatctcttattgacagcaataagagactttccaccagccatcttccttatattgaagttcttttccttcagctcaccctatgcaaaacgtttagttagaaaacattccatgcagacatgcacaaaatattatgtgacacactcagtatgaacctgaacatatatgtcaaaaactctccgcccgatgctatttgaagttagtgagtttggataaacaaactctgcgaactcaagtgagacagtgtaattcccattctcaagtccaataccatagtatctaagtgatgatggtgacattcttgcagtttggaataattctgagttaagtgcactctgaaactgctgggggctatatattgcataacttccattgcaagcctcattgaatttacctacactgcttacaccccatctcgcattgtcactaacataataagatgcggctccaatgttttgagcatcagtttcatacaaagtattatctgatccccttgtagatttattactgccacagtcgaccgcaaaggaataatctgcaattgagatggttataatagtactgaggtcatatcaactaccaatgtgagtgaagagttggaaacttggaattatacattttggagaaccacggaaacaaggagtatcttgttggagacagtttagcccttaaggtaaaatgctgcacaaataattgaatcaccaatctcagatcgcgcacaaatgttttcatctgtacaatttaatgtgacacatacctattgttggtgctatcaagaatgaagtcattagccaccaaattctctatagaacgcaaaatggttaacttgctaggaaacatgtaagcacaacctagagtatgtatattttcccctctgcctgcattcaaaagtttataagaaatttcagaacataaaacttacagttgcaaattgttcccagtaacccatggaggaaagcttccagagagatggttatatgaaaaatctctgcaaaggttccatcagaagttcaaaaaaaccaagtacaaaatattcaaaaatataggagtaacatgtggccatgtgctacacttaaatgttaatttgctacacatacaaattgttcagtgaagggcttttgtcatatggcaagcttccagaaaggctgttgttcccaagaaacctggtttatgtacaggtcagtatggcc

SEQ ID NO: 57368 - DNA, 1249 bp, Oryza sativa
acagatgccttatatcaaactgaccaaaagtaaagagcaggaaaagaaatacttacagtaaggttaaccctgcaagcttagaaaagttaactgttccaagattatcagatatcttgcagttcctcagtattctgtaataaaagtatctaacttagtaacttgccactttgtgaagactaagcaattatgaactctatagcaaaagcttttcaccgtacaagacattcaaagatgtcagattagagataaacgacagcgaggagctcccatttagaatatcaccgatccgcctgaagcacggacacttagagaataaagtacttatattgatctccatggaggaaacaggcagtgtaatgtaaaaatacttacaaacttgttaatctggttagatttgatagacttgctggaattggaccttgaaaagaatttccttggaaccttctacaggttaatgttttgattagatcataaatatatgatgtcaaaaggtaaaattatacaaatttatcactcaggcaatgtgttgcactcctgttaggactagggctgagaatatgatatgttcttgtcctaatgtaagggcaagaaatgaaggagaagcattttgtgctacagttccattgattttctgttataataaatcaggataaatatttaaatggagcaagaggttgataattaatcttacaaatcttgtaaatttggaaagctcccaaaataatcaggtatttttcctgttaaatcattatctgatgcccacctgcaggcaaaatagaatctgttacttcgagcatatggaaccaaaatgaaaataacatttgtgacactccaatagcttacagaatcttcaaattcttaagctttgagaatgttgaagggaagggaccactgaagccagaactaataatatacctataaaaggaagactgcagtaattaaaaacaactttagatgggcctcatcaaaattttagttaacaggagtctaaatttggaagctcaaaatggacaatgggattacatttgctcgagtttttccaaattgcccagttctgcagggagttcaccagtaaaattgtttgaactaatgcccctgaaatcccaaagaaacatgttgactacgattttgtttatgtacagacagaaaatagcataaattcgcctctgtaagaattaagcatgttacaaaacactgcttaagaatctacaattttgttattttggatagcagataagaactatttatt

SEQ ID NO: 57369 - DNA, 2966 bp, Oryza sativa
  unsure (1)..(2966): unsure at all n locations
nnnnnnnnnnnnnnnnnnnnnnnnnnnnnnnnnnnnnnnnnnnnnnnnnnnnnnnnnnnnntcaattgccattcctcagtcgatgttctctacatcctactagctagctctcagaaaaagtagtgctttactgctttatcttcaaaacagagaagagaaagtttagaggccatacaagttattcagataagagagattctgcagctcctcaggtatttgaccaacaacgttcaacgagaacactctcctgaatagacacacaaaaacctgttagctagagctccttggatcctaaagatcgtgatttcagggaaaaaaacaaaccaaacataggagtttgcagagacggattggaaggaactaatatcaaacaatttcattttcatgtgtgcaagcctaatcctcagcaacaccatggtcactcatggcctcttgtaggcattatatcgaacacctggtgtgcagctggatcagcgcaggttgagaggatacgtacagtctgatgatgtggcagacggtgccggcgttgaaggagcagtcgcacttgatggccgggttgatgttggggttgttgtcgacgccggtctcgtcgatggcgacgccgctgcagggctcgccgctgatgttccacgccggcgacgcccgcaggccccatctccccaggatcgtgttcagtgcagccactggagagacacatacgcaattcagtttaagcaaatgtagctcgaaaaccttttctttgttttccgctaaacaagataccaaggcagatgctcgtatacatatgcacgctcaagccatataaccacacgctctacttctgtaaacacctactccctccgttttccgttttagattataattcgttttgactttggtcaaaatcaaactattttaagtttaatcaagtttgattttggtcaaaaccaaactactttaagtttaatcaagtttacttacaacactaaaatagtttcattaaatctacaattaaatatattttcataatatacttatcttatgttgaaaatgttactacgtttttctacaaacttgatcaaacttgagcagtttaactttgatcaaagtcaaaacgacatataatctaaaacggagggagtacttaacattaccggctcgctatcttaccgttctagttaaatttctacttatttttatattgaaatatatgagtcgagtccatttccttaattaagtgggacaaacacaactcattgtggtacttcatgtgtcatttgaaggaggagagaattgtggattgaattaggtgtctaattagttagactcaaaaggcacatatatggtagaagatatgagaaaattatctaatacttattttatattaaaatagtcccactcaagtccatttcaattgtctaaataaaacatttatttaattaagtgggacaaatacatctcaccttttcctaccctatgggccctaggttgccaattgaaaaaaaaataagtcggaaatcaaggaaggaattggtgtccatggttttaagaagaaagaagcaaatatttcaggtgagcatgctcgagcaaaatcgaactcaggcgatggggtgcatgccagcaacccatctttaagctgccaattgggtttgacttcaagctgctcaccattaattcttccaatagccttcctttaatatcaaagtccgtcctttaatattcagcgtctagatagactttaaccttctgatgcgtcataattgatccctgtttactgaaaatgttgccagttaaatttctgacttgtatttcacttacgttgtctacaggcctaactttttattttgaaagcataggagctaagttattatctgaattttaggatttgcttctgtcattaacctgttgttcagtgaactaaacaacctgggtactaaccggatgctgttttatttcggatttgagtattatagattgaatttgaagctagctcttcaaaattagtgaatgaaaccggagaacaaattaagcgacaagacacagtttgcacgcaattaactaagctctgctaattactagtaatcctgccagtttctgaattaacaccctctagctaccacttgcagagttgcaggtagaacaagatcaatagagatatgtaatttgcaaaactgaattcacataccttctgctggatcagttctcgctgcttgctgagcttgaacagctgcacaggacgcataaacgagcatcagccacaagaagccatggacgctgctgctgctgcaactcatctctctcttaatttctctctcagctaattaaccaaagcaaaagcagcaggtttggtttggtttgttttgaaatatagtgatgaattgtccgaggtgttgtgtatatatgtaccagcagcaacgggagcttcaaggcgaaaagttaattaatcctaattatgacaatatgaaaaggccaagagaaacctcagttgctaattagtaagatattatttctgtttccaagatagcgagaggagtggagcattaaggtttcaataatgtttacgacattgactaattcatggcatcaacgtactattgatggtacacaactggaagagatcggacatgtcaactgcgacttgtacgtatgaaagccccctttttttggaataatcatccactattacctgctacctccacgctgatctcaatgtctcaaaaactaactatagtcaaaagatcatagtgaggacatgagaattaaagttggaggacttttttttatgcttactattcgtaagttgaaattagcgaaatgcaatcttttgtgggcttgtctggacatccaaaatcgcctacgaatagcagatttaaatacaacattacttaatacatacggttgaaaacggtcggaaacggcttggaaaaaagtcccaaccatttccgtaaccatatttttctaagaagagcaatttcaccgtccaacat

SEQ ID NO: 57370 - DNA, 1399 bp, Oryza sativa
ctaattttctatccatctttcaagactgtaatatgagcaatgggcagtggtgcttgctgtatgcacagtttgatccttccatgtgtggaatgtgacacagttttgctatgtgcgaactcaggaatggtccaatggggagttcaagaatgctgttggtgagatactatttgagctgactgatgaaccaaacccgttcatttccctggaactcttgtactcaccgggtcacctgcgtcttcctgatgttggtcgacacgcaagatgcattgaccatcccaagactgtttctttcagggaccagattttggttgctctggttctgctcgttttcttctacctcttctggagataattgtacccaggtttgctcattaatcatgccctcctttgtcaaggcaacgaagccgtgaggtcaagtgtcctagaaggcttatttttacagcttttcttggacttagcttcctgtacttcttcattaatcgtgggggagagcaccgcacgggtggcggtgatgacaggtagtttgagtttttgcctctgtggtttcaaattcagattttgttgctgttaaacaatacgtgatagagtggatatccaacttgaagaaaatgatactgggtggattttgatttgttgattgaggcttgattttgctgttgaggtattgtttggaggtgagatttttattctattacgatggaggagttgtttgtaaaggtgcaaatgtttttatgcttcacaaaaatatattacaatatatgatattattgccatgaccatgtgaaaattgttcattgtatgcccgcaagttgcaactattaccttcatcccaaaatattgctatgtaaaataggatgtgatattatttagtaccactataaatctggatatgacatattcgtattactagatatatcatggatcctgtttaaatttgtagtatcacatcttgtcttagggactgtaatttgggacggaggaagtatcacaattttcgaatgactattattggccgtacactcgtacttatttatcacctgaaatgatcgttctacgtcctatgctcaactcggttgcttttctctacacagtttcttcggtgtgtcggtccagcatgtggtgaccacccctccccccaccccaccccaaccaacatactcgacctgtggagtttcatggtgatagatctccaaaagtacgtacctgccctgtcatgtcccgcgctattacagtgtactagtgtactactgctctgctcctacttgaccatgctcaatcgatcaaaacctgagctttctttcagtaaaaaaacgaaaacggcgttgcagactcggactagtccgcagcagtaaaacgcggcaccgaaaaaaaggatcacgaagagatccacgagagggga

SEQ ID NO: 57371 - DNA, 1819 bp, Oryza sativa
ataaatgtgggcatctctcggacgattctgctgttgtgctgctaggaccaaggtggtggcaacaaggagaaggagaaagggctgtgggggggactggtgggctacaggccgtgatgccaatctctcaacctccaccgtcctgtgcgcgatcgatgttctagtgtacggtacaggcagtgtcatcctaatcattgcaatcattggcgccatctttgctagagactcccaatccttcgtctcgttgtcggttctattggcttttcccttttgtcacgtccttctgatcatccctgaatttttagtagtaatttttacttacaccatgtcaaaggctcaaagccagcatcttggccttgggcatgacgcatacacgtacaccattttattcggttcagatcgatccttcctgccgtcgatcatggtaaactagaccgtaggtcgtgtcctgcgatgagtgaaacactgctgtctttgtcattctggtacattgggccattgggctgcttcgtgatgccgtgcgcttttgcagtactactagtaagcagcaccggctgcctgcttttgcctggtaaaacgagtgctgtgcacagcataacggcacctcaattctgatgtgtggcggtcactcatgaaggctgctggtagtagtagtaacatttcgaggctgtgccaaaagttacaccattgaattggatctgcaaagggccgtagttacactgcactggaggttgagagacatgaaccattcactctgcactggacgagcactggccatcagccgtctcttcttcagtctctttctctgctgcaggggtgtcacagtcacttgtttgctggagttaattaagctccccatttccattgttactactgcattctccctgctctcgatagtcggatgtgatgtctcaatgttaaagcccttcactgactaatcactgaggcctccgagagagaacgtagtgaatgcccgatgtgtgtggctgcggcttgcagctgcagcgccttttgtcaggcttacatgtacagtagtatatgatgtgtgtgtagagtaggagtaattgtgtacagcatactcctactgtagtagaggaaggaggttctgatctgcagcttgtggggtgcagtaggagtaatactccgtgtactccagtatttgacactggatgcagtgaaactggttcttctgcttcttggcagtcgttcataaacgatctttgcgagaacggtaaacaaaccacgcatacgcagtactcatacatccatgaatttctctctgaatgagtcgaagctgcaaaccgggacacagattgccgtgtgcatgcccaccacaaccgattggcttccaatcctgtcatttctcagacccgatcctggccgaagcttccaacaacagtacgctatgcagtaatcctaatactatctcgcccatgcacagcacagcctgaagcagtgaagcttgtgaaggatcaacgacgacgcagtagttcacgaaagcatctcctgtttcaccaccgccatggcacgcactgtccctgtgcatgcacatacatgttgactcgagaaacacactgaagaatgggacgcgcgagctgcaccatgtcgtgcgtacgcatcgacgatggcgtgcaggttcaccctgctggtactggtacagtaggaccgacggccggacggccggcaagatgggtggacagtggtggacgcgctgttcccgggtattcacaaggtagaaattctacagaaaatcttctatcgcccaacctatctttgaccccaacagccacgcaaattcttgtcgaaattgggggtgcaggaa

SEQ ID NO: 57372 - DNA, 10907 bp, Oryza sativa
atctaagatccgccgatatctggagcttgtgtttattagacatggctatcatgcattcatgcatgacggttttgttcatgtggtccactatataatgcagcccactattgcgacttcttgaccagaagactcaagatgagcaatcattttagtaagactgtcattgttgccttggtattgtcgagtaggtacgatccatatgtcatgatttcatcgaattgttcgtatgctaatactactatttttaacacaacaaagacatttgccttctactcctactgtggaaagcatcatgttttggagaaagaacatactactagcaagttcagacttcagagtatgtagcactgatactttacagaagttggatgaattctttctcaagctctgcagacacaggctcctcattgatgaggaatggaatctacagactactactcctactacgtatatactacagccactcttgtatatgatgagatgagtagaaacaataggagcagtaggattgcagtgattcaattgctaggttttttgtctgcaactgttgctacttctgtcctctctatctagctgcactacccacaagctgcgagctcaagaagatcgcaattcgcaaggtgcaacaagctgctagtactactagcattcacaactcacaagcagaataactaaaaagtactaacctgctctgaggaaaaagctcttatacaaggacggactgttcatcacttaaagaggatgaggaccaggaactcgcaactgcatcggtactgaatactgatcgataccaggtctccaagaaacagaaaataaaggaagagagacaactgtgaacatttacttgatggtactaatatgttgacctgtactgtgcttgagaagcaaagcttgtccaacattagtacgcgagtcaaggttagtatcctgattcgtatattagtatattacgatactacgattttatcaaaccgaaacgataccgcgatatcctaattttgatagtatctcgatcctactattcattaccacacgatcctacgtaatcttatatagtatcctaattctacaatccaacaaaatattatttaaaatatgatagtttgaaaataatgaaatatgctcaagtttatatataaaaatcaattaaatatatcaaaactaatgtggtttttcttaataaatatctctatttgcatgacatatattattactatattttttatatagaatggctatatgtaattaatataaatattaattaaacttttaaaaaaagaaaatctcttagtatcccgatcctacgatacgatactactttgagcaaaactatattaactaagatcctaatactgacaaccttgtcgcgagtaactcaatttcttgtaaacacacacagagactatcaattaataccaggaatattttttacctgtatttctttagcagtaaaagaagtataagaaaggcacacttgttgcaagtacaattttcacaatatttagatttaaggtaatttttttaaaaaatactagacacaagagcagtttgttctagatcacgcaaatattctagctagatcaaaatcaacttgctatgctaaattattcgtgaaagttgaatagttttgtaagaaatgataagtttgttatttaaattcttagtgaacagtggcaattgcagacgcagcagaccttacgcatttatatagggtgtgttctttttctctattcacctttatgcatgatgcttatctttcattatctaaaaaaaatatgtgcttgatgatctttgtttcagaatgaaatttgtttaataatctattttagaaatgaacttaaagaagaaaatatccacattatactagctacatgactaaaccagttgataaaggcagacagcaatgggagggtctcttcttctctgcctccactagatggcgttggcgggtgaacgctctaggggccaggatctatcaaatgtgatcgttgacaaacgcagggtgatggaggatccgtttggaatgcttctcaagagcgtctgagtgtgaggattccccaagaggttgctaatgttatcaacatcgacagagaagacctcaacctcttatgagaggaggcctctttcggatatggacttcatgtttcctttgtagttcaacttgattcttctgccttctttgtcggtggtttggatcccgccgtttatgtaattattgctgttgtgttgaatttgtgtaaaagatctagctaaaatctttggtggtgtatctgaagcttctcatcgtgtgttagcacctgaacctccacatatgagaggcccctttagggtttgtgagcatgcttttcttttggcaactcgccttgtttcaagctccgtagcagctgagctccaagcctatgccatcggcgtcgtaggcagccaaaggagaataacccaattgccttttcatattgtattatgttattttctgcaaaatgttgattgaaattgtaatttaatcattctaaaagggcttgtttgcaaaactggatgtatcctatactgagtttttttttcttttaaaaaaagaagaatcagggagtggccatttttttctgcgttcctctctgtaggttattttgtgaaaaaaatagaagtggttaaatttgcaaatataacccaagtagcacgtctatgtagcatgtacatgcaccttgcttagttttcttggcaccctactaaggaaaaataacttgtgtgggagcacttgtgagttgtgactcaaatgcacccaccagacaagatgagtgattcgctattcaattacaaaaatagtgaccaacttaaataagaaactcaccgtgcaagttgcaataccaatagtataatttgcactttaaacaaacttaaataagaaattcaaatgcgatatactactgtaatactccatccacgacatactagcttcttagcgatcttcaacattatagtttgatcaatgatttattttaatttataacatattttccataaaaataaaactaacattatacaaaaatattttaatacgaatccaaaaataaggacgcgttatattttagattgatgaaagtaattcaaaaaagttgctactactaagcattagacaaatccaaacaataataactataacttgaaattaaaggctattttaatctaattattgttatacagtttatgttatggtatggaaaccacataccacctccgtcccaaaatataacaacttttgactatgaatctggacacatagttgtccagattcatagctaaaaatgcttatattttggtacggatggagtacctaatagtagttgactaagctcggcaggaccatcatatattaagtcttatacggaattatatctcgtatatagaaggagttctggataaggaatgacgaatacagttctatatgaaaacgagaaggactactcgaattgtatccatattggtctccctagttctacttggacaaaggggtatctatgggtataaatacaagaccccttaataggaggggagacacaacaacagatagacacacaatatacaagccaacatatgccgtcagacatcaacattagggttaagcctagaaagaccaacaagagggatttagcgtcaaatctgatctcaagagctcatactcgaggaggaagactaccatgtcgtcaactatgtgttggttatccatgccgccaagttgacgacagctcgataggttatcccaattattgtacttgtgtgatccagatgaataaagagtaacaccggcttcggccgacaggagtagggctattacctgtcaaataaggggtccgaacctgtataaaaatccttgtttccatctcttttacctcaatctcgcataccctggtaccaactatccctatttcatgcaaatactgtagtcgagacctcaaacgtcgacagtttagttagggtgaaatttactctggaaatccgctcgattttttttagaaaatcatgagctacaattaggagtccgactttcgtctcaagttaacatacaagtttttttaaaagatatttcttatacggctccttttgtattttcaaaagcgaacaaacataaaaactaacttaaacacgaatctatatttctaaaaatgaacgaaattaaaaaccgactcaaacaaggataacgtaccttgtattggcaaaaacattttcaacttttataatagtcgagattaataaacagataggcgtgaacttagaaagggtctcatcttttcgcttatatttatacttatcagccaaaatttgaatttttgacgttaaatttggagttgattttaggggtttttcatcaaagtttatttttcagactttgtttttagatcgctaagaatgcatatataaaatttttattcataaattattcttcaaatgcaaatatgccgtaaaacgatgggtccacaaggtttggattgatgaatactactccctccatcttcttttgatagtcatatttctaaatctaaaaaaattatttttgataggcatatttcaatccaacaacctatcctcttaatgactttctcggatttaatgcgtgactctacattcttccacacaagattggctacatgggcatcgagaaatgtaaatattaatgaatcgcttgtttacaaggaataactggtagcatatttaaatggatgataagtagaattactttggtctgtgtgccaagatgaaatatgactatagtttaagtatgcaatgcggtagtacgtacattgcatcggtaccacactaagcgcgcattcaataagcatcaatcaaactgtcaaaaaaaaagcatcaatcaaagactccaaattaggtgcttgtcaaattacggtttgattaatgattaatccatgcaccacaatgtctcggatgctcaactaacttgacacgtcgtcatatacttgtactgaagtcttcaactctacatcacgtacaacagtagtggtgtagtaccattggacactactacatcctacagataagaggcagagccaatagcgaagaaatactactgtttgactccattagatttgtcattaatattatcatttatcaacaccactatttagtctttaccatagttgatttctacagtactagtagtaccctgttttgcctggattagcctctcacatttcatactagctactgtagtatagtaccataaatgtaaagagacagaagaacagcatagtatcccaggtctggataacactatttatcatacccaattttaggatcattaacaggctagagcaaaccaagattctcaagacgacagctcttggcacgatgggactcattggattcaccatgcaagacaagagttgcattgcattgcactagcacgagtgagcttgagactgagctcttccgctacatcttgatgtccgcgaggttggcccagatatgctcgaacacgtcgacgatgaggtcgtggtactcggcggcgttgagcgacaggtagcacgccaggaggtcctccaggtcggcggcggtgcggatgccgttctcggcgatcatctcctccatggactcccggaagtccctcctcgggtcccgcgacgacttcaccaccgcgaagctctccgccaggggcggcttcgtcgtcggcgccggcgagcgcgccgccgcgggtggtggtggtggtggtggctttgacttcttggccacgatacgcggggtgttggcgcgcgtcttgaggcggcgcgcggatgacaccgaccgcctcggcttgctctgttcgaggagggtagtgggttttttagccgacgcgcgtctcacgacgtcgatgtgtttctcctccagatcgcagccgtcgagctctctcctcgccggcttggtcacgataggcgggagcaccttgtcgggcctcttctcggtccgcaggtcgatgatgatgtccgtggcggaggtgatcaccttgccgtcgagctcgtcacacgcggcgacggcgaccgtcggcttcttgaattccacctcttcctcttcctcgtcatcgtcgtcgtcattgtagccgacgaacttgtcgcggcggcacggtggggtgtcgggcgcctcgaccacgacgagctccggcttgcgcccgcaccggcagccggtggacaccggcgaggacaggacgctgctgccgctgacggacggcgccagcttgacggaccgccgcctgtgcctgcgcctggacttcctcggcggcgacagctgaagaggagggaattgcgtgtcggagcacttgggatggagcggcgaccccacgagcaggtcgccggcccgcggcgtgtagtagtaggacgccctgtgcgggagcgacaacgcgccgtgcctgggcgtgttcggcagcggccggcacgccctccccgcccgcgacacggccaccgaagactgcgtgaccaccccaccgtggctggccccgccgccgccagcgcccgcacctccccgggcggcgcgcatgtcgcggagcttgaagaaccacgcgttcgggatcatgtcggacagcctgaacttgtgcctccccatggcgccgcgctgcgctctgagctccacagaatgcgcggctgctcgagtataagaagagcaagaagaacaaagctttgtgtgggctgcgtttggttgcttgctgctgctgctgcgcagcttgctctgtacgaggaggagcagaggcgagcagaggaggagatggcgcggagcagaaaagggcgggtaatagagtgggggatcggcgaggcggagaggaggggacgtgaggcgccttttgtcctcgctcctctctatgcggcgtgggcccccacctcgcatggcttcactctctcagctctcatcagtgagacaacgccacggtgaggcctcctcttccattacagattatttcaacagtactgtacttactgctgctgcctgtatttttatctgaaaatccctgtaaatctctcgaagttttggttgacatgagaggctaaaaaatgtttcaagggaggtcggggataggatgataggatggaaagcgcaggtattgttggtcggagaagaatgggcctacgctgcactgcacgtaggatatactactacagtagacaggatatgatatgaaatctgaagaaatttcgcttcgctcgcttgtggattgtggttacgtcctttgcctggctgccttcaattcttttctttctttctcatctcatcaggcctttaattacgcgtcgaaaagcatccttgtccgggacctcttgtttaatccttttatttccatcacccctgggcgagacaagcaacagtactactactggtggtggtcgctggctcggagcttgagcggtcagtctgcgagatttgccttcgccgcttgcgttcacaacaaaaactccgagactccgagagggtgtgtttagttcacacaaaaaattagaattttgattgaaattagaacgatgtgatgaaaaagttaaaagtttatgtgtgtaaaaaaaattttatttgataaaaaagtctaaaagtttgaaaaaaaagttgagaattaaaccacgccagaggctctaaatttaagatgccacgcgcagcttttcgggccaaggccaatggtcaaatcttgcgctgcaatgcaaagcaccgaaacgcaatgcagcgagcctgatcggccgcacgcatggcggcttatcgcgaaagccacacacacgcaaaaccaaaccgtaatcctgtcatgacgcagtactaaacttgtacttgcatgttagattagtgtggttgtgtggcacttgtaaagagtcaactggcaagtggcaacccaaaagagggacgtgggtgaaggtaccggagcttttgatcgtaaaaaccgagtcctcgatcggcatgcttaacacgggagatggatccagcaccggcaccaaacggtgtcgataggattgatggctgcgtgcttagtgctcggcgatctcagaaaggtgctcgttattgtagactagagtgtggtcctaactccggccctgaggcgggtactcgcttcgcgcgcgcgtgcatcatgctgcagagggcagagcccctctgccccgtggacgagacaaacacaaggatgcaaaaacgttgatcaaaaccatattattattttttttagtttttcacacgcctgcttaattaacccatatgcattgcgagtgcgacacacagcgacagtcttagccaacaagtgcaatataaatacttgaactaactcattctagcgccggcaatataatactgcaaccggtagatgagatgagatgaggatggcccgcgttttgcccagcacggaatcgcgcttgcgcgcacggccggagggcgagagggcaccagcgatgacgcctcatttagcgcgcacggagcgcataatataggtacttaagccgcacggttcgtcgtcgccgtggccccgcgcgcgcgcttaattttttcgcggcctgtcgggcgttgcgcccgccgggcgagcggcatcgccgactccgtctccacctactcggctacacgtccttcccgatcgatttgttaaccgcgcggaaacaaaagcgcgccagcatcttggttcccctgggccatgcgtggtgacactatttgcttgccttcttttccgggctcctagttacctaaactgcttattatcaaatgttaagagtgtctctctcactagccatgcaggcaaatggagtgcgtatcagctggctggcttcctttgacttggaggcatttccgtgctagttgcagttagccaacaatggatgggctcagctcaaagaaaaaaaaaactacgaaagggctaacccttcacaagttgtgtctgtatcgtggatggaatgatgatacgttgatcttgtttgaaactgaagcagataaagattttttagagaaaaggccgaaaggcccagcttactatcaagcataagagtgcagatacaagggtaaacgctggggaagccagcttgaaatgatgtgctgaaaactcaacttcacttctattaaggtgctgctggcacagcgctaacaagccaggaaggaactcacaaagaaccacacagcaaaaattaacgcactagtttggtcctgacgcccgaatactggcaagcaatgagtccttcagaccatccacttcgaccttcagcttctccggcagcagccctctccactggatcaaaaacgaaacagctttgtgagggagatgacatatattagaaagcagcttgttattgaaaacccagtcatttctcacaagccaaatcgcccaaatccctgcagaaattacgtgtaaaaagattattgccctatcatcccccatagtcatcaagatattcataaactccctcctggaagaagggacgtgatcccaatgaaacacatctctaaaacaacaccataaaaacctagctggtgcacatttaaacattaggtgatccacatcctcttcagcaccacagaacttgcagaggggatctccattccacttcatctttttaagccgatgagcagcttgaattctccccttaagcatcagccaaacaaagatcttaattttcagaggcacgggtgtcttccaaagttcttgcatctttatgtctctaatccccccaaaggtcatttctctatagagagatttcgtagtaaactgtcctgattttgttaatttccatctcatcctgtccctatccgtagataagtgaacatttgcaagatctgcaagtagttgttcccattcaactagctcctcggcaccaagcgatcttctaagatcaatcctccagccatcagaggaccataattgactcactgttttcccaggatcagccactatactgtaaatgtagggaaatttgattttcagaggtgtatctcctagccagacgtcatcccagaatctagtaccactgccatcccctaaatcatacagctgcccaatttcaaccaatgttttacctcatgcaaacctctccagaattgagagcatccctcagtactagactggaaaaagcctcccccgaagcagataaagattaagttgatatacgtaaaacgagaaaactattagcatagaattaattaatttttaattattacaaacttaataaatgtatatttttctcacgtagtaatggtgttagatattgcaacaattttataatccattgcaacaaatagaaatccttgtagtgaaaacaatttctatatagaaagttttcacaggaaacataacatttattagtttaaaaaacgtgctaacagaatcttaattgatgtaatgtgtatgtgaccaggccgattgatccctgtcgcggatgttactcatcctgcatgcgctgccgatcgatcgacgagcgtaggtacgttctctacgtcgttgcctcgtcgctgtttgttctccatcgatcgggttcagattcccaccggtacttttcgcggatcatcatgaggctaatcttgtgttttgtcacgagattagagcatcctagtcatcaaattcctcagggagccctgtcaaagtacgtacgatacgccggctgcgagagcagctggcgacacacagtacctgcgttgggagtatacgcacatggacatgtgctatacgcaaagcaatggtagcgaagggtcgtactcgtacacgactcgggggcatgtattattagcgtatttcggccgtctccccttaaatcgatcggtcccgtgcccatctgctgataatgatcgaatacctgatggcgatgatcaatacgcaacaaagatacgggtatcctttggtgtgacggaacgggggacggctggtggtgtggtgtcttcaattcagctcaactcgattttttcatacagtcctatactgcatgggggctgcagga

SEQ ID NO: 57373 - DNA, 1217 bp, Oryza sativa
  unsure (1)..(1217): unsure at all n locations
tgttcagtgttgcctaattggttggtagcgtacacgcacaaattaagccgaatctttcacatatctcgccccgacaacgtaactccatatcgacctctcttgaatagggcaggatatgaacctatggctccttttatgctgctctcaactctgaatcttgacttgatgaaccagacgtgctacctgtgtatagtatccaagatgtacgtatgtactccgtacatagctagtaagtgtgctgctatagagggtgtttgggagagaggtaacccctctcacaaaaccataagtactcgtttctgccaatcgctagggtgaggataacaactgttggagagtttgacctgacgtgacaacacacgtgtgaagcacatcaaagcaagcgcagggtagggtatcgcctctcgcctcgccgaggccgtagaactagctattcaatgacaaggacgccgcagcgaaagcctctggctctaacctctaagcccctgttaattttttttcatcttatacccgtcttaattggaatccagctcatgatcctaactggcccattgtacatagactagggtcttcttcaaccggtcgatcagtttggtctcaggctgccagccattgcattaatccaacaagatttgcagttgccgtagtaggttcattaagcgaggtccttggaaagaatctcgacctactggccggctcggctctcactggtgcgtactccatttttgcacaaatgcacctatgccctgacgacgatagaaaaggattggacattgttgcatcttgggactttggtttgaaaaaacaggagtcccccctacaaaaggtacgtgtcatggcaccatgatgatgattatctccgcgtcgataccgcaatctgatggggaaataaagctgcatccatggtgatggggaggcaacgttgctaccaggccatcatggagattgcggcacctgaggtccacatggttgttgcattgttgtggatcgatccatccattttgctcggctttttttttttatgtttgtttttcgaaggctttgtatttataatggcaatgtgagagcacgttcagcggtcggcccaatttatttccacacttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57374 - DNA, 1149 bp, Oryza sativa
ccggtccccggaacgccatccgggcgggatgctctgcagcgaacacgcggccatgttgctctccggccgccgccgccgccgccggcggcgtggttttgacaggtcctactcctaccgtactagcgaagacagaaggggaagcggactacacaaaaagaccgctatcaataaaacggtcatcataggagtttttttttttcgcgcaaaactcccaatcgccactcaccaatcctaacagcaggcagtgttttgcaaaaaaatggatggacacttcccgtccatttaattttgaatttaaatttaaacatatatatttgtgaaataatatatcacatattatttatatattcttaatatttttttatttttttataaccattcgagtgacacataaactgcagtgtacttgtaggaggtacttgcgtaaactatttgtttcatcttttcgcttatgcttatatttatcagccaaaatttaaattttcaactttaaatttgaagctgattttggtgtatttttatcgaactttatttttcagcatttgcttttagttcgctaagaacatgtatataaaagtttttttttcacaaattactcctcgtttgcaagccgtacaccgccgcctcctgtcttctacgcaggccaaagcattctccgtcactgagcttaatcagaaatcattatcgcaggcgatgcacaagacgggaacaacggggactctgctacgcatcgattaaaggcagtataaaccgctaagatgttcctggcatctcgaacaatggcgtccaacagaaacagactgtacgcgagataactcggataagttcagggctcaccgaacacgaagccgagtgtgctcatgagcgccttgttgcagacgacgatcgacaccgacgacaccaccgacaggcccagcgccgccgccgtgccggccatcctgccgtccaccatcccctcacctgcgcccgtggccaccaccgcgagaaccgagaaaaggagagaggacgaatgcgacgagaggcagaaatcctcctccctccgtgcggtggtgggtggttgctcgttgtcttgcttaaaatgttggtggatttgttcgggctcaaccaactctggccagacacagatgcctctcggtctcaggcggtgtc

SEQ ID NO: 57375 - DNA, 2241 bp, Oryza sativa
aaacccaatgttaaaaaataaaataagtacaagatcgaaactaaaatcaacttcaaattaacttttaaaatttaaattttgactgcaaccggtaatctcgagagttgctgcacatgtcccgttagaccgtagtcctggtgagaaagcatcactatccccgttatatatatattttttccctagaccttcctagtcattgttctcacgtcccaatgagagtcagcgtacgttaaatatgatatgaacatggcatgtgtcaacttgtgcaatggaaaaaaggattagacccaatcactccgggttgacacgtaaagtattacggtgtagttagacacaaagctggaaagaatatccacttttatcacctcagaatggcatgaacgactgaaaagacaaatagaaatgcagtgtacgacttttattgtagacaatgagatgcaatgtacttggcgcaagatttgcgaatgctgaatgattctttttttcttttttggaaggtcaacgctggatgattcttaaattggggacaatttacacagtggtacatcgaatgatttacgcgcagagttaggaggttacggtgtagttagacataaagctggaaaacatccacttttatcacctcagatcagaatcgcatgaacgactgaaaagacaaatatatagaaatgcaggtacttttgttgtagacaatgagatgcaatgtacttggcgcaagacttgcgaacgctgaatgattcttaaattggagagaatctacacagtggtacatcgaatgatttacgctcagagttaggaggttatgttcgttgcattgaagggttcccttttttggtgacttttatttggtagaagaccccaaaaggccaaaactcgtctgcagttagctaaaagttgatctagaaaaaaaaagttagcatctgatacattgaactcgaatctgaaacgttttggagccatcttgacctgagagaatctgtgatatacctgtgttgtgattgatcgatcataattaaactctgctctgggcctcgggtacgtgtgcacgtgtgatcgtaatatttggtttactgacgagggagatttaggcgttgatcacaatctagaaaagctttagaccctatttagatggtgttaaaaattttaagtccctatcacatcggatgtttgaacactaattataaatattaaatatagactattaataaaacctatccataatcttagactaattcgcgaggcgaatctattgagcctaattaatccatgattagcctatgtgatgctacattaaacattctctaattatggattaattaggcttaaaaaatttatctcgcgtattagcttttatttatgtaattagttttgtaagtagtctatatttaatactctaaattagtgtctaaatatagagactaaagttaagtccctgaatccaaacaccatcttaggcgttgattagtggctgagaattgagatgacccgcgggaatcgatcacacgtatctcagttagttctaggaagaaaccaattatttactccgcctaatattatatctaactatatattattaaaacaatttaaaaggatgcaccatattgtacgctagaaaccatgattatcattaaggtttttaaaatcgaacatgattaacattgagcttttttttttactttttagaagtcccgccaactgtcgtgattatgctcttaacagtctatccgtcgtcccttcttttaatcgtcattgggattatatttgagatttcgttaatagtttctagatgtcccatcaactgccgtcactcactcctttataggccagttgcttctcccatctttgttgttatcgttgtgctttatatgaacttttttaaaaaaattccatatttttattccgatatttttatttataaattgtactcctacttaaaatcttataattattttctctcttcataatttattttagttgttattctgaattttaattaatctcggtcatgtgttctatatggtttattctttcaatagtttttattttttattacgaattttagttatttataaattatatctatagttgaactcttattcttatttttctaattacagaatttattttactttttctttcgaactttaattaacctttaaccttgtgttctatatggattattcttttaatactccgtccattccataatatagcaacctagtatcggatgagacatttcat

SEQ ID NO: 57376 - DNA, 2249 bp, Oryza sativa
ggtgactaccatatccaatttcaatacatgacatacataattaaaattaagaggtgatatgtataataggctatctctatcacataattcccaatatctctgacactctcacatgtttattgaagtttgtgtaggggctgccccttgcatgagaggtgactatttctctctcatccttcttctctcctccacctcactatttagtcttttgtgtcatcttgggatttatgtttgaatgtccatagtacttgccctaagttatctacagatactccgatacttcgatcagtttgatgagtaaaattttagcacgacacttcgaaaagttcatcaccgagaagttggctactctaaaaaaaagttagcatctggtacagtgagctcgaatctgaatcattttggagcgaccttgaccggagcgaatctgtgtggtacacttgcggttgtttttcggtcaatcccaatcccctgcatgcgcccttccctgcgcgcgtatgcatgtgatcgatcgatcatgagctctctgctctgtacatctggtacgtgtgcacgtgtgatcgtaatcttggttttactaaaaaggagatttaggcgttgatcattagtagaaaagatttaggcgttgatctgttcctgccaacgacgacccggggggaatcgatcgcccgtatcttattgaaaccaatcgaacaatctatctattaacttattaaagtaatagaaaaataagcatccacgttggcttttacggtctaaaaattattatattaatcggagaaaaataaaaacaaattccatataaaaatacaatttaaaaagtaaggaatattggaagaggagactagaagcctccacgctcgctctcccggcctagaaattctcatatttaaaaaataaaaacagagtccatatagaatacaatttagaaatagctaaaattcagaatttaaaaaataaacaatattagaagaggagactagaattcatgacgatatacaatttagaactaatgaaaattcgaaattaaacaataataaaattaaaattaagttagagtccatatagaaatacaatttagaaataactgaaattcgaaattaaaaaataaaaaatattagaagaaaagtatagagtgcatatagaaatataattaagaaataatagaaattcggaattagaaaacaacagatattagaagaagagtatagagtccatataagaatttagaatgaactaaaattcggaataaaaattaaaattaaagatagaatttagagtctatatagaaatacaatttataaataattaaaatttgaaattaaaaaatttatggaagaagagtctagagtcaatatagaagtaactgaaattcaaaaataaaaaaaaagaatattgaaagatgggtttaaagtccacatagaaaaacaattagaaataatgaaaattcaaaattttaaaaaaaatattgaaaaaagagcctagagactatatagaaatacaaattacaaataacgagaattcagaactaaaaaaatgaggaatattggaagacaagtctgcagtccatatataagaatacaatttagaaataactaaaatttgatattaaaaataattaataactatcacgtatatacaatacagtatgagacagtggtagtttagtaaagttagtacaaaatttaaaattatgttatcattttaatatattttaataataaattgagaaaacatatatgtggccaccgtgctagttctgggctgtttagttggaaaaaaattttgctcctgtatatcacatcggatatacggacacatatttgaagtattaaacatagtctaataacaaaacaaattacagatttcgctagaaaactaagagacgaatttattaagcctaattaatccgtcattagcaaatatttactgtagcactatattgtcaaatcatggcgcaattaggcttgaaagatttgtctcgcaattttctgacgaactatgtaattgatttttttatctacatttaatactgtatgtatgtgtctaaatatttaaggtgacaacgtgaaaaattttgttttggactaagcaggccctcagttgatcagatgagagatccacatggaacacaggactctgaaccatgtgatgatgtaacgtggcgacgatcgaggacacataattaaaaacttggccgcgacacgtttttggcaacttctacgcgcggccgtcgtcgtgactctcgccat

SEQ ID NO: 57377 - DNA, 5500 bp, Oryza sativa
agcgggtgctcggtcgctgagcatgatttgctcccttgtcagtcgcgttggttggccttgggcccttgggcccgttgcgaccgcggcgttggttcgcgcgggcttccttcccaccccgcgttggtgggggcggggttctataaatacgggacgcgacgcgatgtgcggggtcacttcactgcacggcgtcgcggttttcccaagctgagagttgtcgtgcgagagtgaggagcatggcgatgctggggagctcgtcggcggtggtgctggagctgatgacgatggggtaccagtcggcggcgtacctcggcgagctgctccgggcggcgtccccggcgcaggcaggggatgagcagcaggagctcgccgcggagatcctccgctgctgcgaccgcgtcatcgccaagctgaaccggggaggagccactggtgctactaccggcaagaagcggaaggcgcggagtccgccgccgccgccgccgtgacctccccttctctccccgtcacgccgaccaaaagaaggtgaggttccccttattgttttttggcgcggctaccgcgagacatatcgtggtatcaaaaatcgaaaaaaccgtgtggtaaccgtaagatatatcgtggtattaaaaatcgaaaaggttaccgtgcatgataaccgcgataatcgtgtggtaacggtacggttttgtactctatcatgcaaggtagtaacaggtgatttcttggtttggcgcagggcgcgtggcgcggaggcggtgagggaggtgaggagcggcacgacgacggacgggtcatctggaggaagtacgggcagaaggagatcaatggctgcaagcacccgaggctctactaccgctgcgcgttcaggggccagggcttccttgccacgcggcgggtgcagcaatcgcagtcgcaggacgacccggccgcggcgttcgtgatcgcctctacgggacccaccttgggaagcgacgcccgccgccgccgcgcgtgccgggacggggaactaatgccacctgccgtcatcaactccggcgcgtcgagcttcgccgccgcttggaacatggcctcgcgtgagccggcgtcgtcgctcgccgtcgagcggaggagctgcgacggcgacgctcccagcgagacgtcgcaggggtggtctccctccttctcgtcggaggtggagctggacgtggtgggattcgacctcgccggagccgactcgtcggcgtcgccggtgtgggagttcttgaatggcagcttcgactgggaattcgtcatcaactccctctgaattttcgatgcttcgtgatcagtagcacaccagctgccccaagagtgcagtagtctttgcaaaacgcacaaaatttcgcgggaactatcgaatttcccgcgtttgcgcttaagttaatagcctcagtagttcgtcagataatcgcacgcactattttaattcaggaagggatttagattgacaaagtatattaggtgagagttaatatgggagaattcgtaatgaagagttgaatgtgttgacgttgacgtacaggggaaaaacacatgctaagaagaaaaatggcaggtgaaaggggcaagaaatggcaaagctgagcaacagagcaggtaataatagagaattgctactcctactacttgcaagcatatatgtccagaagagcagccaaagagaacacaagaccgtcagcttgacgcataactgacgcacttctgatggtaacaaaaaaccggccaccatgtcccatgtgaacgaatggattcattagttgtaataatggtaatagtagtgacactcaattgcaatatcatgcttggtacagggttaaggatcagatggttagtttaaccaccaatagcaacaagctgaaacgaatactggttttgctggatttcactggatgttgttgaatatcacaagcttagagcacaacaacgttgcatcaaataaacagaagaaacagaaaacagctaggtacatctatgacctttggaggtcaatttcttattgttgttcgaggcgaatgtgtatattacatggggagaacaaaggagcgcaactgcgaggacgagtatgcatgcaagtcgtcttctgaacccaaccgtcaaagtccacagccacttggggactaaagacaaactagggttgcttgagtttgatggggatggaaacggaaagcaaatgggccagtcaatcttcaaacccaagttcctgtgatcatctgattcatccagggtgatgtgtaacctagagaaatgccatgttgtgagttcaacgacaattggttttatcatttatgcgtaacatcatgtaactagttcagttatcatttatcaaagcacataggcagtgtttatagacctatttgtatactgtacatgcatgggaaaatagcatgaaagtaaaactgtcaagtgttaccattagttctctgcagtactctcggagcttggacctttgtgaccaccagtcataatacgatgagtgtaaaaggctgtcaccgccccactgcagaacaattcaaaactagtttaaaaaaataaaggttttcatacatacaacaaatgtatttcttctgtataagcttaaaatggccatagtggctaggaccccaataaaaaaaaactgtgatatgtgacacgcccctaaagaaataaaacacagcacgataaccactgaatgaacaacttcaaaatgaaacctagtaagtcattggagatttggaataatcatggccaaatatattgtttgccatcaactacttacaggtcactgcatttaaaggaacattgctcatgtttggtttgacaagtttagttttgaagcagcacacaacgtgccaacagttttattactccctccttccaaaagtctaagacctatttctttttgcaccaagaccaagaagcaattaattcattcactatgtatacaaccaataagtaatagaatgacttcttgggaatttaatttagcacatggtgactacaaataggacttggacttttggaaaaaccaaagaatgaaataggtcttagacttttggaaggagggagtataaaaaatggaactattaactgtggaaaaaagaaggcactcaggtgatattcagcgaaaagtagtatttgtgacagatgtaaaaaaaaaactgtcagactgtcacattggattgcagtctaggtgatagatacagtttggggaaatgtacagtaaataagaagaaatctataagaaaaaacacaggataacaggaacatcaaaggcatatgggtaagaaaattcttgtataatcaaggcaaattctgtacaaggaattgacgcttactagtcatagaaagaaactgtttttaagaaatctcatcgtaggaaccaaaaatatgcaaggatcaccacattacatgttaacacattgctagatgtctgttagtcaatatcagagcaagtacaaaaattaagcatgcactcacctgagaaggaccacgaaaatatttggaaaccacccatactacaccatataacaaataaaaaaaggttaaaactaaattatggtggtgagaacaagtatgaatattagaatttagcaatgcaattgaaggcaaagaaagaaatcatacgtggaagaaaattaataattccctgaagaagatgacacttgcaattgctgcatgaaagtcaaatatgtcaataaatttgcaatgtaaaaggacaacaatccaatgacttggttcagcaagctaaatcatgggttcatttttcaatgtaaaatgatgatgaattcttaatttccaattagataatagctagaagtctgaaatattcatacttgtcatccctgtttgatttaacttgaactaatatggatatatccagtaactagacatgtcacataaaaacagagaacatgagtatcaaggatcaacacaagagaccagctatgctactcttatgccacttaaattatgaaaagggcatacaaactgaagagaagaaaagacagaagaaatgaactaaccagcttgtcctttcagcagaagacgaggacgacggccacctgctctttgagatctcaaacttgagatgcccatagctaacagcgcaaagccaagaataataccaaaacgaattgcagatgtcctcccagtaagcatgaagttcaggaaacctcctacggtaagaaaggtacctacaaaaaacagggcaggtccatgaactaaagttgagaacctacataacaaggcagcattaaagtgcctacacaacgaatgacacactttctcggtttattacgtgtttgtcaattccccagtatcaaattaattatcaacggaaattctacaaagaaaaatatgtaatgcattttagttaccaaagggaatgcccacgtgataatcctcatactctgatatcttcaacttgccaagagaattgaatgtctcgataatatccttaattgagtctggcgagttttgagccgcgagttttagatactcctgtccctcctcaccaacctctgtggcaatcacgctgagatccttctgtgctttgtctgcgtggatcttcagcttctctgaggcctctaatagcacctcccttgccctctgggagtagacaccatacgcctgcaatgtcaggccgtgcattcgctgcgcctcatccttgaactgcttaagcatctccttccacacttcttgagcttcctcaggcttcatctcacccttccctttttccttgtcatcacccgattctgagcccacctgaattcaggcaaactcaaccacataagttgtgaactctagacaaatgttttaagcaccacaatttagcaacagaataaacaaggaatttgccacaagaactcagttcaaaaccctgacgaaacgcaccgacattagtcaaacatgggatttatttagcgcaatgaactgatcaagacatttggcatctcaaaaagcgcattaacattaggcaaaactgtttggtatgcattacgtatttacgcttcgaaatagtcagacaaaaatcacttgacgcagcaaaaaattgtaaaagcacaccgagattatgtcatccgcgcatcacgcacagaaaatgggaggggaaaaaaaactagtcaaccaaataaaaccacacagatcggattgacagtaacaagaggaatacgatagaagcagccaccagcgggtaggatctcgaaagggcgagactactcacagattcctctccggcgaaggtggcgatgacgcggcgagtccgcggggcgccccatccggcggcgaggcgtgaccccgccgagagcgccctgagcggggcgtcgaggcaacggcggcggcgggtggagggggaggaagcggtggcgcacgccaggcgcaggaatggggaggaggaggcgagcgggtggaaggcccccacgcgggcggccggcgcgggggaggcggaggctgccgcggcgtggacgagcgaggcggccatgggggggggggtggggcgctccgc

SEQ ID NO: 57378 - DNA, 2250 bp, Oryza sativa
cggcggaggcgggcggcacgaggggaacgcgaggaaaatgggggaagaagaagaagaagagtttggtggggttttcgtgtgagggggctttcggtttcggagctctcggaggtgtttgtgtaattgtgtttggtgggctggaattcgtttcgttttcagctgtttcaaccaggttttttaaagtggacgttctgtcaatcaaacctttggccttgtgctcgcggcaagaaaatatgcgccgtccattggtgtagtaacagtatttcactctcgaatcggatcctctacatcgagcaagaaaaatgcagtgaagctacagtatatttttttttggccgttcaatttatatcagtaaatagtccaggtgatatgcatataagcgcagggcacgagggccaaagcgagaattaacgtgggggcaaatggatggttgcttgaaaacacccaaagatcacaattagatgtatctcttttgctcataattatatgcactccatctctttgctcaaaggacaaaggtatactttaaggtgaccatgcccaatgctgattgcttcaacaagttaaaagatcacataagcataagctagcacacgtctcctacagtagagattgtcgactgtgtactgctgatgcagtggcaggcactgacgtgtgggggcagaccaaaacaaaaccgtaagaagccctgtggatgttatagctgttttttttccctgaatctgaaacactagaatacctaaccgattgaatctcaactatgagcccagcctgaactttctttttcagatacatacccagtttcatttcaaccacacagatttcaatcgattcctttattgattaccgcaatcaaagcttctccaggaggggcatttgccctcctcatggagcaatgtcagcacgatggatacaaagaaaaagactcaaatgacatacattgcttatgccaagctgttgcatgtgagacataagacggaaggcaggcaaaaagaactccacaagaaagaaatcgatactcatggcctcatgctaaccctcgaaagaagcaaggtattgctcctgagaacagctaccagcaattactttgattttgccgattagaattgcattgattaatttgaattaaatgtctaaatggtaaagagaaattgactcatcagaaatcctgcctgaaaacaaccgtgttcatgaaggattttgcatttggtgcaaggtaatacaaatgttcttcacattggctagtcaaaattttctattagatatcccagtagatggacgctacgctgacaacagttgatagggcatgtaataagatgcaagatgaaatagtacatccacctagcatgtgttatagcacaacaatgtttggaatctgttaaaataactgctcacttaatgctcgcattaggaacagaagatctacatggaccagcagatgtagtgaagggtacccctcggtatgttgcaattccatttccatcagtgtgaagatcctgggtgcatgataaaatttaattattggttgattcatgcagtatatatacaaatggatacacaacagccttcaagagcactcagcgcatagcaaacacgatttgtgaattgtctgtatttaattattgaatttgttaaggcaatgtaaaaaatgacacccagatgtgcaaaagaaatgacaactgatttaattcacccagattgtgctggaagggcagactaatcatgtgattgctaaaagggaaaaataacttagagcatcatgcaaaaatagcgcattggtaaaagcataccggtgtgatcttgtcgagctgtttcttcttcggattaagaacatcttctggcttcccatcaaacctatatgtgaaggataagtaatttaactgaactgaaaggtggacagttataaacattttttttcttcacaaacggtgcaggacaccaaacacaatcaaataatttctacagcacaagacactactaataacaaccgaaatgctaactacgctaaaatattattttccttgaaagacgacagaaagatcatcacacaacatgggtccatcctgtttggacttcccttacgaccaacatattaggggacaacttgtataacaatctaaaagacagtaattgcatataagcttgtgcaagctgactttaaagccatgaatgcaaataggtcaaattgaacagaacatgctccccagaactgcacaaacacgttttttaaaattttaatgcagatatcac

SEQ ID NO: 57379 - DNA, 2335 bp, Oryza sativa
caattctccctctacgctgttctcgcgtcgcgaccgtcttggaggccttctctgctagtctcctgcaacattggcatatgattcatggtggtcccctgtcgcccgcgcggtattggcaacaccggcgcgcggattcgtcccgagttgtcccggggtctggcaaaccctatgtgacgtctcgtccttcacggttcgactacatcggctcttcggcgtcatcttcctcacgactgccgcgattgtgtcaccatcttcgtctccagtgcatcctcgtgcaccttggtccacgacgcccctcccgtgcgtccacgaccactctacggcgcctcatgcgctccctgcggctcggctacctcgacatcagcttcctgacttcgactacatcgaccacagctactctacgcacagcttcatcgaccacagctccctcgcacccttcgctttggctacatcgactacggcacaaagggttatcatccgtattgagtactcttgttggtttcttcttcagtccaagtgtccgcgctgctcacgcttggactgcggagggatgttagagtatatggtagttagagtcatattaggataggattgatttgtgtggactccttccatatctgtaatccttccttatctcctcccaagtactcctatatataccggcccctgaggctcaatacaagtgatccacgttacgcaatattcctctccctatactatccaacactcgtgtcgctgcctgtctactgcgacgtcatcggcggtggtggccgccgcggctggacgtggtggtctacgcctgcgcctgcagccggtggcgggacgccgcggtctccatcgtgcagccgccgcttgagtgcgagcggaccatgttcccctcatcgcttaagcaggtgaggcaccgcccgacctatcctatcatttcaccgcccgtcttgatctgggtcactttttgagggactttgctcgttcatccttgtgcagctggagatgatttttttttctttccgcgggagaaaaatctggatgctcgatttgcagctgttcattgaggaaatgtttttgatttgatttgattcagaaagtgggattttcttttttgttgctgcatctgtctggatgtattaaaagttgaatatatttgttccgctcccgacatcgtcgactgctctgccacctcctcaacctcattgggttccctgccgtcctctgcctcctcggctgcccctggaagctctcctgctcaactctcaaggccgacgcccggcgctgaagatggactcggacgccgacgccccgacctgcttctgctccgccgacgtcctcctcccactgccgacgccctccagctccaacgtcttctccgccgatgccgccctccagctcccgcgtcgccgcgcgatgcaggtggagagtcctcggggcgcagtggagcggcaaagggttgacacgtgggccccataattttttatttacctttagtgtaactgacaggtgggtcctacgatttttattttttttaaacgaattgccacacaagtgccacgtcagatgaagaccgagtcaaattagccacgtagacgtcacgtcagccaaaaccaccgtccaaaccgccgagggaccttatctgcaccggttttgatagttgagggacgtgttgtatctgtttttctggttgaaggatgaaaatcagattcgttgacaagttaaaggaccacaagtgaacttattccttttggcgacgcactcccaaaatcaaagtcgtaatcgagccaaaacttctgaatttgttcatcgtcccccccccccccccccccctccccttccccttccccaaacgactccctcccaagtcccaactccacttgaattcgccgtttgcgaaatttagtggtcgtctgatcagccggtcaattcttcgattctcctatgtgcaagggaagagaatactacccgcccgtagcttcaaatgtactaggctgcttgtaatatgattatatccttctggatcagtcctgctgtcctggtctattatgcagaatcgcagatcgactcggagcattccaacttcttccaggtgactaatctgaacttttcacaagtctctcctgatccagaaaaccagaaacaaaagataccacaatagcattacattgcctaattgcagtctcagtttcacaccgcacaatcggtgtgaaccatctggtaattgcctcgccacggacagatggatcgtggaaaacttgctgtaaattactagattattagtactattagttaatgattacacgagtaggccagccatttgaacacctgtaatgcagagtgtccgagt

SEQ ID NO: 57380 - DNA, 740 bp, Oryza sativa
gaaacctttcatgaaaacgtggtggcagctcactggcctgcaagcacgtcaaactaccacagttgcgtactactgttgaaattctgatctccggtttttgtcgtcgtcgtattctctgacaaaaaaacaagcagcagcgttttgttttgttttctgtcagagaataagtgcagccataaatatacgtgcacagctttttgaccatccgtcttatttaaaaaatttataaaaaatatttaaaaaattagtcacacataaagtactattcaagttttatcatctaataccaataaaaatattaatcataatctttttttaaataagacaaacggttaaacgttggacatgaatagtgctaaaactacacttatttttggaacggagggagtacaggctacaggctaggggacgtctcagcatggggagttgggaatttggggttgttttctgcagatgcaaacagtcgtcaggccttttccttcggagagaatcgtcacagaaaattggtctaatttttgtgtgccattgaaaattgtttttttcctatattccattgttctaaatttgtgcactctctcatgtcactcccgtgtgttgatcgttatataatcagaatgataaatacgtcttttttatttgagagttaacggtcaacacacggtcaacagatgtgagtgtcatgagagggtgcacaaatttgaaacaatggcatataagaaaaaagtcaattttgagtggca

SEQ ID NO: 57381 - DNA, 2830 bp, Oryza sativa
ctgcagcccgacggtaagtcgaaccgactggtcaccacaagatcaatgcagtttaatcagtgcacttccttaccattctcagccattccaaatttcgatgataccaccacgataacacaaccttaccattttttataattctaaaactttatagtctacaaatttttttaacaaattagactttctcaaaacttatttcaaaacttgaccgtgtaaaaaaatttcaaccaaaaaaagaccatcagttcaacgccagggacactggccctaaggttgtacataccaacgccagctacgttggcgttgatccgttgcccacatggagccgaggacaatcccctcgccgacgtggcagggtctcaacgccaacctatcaaaaaaaaaaagggacaaaactagtctcaacatttaataaggtattaaactaaatactacatatcttcaccttaccttatcaaaatttaacattgccaaagtttagtaggtttttatttatagtaaagtgaagaagccctataattcaataaacatgtatgcgaactgccaaacgtagcaacaagcagctgttatgaacttatgccatggtgccgtggaccggtggtgatgaaggtaaaagcatgtacaccaacatgtacatgaagttaccgacatggaaatggaatgaactttcacatgcacaatttcacaggttgatgctacagctgttaacttttgaggaagaactagacgagcccggagataaaactataaaagggctctgtgagcaatttcgatgtagcacagatccatgccatggactcatgaaagaataagttcactccaggtccttcaacttgacgtcgagtctcttaaaccacaatctacttctacttctacttctacttatatatatatctctacttaaaaagtaaaacttgtttccgtcgtccgtatgaccgtaaagaaaaacacgtagaaaaaaaacagcgagaaaaagacttctgtcgaaaaaaaaattctgactcctattataaaaaaaacttccgactcccttgaaaaaaaggacttctcgtccgtaataaaaaaaattcaaaagaagtccgactcaggcttaagttcgatcggtagttttaaaaacagatttttaaggcaagtaacgataaacctcattagcactcattagcacatacatgagtactacttaaaaaattaaagatttttccatcgttcgtgataaaacatataaaaaggcgaaaaaacatataaaaagaaaaagaaaggaaagtctgagtcatcaatgacgcggagaaaaaaacctccgttcgtgataaaaaaaagggggaattttttgttcttcacggagaatctaaaataatcatccaatcggacaattacacaaatcgagaaacctaaaaaaaggggaaaaagagaggaaaaaaatcacacagatgagcaagcttgccgtcaaatccggttgttccgagctcgtcgccatcgccgccgaccgcgctcctgtcgtggccttgcccgctgggcatggccacactcggcacatcccaacccgcgctggcaccccctccctctacccggtgccccgccctccgacgctctcctcttgcttggagacagaggagagaaagagaggtggatggccatcgccgaggtctccgcgccgtaggctcgtagccccgccattgaggctgacggggagagaggaaggggaaggatggtcgtcgccgccgtcgtcgtcgctgtcgtacccttgccgtcgctgcactgcgtcgagcactcactgacatgtgccatgccggcgagactggaaggagagggggagaaggaacgtccccgccggtgggggaagggggagtgtcgccaccgatgggggagggggaaggggagtggtgctgccaacgccgtcgtttgagaaagagggggggaggggaaatgatttacgattagggttagggctgccgacgttttatatatgttcggatcaatcgggaccgtcgatcagataggacggctacggcttctcccactcgggctgctaacgccacacaattgggccatatgtacgctccgcatggataagttcagttttggtccctccagttgtcccaaatacttactaaaccaaggccaaaatcagattcaagccatttaaaattgctgggaaattatgatcaattatttaatcagttagtagattatttttagataaatgaaaccaacaaaatgtttatctagaaagtattaattatatgatattgtatttgaccaacgttaatatggttttatgtcaaaataataattatttccttaaatattaaattatttatagaattcaaacatattccactaaagattttatttcgatactataaagtgtgtgtttctttcccattgcagacgctttgtagcactgaaaaaactgaaaacatactatagtagagtgcaacaaagcaacgaaacgtttaacctcttttactaaatcccgttgcaacacacggacatatttactagtaccaaatataatatgtatctaaactcgtaaaaccgatgtaccagagatcccagggcagtataaagctcggctttggttgaacgagttagctacgtatggcccacctaggcacccggctaactcagtgtggccccgcgtgtcagttgccaatatttcttcctcctctctctccgtctcacccatctctcatcaggttgggtcactggaaggcaggagacggccgacaggaacaaggcgagccgccggcgggaggtgagttgcgggaggccgagccaccgatcgaggcagcacagacttcatcggtaggcgatctctgcattgttagca

SEQ ID NO: 57382 - DNA, 2913 bp, Oryza sativa
atagatgtgtgcagctcggcgatagatttgtcgtcggctcacgttctctctctcccctctctcctccagctaatcacgacagttgatgtggcattcctatcgtcagtccacggtggattattgtactcgctctaagacgttttgagtttgatcaaagtcaaactacttcaaatttgactaagtttatagacaaatatagtaatatttataataccaaattagtttcattaaatcaataattaaatatattttcataaaaaaatgttttgggttgaaaatgttattattttttctacaaacttagtcaaatttgaaacagtttgactttaaccaaagttaaaacttcttataacctgaaacagaggtagtaggagacagagaccgaagagcatgtgaaggctacaagttgtgttagacttcagggtggcggtggtggatggcctcaagctgtccaagcgcctcgtcctcccaagcagcaagccctattgtgtcccgttgttgcgatggactgggtggccgcattagacgtcaccttgctgctactaccggcgtcgatgacctacaccgtggtgatggacccaggtgccatccacagccccagtgtgcctagctaccagccacacgtttgtgactgcctggacccgccatacatgaagaaggaggcggtgaacatgaggctgacggcgaccatgacaacccacctctccaccaagcaaccaaacaccttaaacccaaatcccccttccctgaattcgccctaaattcatcgctccccgctagagatcgacccatcggacgccgatccagctagtcgacgaggtcaccaagtaatgcgacgtgactcggtgcttccgcgcagagtgcggtgagctcaaggcgcgggcggacaagcttggcatcggcagcagggcagggtcgttgacggcaaccgtcttcaccctgagctcatcgctgccgcctttccgccgatgagtgagcaagctcaagctcgttgcccagctcctctccatcggtgctaatgccaccctactcctctccaccaatgttcttgtcgcctatctcctctccgccgctcttctccctgccggccactggccgcgtcgccttttcccgtcgatcgtgtgctcctggaaagagatagggggaagtggagattggagaagctgtggtttcacactttaactgacatgtgtggcccatatgttttttgctttttttttttgtctttagtgccacatcagagccatgtcaattaaaactgcttacaatattttcttgtcctcttggaactatatttgtactggttttacaagttaagagatgtgttatatttggtattacatattgaggatgtaattcgaactcgacgctaagttgaggtactataagtgaacttattccactcctgaattcccaagccctgcagagtttcagtcttgcacttgcacttgcagcaaaggaagctaggcctagctgtgtgggttggtcagaacgtggtgcggcccacaaaagttggttagaaccggattcggaaaaagtacatcgaaggtccctgaacttgtcatcgagttataaaaacgtccccaatctgcaaaaccatatatcacacgtctcttaactaatcaaaaccggtcacaataaatcccttggcggttttgatcccggtcttgtcctacgtggcggctgaatcagcgtagaacctatgtgagccccacatgttagcatgccacgtcagcctcttctctatttcccctcttctctccattcctcctctctctctctcactcctctgtggggctctggacggccggcggtggggaggaggtcgtcggggcatggaggtccgacggccggccggcgatgaggcggcggcgacccagaagggaaggccggcggcggcggcgggagcacggagagcaacaccagcgtcttgtgccgcgtccaccgcggcgtgccagcgccggcggccggcgaggtcgtgttggcggcgccggacattgctgctgctgctgctgcctcccggaactcgatcgagacacatcaagggatccaccagctgggatttatctacggccatcgcagccattaaatcgggaatcaaagcttgcaattttggcatccagcagaaacatgcaagaaattaatctcgtgctacaaatgccatctcatcatactcatctcttcttatctcatccaactaagaggccatagaaaatcagtgtcattctactggcaaatcacaattaggcaaaaaaaatgcaagaagttaatctagtacaactaccgcagctcgcagaagggcaccggcgaggagctcgccggagcgccactgccgccgctttgcctcagggcccttatcaagggcttggtcgccgaccacggcgaggccgcgccggccgtgcacgcacacgcggccaagctcggcctcgaccaccgcctcgtcgtccgcgatgggctcgtcgagctctacctcgcgcgcgtcgagctcgcctccgcgtgggcgctcttcgacggattccacgccggctggccgagacgtcgtttcttgtacggccatggcggatgatagcggcgtgtgcatcgacaccgtcgccgccgtcgcggcgttctcggcgtgcgtgcaaatcggggaccttgcgctgggtcgggagctttaggaggatgcccgtgaagaagaacgtcctcgtcccggccgccgccgccacgtcgcggccggccgtcggacctcctcgccccggcaacgacctccccaccaccggccggcttgcccaatccagagagaagagtgggagagagagaagggaggaaaggagaggaagggagaggctggttgttgacgtggcatcctgccgtacggggctcacatgtgtcctacgactcagccgccacgtcagataaatcggggtcaaaacc

SEQ ID NO: 57383 - DNA, 3249 bp, Oryza sativa
tcccatagtcccatgttccagtgaattcacaaggtacaccatgacacctactaaaaaacaaactttagcacatgaaggacttgtggctgccgttaatgaagccatcggaagttcacaaaaaagaggccgtcgtcaaatcttgtgccaaacatcctgtttcgttacagagagagggggagacatttcaacgtgcaggcgttgccggtgatagaatttggttcctcgtgagcaggcgtccttgcggatatccagccgtcggtccaaccagccacaagcgtactaccctgtctgccgaaccggtcgagttgaagatcccgtccaatgtagcgcgcagtacacaaacatcttatcccgtcgatcggcacacatcggcagtacagtcggatcctgttcctccatcgccgtgaacagcgagcggtcgatcgatcgatcgcgacctagcttcctcgccgcacgctcgatcgaatggcctcctgcatgcctctaggccgacggaccacgagaacagcccgcgggcagcgactcctgagccgacggatgacggatcgacgagactcgacggaaatgccgctttgccgtgcgggggcgcaagcacatggcacatggcaggcagcagcaacaggacgcgcaaccgcgacccgcgcgccgctggtgcatcgcgtgcggccatccgtctcatcctccgggatcgcgcgcgtgcgtgcggggtgacgtacgcgcggtgcggtgcgggctccatccaaccacccgccgcgcgacgcagggcaggttttcgccggagagagcgacgcgggatggatggatgagtaggcgggggggcgtgcacggcgccatcggttcggttgggccgggcgctatcgagccaataatgaacggaacggtccgaactgggaagaacgcaagcctctcccaccgtcgttacgcgcgcggcccacaccgcgccatgataggatcccacttgacatgcacttgccgtttcgtgtctaggtaagacaggagtagttagctaccgttaagtactactagctccctttctttggaaatgagagcgaaccgcttgcaaattgcttttttctcgtatgattgagcgtgccctagctaacgcaattgatgagatgtttaagcgagcgaagagcacgattctcctcgacaatcatggacaaccaccgaccggggcaaagaaaaccttccttccaaccgtcattaaccagtgctgtaacaaccacgaaatgcatgatggtgtctctgatgatcgaggcggttggatggatgaagaagattttgcagcgccctactgctacgagagattctcttcagacgagtaggcgtggtgttccattcgtgcatgatgaatctctttttgtttgggtgcgacctgcagatgagttccctgggcttcagtcgccatcacggcaagattttgtggtccgttttggtgtactcaccacatgcttgctcctcgctctctctccatcttccaaacagtcatggcctcttcagcgcatggcgtgaatagttcaatgccttcaatgtgagacctggttctattatactccctctatctacaaataattaaattatttgatgtttaaattttgcctataatataacggatcctacattattacttttccaattcatccaaccattacatttgttgctcaattttatttgcatagttggcgttatctttactaatctggtaaacctataggacaatttcaccccagctcaatactatactactgttaaataacctagaacccctaatatttacggacaaaagaaacacttcgcatgttaataccatcatttatagacgaagggagtactgtacatgctaatgtcggtggtaaaaattttgacgagcaaaaattggatttaaaatttatattatatggtatttttaacttatttatgatggaagtggttcacataatccgcctctaccaaaaaccacacaaccaaggtaaattcgcatattgtatgaaatgcttatgatcaactgtaattagatttagtatgtgtttggttgaaagaacggaatagattgagatgaggcgaatccatttttcaagttgtttgatttaagaataagtgacatcggatcatgggatggttcgtaatcccataagatttgggtcagttttacacctcagaaactaacggactaatcaatcctacccacctcctctctcttattgacaaatgagccacaccctccgtaaagaaaatataacgattctatctgtcatgacaaacatatgactaaaccattccattcataaaaaatatagattatctcacctcattctcaaaccaatcacgcacttagattatactccctccattacataatataagggattttaaatggacatgagacattctaatactacgaaactggacaaagagtatgtccaaaattgtaagactataatgtgtcacattctttcaaaatcctttttattacgggacggatagagtacaatcctgccgcagttagcagtagaagttgccataaaagagtctttggtgtactattgtctggagtgaaaataagccccttttcaaattagaagtgccttagaatttaagactcgtgtacgctctacgcggttcctacatactttatcgaacgtgagtgatggcagattgcagagcttgctcaatgctcggctagctcaaatatccgtcggtacagcccaagtaaccaacgtaaacagggaaaggaaattgtggcgtgaaccttatgatgctcggagctgaaagctcgggacgcttgcaaaataaggcgaatcaacgcatggtagctagtaggagattgcccgtgatgtccgggcggcccatgcccatgtgcagctaacatggcgtgggggcacgaaatggatggttaattagtcacttgatagactacttctttttgaaagattggcacgcatgttctctttgaaaggaacggattatgacgggaaagctaaccgcgattttgttttcttgtctccaatacgtgatctttgaaacatcgatggttccgaattcatcacgctatcatttccgcctgctaggagcgatcagctgctgccctgtgctgctagtataaaacttctcctgttgcatggtagtgataatttactaaaattacgatgacatagaagtaatttgtactgttaactaacaatgacgcatctccgaaagaaaattttcaaaagggctttatgaagttggttgggggaatccattaaaact

SEQ ID NO: 57384 - DNA, 1071 bp, Oryza sativa
cgagtcagcgagagacgtgttattgcagccccctgtcattttgccacatgtcacaggaaaaagaacagtactatatgcagaggagatgaacgaagaatgcccattcaggtttgtcagagcaaaaaacgtgaacttggacaaacatgcctgcagtttgtctgaagatttcgatttttatacacctttttttgatcgcctacgtacgtggccatgtttatgccatattgccatgtgaaggtgtgaacccttgcaagcacccatgggcgtcaggctatatcctagtcctaaatcctaatagtatctgagcttatcattgggagttcgcactggtaattttggcatcaagcatgtatgcactagattaattgctgcactaatctatattacctagtcctaccaagtaaagttactcgcggctagtcctactattgattcttgtatactcctagtcctacatgatttacatagccgacagaaaaatctggggatagtcactttgcctgatggtgcaatagtggcttcaatcttcagcctactctgctggcgcattacaatttacaattgtgagaacggttatgccttttagagcaagtttaatagtatagtccactgctaactccaaatcatctatagctaacgtaatagctaattcatataatagttgcttactatactattaatacatggtcccacctgtcatacacacattacatcttggagtccgtgctgcagctggctacagatctgtattatagttagtttatagcctgctattgtacctgctcttacaacatcgaccggctccgatttttcggagattatccaatgaacgagaggttcttaaccgaagaatgcaaccttcgaatcttgcgctacgtcggaaaggtgcgagaggcatccacgaacatggttcacactttagaacgattggttgtcattcggtctctttttcgtttctcgcattaatctaccatgcatgcaacttgatcaacagttcaagaacataaacaaagtggtttactttagagcatttgagcaaactgtatcgcgtagtccgtgcatttgaccatg

SEQ ID NO: 57385 - DNA, 1079 bp, Oryza sativa
gtggtaattaagcatggctaagcatatagttctagctaggtcatcaaagtaacacaagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcacttggatcttctgaactcttatccttgcgaacgcgatcttccgaaacgacgggaactacacgctggcacgcaaaacgagaaaaaactctaataaaaaccaagaaaacagtacataaaaactaaacaaacatgtagagctcaattttagatgaattttgcaagtggaatggctcaattcggagttcgaatgaattaggtatgaattttagaagttttaagccatttaaatgaatttctagaattaaactcgatttattgcgcaattattatttatttttacaaaggaaatggtcatcgctgacgtcagcaaggggtgaggcgcggaccacgtccacaaagggggcaggccccacacgtcagcggcacggcccaccgtggaccgagtccacggtggcgatcggccacgcggccgcgcacccgacggtctagatcggccaaggccgatcggacggctggggacggccgggcggcgcggcctggccagcgcgcacacaaggctggcggcggcggcggccgggaccaaagcgacggcggcacacaggccgggcgtcgcagggagcggcggcgcgcagcgcgggaagcggcgagaggaaacgggggcagtgagggagagggaggtggtggagctcaccgaggggcacggcgacggcgagagcagccggcggagggaggcggcggcgctccacaggtcgacaaggaggaggggctcccagcggcgaaaggcggcgaccgggcggcggatggggaagagcgggacgcggcgaagccggcgatgcagccaatgcgtcgcagcgcgcagccggggtgaaggcgaacggcgatcggaggcggaa

SEQ ID NO: 57386 - DNA, 3311 bp, Oryza sativa
cagcgcggcggtggctacggcaacggcggcgtgcagccggagctcgccggaaagcagcggagcgcgggctcgcgcgaggaacacgggagaggtaacgaggagctcggggaggagagggaaacggaagaggagagcacgagggtgctttttataggctcggggaggagaaatcgtggccggacgtggcggatttgaagcggcaacggccggcgacgtgggcgacatcgtgggcgaagtggggctcgatttggcgccaaaaattggggaaaagtgggggatttggtggaggaggtggaggggaaccgattttatgcggtttgggcgcgagggcgcgagcgggaggagccggaatcggcggcgacgtgggtggcaatggcggcaatggcggtttcggctctagaggccgaaggtagaggaaggacctgacaggtggggtcgtcgggcccacctgtcggggagggagagagggaggagagccagggggttatttagactttgcgcgagggaagttgatcggaccaaaaagggaggggtcggcccgagagggagaagggaaagagagaggggcgagcgggccaaggaggggaaaggatcttgggccgaaagcggcccaaagacaaagaggggaaaattttatttgttttctttttattttaattgattaaatgaaatttgtgctattaaaattatttctcgagctccgaaaattcacggaaaattccggagagtattttagggcacaaagaatattacaaaatattcccggccaatgatttttaagggaaaattttaattctcccatcaattcattcgaataaattgctttaacttttaatataatttctagaaatgcattattaattgatttttaatcccgaacgaaaatcggggcgttacaggcatggcgcctggcgatgctaattgggccttctttcctcctcttatctacattgagctcgctaacaagatgagaatggcgaggacggctgctgagccatgggcgtcgccgttcttcatgttctcgacacgacatgtcgagcccttaggaggtcctgtatccaccatgccaatggctagttcctcatgccaccaagaacggtcaagtgagcacgacaacggtttttcaaaggtcttcggttgagaacatgaactcgttcatttgcattgaagtcgggtgttactgtcatggttatgtataccacatacataatagtagttgactaagctcgatagggcccaccaagtaccaagtcttatacggaattatatctcgtatatagaaggagattcggataagcaagaacgaatagagttctatatggaaactataaggactactcggattgtatccatattagtctctctagttctacttagataaggggacacctatgactataaatagaccccctaggaggagggggggaggaacaaaaaaaatcaagacacgacatacaacagatcgagccaacacacgccaagacaagctgccggatatcgatatcagagataagcctagacaaactcaatatggtgtctacggaggccaacaaaagagatttagcactatctctgatctcgccgagtgcgaattcgaggaggaagactactgcgttgtcgactacgtgatggtattttaagccgccaaatcgacaacggttacataggttattccaaatattgtactggtgcgattatgatgaataagagcagcaataggagtagggctattacttatcagataagaggcccgaacctgtataaaaatccctgtctccatctcttttaccttaatctcgcatccaccctggtaccaacgatccccataccatgcaaatattgtagtcgtgacttcagacgtcgacaagggcccgacgagctccacctccacattgccaccatggctccatcgagctcatcgcaatatggtcacactgctctgcaccctatgcaggatgcttaccatgtgctttcaatcaccggttgttgaggactaggcagccatactaggtagttgcataaggaagagttggcagggatgcatggttgccactgcttcctccaccataccaccatagctgccttggtgtagcaaaaaggaggggaaatatattaaagcggggggagagggggaaaagagggaaaattaaatgaggattagagcaattgacaccgtaatagactaatcggacctgaaagagaaaatatgatctagagattatgaagtactaccaagttttttttttctctaatgtaaagcggtaaacaaaaaatccaagtaaacataagaggaatgtgtatcatgtttatacaactctctacacgtgtagtactgatatgtacatccaagaatctatggggtccacatatcgtgagaatactgcactcaccccagtcttggggcctgttcactttgataaaaaaaaaaaccttaccaaaatttggcatacttgccaaaattttggcaggatttcttatatagtcaccaaaatttgacagcaaactaaatgtagccacttttttggtaactttaccaaaatttggtaatgttgaaaatggtatcaaagtgaataggccctttgatgccattttcaaccttaccaaatttttggcattgccaaaattttggtatagttgccaaaattttggtaggatttcttatatagttactaaaatttaccatcaaactaaatgtagtcacttttttggtaaatgtatcaaaatttggtaatgatgaaaatgggagcaaattgaacaagcccatagttctgcatacaaccttttttttttccaaaatacaatccaagtacttcgtatacacatccaaaaagttgagattccgaaatcttgaagttcccatagttaccttgcttttaggtctacatagataggtgctatataaatgctcgtacattcacccctcatcctacctgtacaataaacgctagcatactcaccacttaccttatccctattagcacatctaaaaattaatcttgatattgacagagtatcataggcgtctagttgttgatggaaacatcattctagtaccatttaaaaaataaattatcgtaaacatgttaaatctattacttaaattcggatggacaaacacattccatcaccagcaagtttgcaaccccatgttcccaactcctcttcctcgttttccacgcgcacgcttttcaaactactaaacggtgtatttttttaaaaaaagtttatatacgaaagttgcttaaaaaatcaaattaatccatttttttaaaaaaatactaatacttacttaataacgtggtaaaggatcg

SEQ ID NO: 57387 - DNA, 984 bp, Oryza sativa
ggcccggcccaaggagagatttttttacataggtccaaaacaagaaaggagattttttacatgggtatgttacactgggcccacagcggctgggggaagcgggggcccacctgccccggtcacgcgatgaccaccgtcacggcggcggcggcgggggcgtcgacctcgctccccggccgccggctgcccgcggcggcggcgcggcggttggtttgtgcttggtggtggcgccgtggaggacggagccccggcacgtggggcaggagtcgtgggagacgagccacgtgtcgacgcagcggacgtggaagccatggccgcagcgcggcagcacgcgcaccttctcgccgtccgcgaactcgccgaggcagatggcgcagacctccgccgcggcggcggggctccctccaccacctccgccgtacacctcgatggggatgctcctgagcgcgcgcttcttgagcccgccgccggcgcccgccccctccacgccgccgccggcgccttcccccgtcgccgcccgccgcgcccaccggatgatgagccgcgcgagcgagttgagcccgagcgcgaacagcagcgcgaagagcagcgccgcgaggatgatcaccatgttggtgtcgaagctggcgtcgctgccccctcccccgccgctgctcagtgcgtgctgcgcctccccggcgctccccggcgacggcgaggccggcgtccccatgtaccagctcatcgacttcgtgtgcacccccatggcctccccccaacttactagaacttagaacaacacgctaagcttcccggcaaattatgcgccgaatgtacaggtccaggtcagtggaaaagctactactactcaccagttatctcgctcgcgaaccaatccgtaacacaaaaggacgtggacgtagtagcgactgccactagctaatacaaaaaggtgaagcttaactgttgctaaactgtaccgatcgatcgattgatggagtgagc

SEQ ID NO: 57388 - DNA, 880 bp, Oryza sativa
cattattaagtactgtacgtagtctctgagtgataattttgaaatctttgtgagcgcatattttaatcgaagttgaaggctatttttgttcgccattttttgttggattgtcaggatgatttgtaggcaaaagttcacaagagaatttatatgttgcttcttcaaagttcaaaacgattcatgagtgagaagaaaatgatttgtgacaaagctttgtgcctttgtctgttttcagttcgacgtacgaaacaaataaaacgggcccatatctattccaccgcagaattccagcttgaactatcaggccattacaaattcggcccactagagcatgtattctcaaaagcaaaagctggccatatctatgctaccgcaaaattccggcctggactttcaacccattaggaatccggaatactaaagtagtagtacgaagtagtattcttcaaaaaaaaaatttctttgatatgaagtttgttttgtattgcaaaatgtggcttgactatccagtataagtgtataactattctgttcacgtatgctgataaaacaccaggtagactgttcaactgattggtctcacacccgacctaacggctaacgcaagaactttatgcaaactggaatactggattcatgagtactaaatgagtatgtaattaagggcaacaaagttttttttatctgttacaaacatctattaattttttaggtatgatgggttcatcattgactgtttcaagagtaggctaaagagctgccaaagtgacaaattgtcgttgcagttcggccgttgtgatgacaacgatggcgatatccgctaaattgccctgtgcacggcgcgggaatctgcatgtctggtaggtcgtcaccgtcatca

SEQ ID NO: 57389 - DNA, 5275 bp, Oryza sativa
tattgggttgcttaatctgagccttggattcaactctattggcttttatcaggttggtttactcttcagaaatcaggccaatcttgcatttgtttatttttcctattttgagatgaacatattcatcttcagcaaacgacacctgttggaaactttaaaacttaaattcttgctggaaatttagtagttgaccttgattcatgcccaatctgaaaatcaacatgcacacaatatgttgccctgattttattggggatggaatgacacaattcaacagtctctagtttcagccaattcatgttctttgtctacagacctaactgtgcttgtgtaattagtctactgctttgtctaagctatctcactctatcaaatgcatcaggtaaccaagctggcaataattccatgcactgtatctttggagactatattgttcaggaaaacattcaggtctgatccaaattttgccttgtcttatgtaaaaaaaaaaaatttgccttgtcaattcacgctgaaaaaaaccattaactactaaatatatgatgattgttggtatccttgtgaatacaagcatggtacttgaatatttgaattcctcaatacctgtgggtcttgcaatcctaatgtcatactcccataaaacaataacttgtagtactatcataaattgaatagactataacaatattttcacttcatgcagccggagaatccaaatggcactggcagttcttttgtttggtgtaggtgttgcaacagtgacagacctgcaactgaatagactgggatcgctgctgtctctatttgctgtactcaccacgtgcatttcacaaattgtatcctctaaacaaagtatacattcaatattattttctttgcactaaaataatgacacttgattctttgtttttaatagatcaataatcagacatatgcattatagaaaaaatggcttttggtgttagctcatatcaaatatatattaatttaccagataaatagtttcttatatctattttgatatgcattctcttgcacctaaagtggatgataacttttaacatactctgaaactctgatagtttctacgacctccgtcccaaaatatggcaacttttggctatgatgtatccagattcatagctaaaaatgcttacattttgggacggagggagtaggtgtttctcaaatttaagtagctgatctgatacacgttgttttttttctctccatttttttgtatcagctataaatatgtggatccaacgtagtatattgatttaacatcatatccttcttctgctatcactatttccttccccatacagcttaaccaattttgctagatgacaaactttatccagaagaaattcaaagtctcttcaactcaactgctctaccaatcttgtccataccaagcgctgactcttttcatcattggtccatttcttgatggttttcttactaaccagaatgtatttgccttcaagtacacgagtgaaatccttgtgagcattccctggctcgatgttccctttcttatttgtcttctatccattatacagtaatatatctgtttgttatctttttgtcaggtattcatcgttctttcctgtctaatatctgtctcggtaaacttcagtacatttcttgtgatcgggaaaacatctcctgtaacataccaagtagtaggccacttaaaaacctgtatcatcctcggttttggatatgttttatttaacgacccatttagttggaggaacatattagggattcttcttgccttgttaggaatgatcctgtattctttcttttgcttgatggagaataaacagaaggccccggaattgtcagctccatttttccacactaaggtatcagatagcacttcttttctgaagccttaatgctacatttgcgacttgcagctatttttttcatatctcgtccttgcaactttagctgacccgttattttctttcactaacttactttttcgtgaatgtgcaaaaggattacacgtcaatatattagaactttcactaacttactataattccttgcttctcacccatcggtaatcacccttgcttatcaacctggcaggtgaaaggaggtgaagcagggactcttctcctagtacagaacgggtcagctaaagttgcagatggtgttgtgactgagggcccaatgtggaggtcaaacagagacttggacgcatgatcatcccgctcctgcagaagggatcaagggactgacatatggtctgaaaccggtgtaattttcatcggcattttgctccagttcactccagctagctagttctgaaggctccttgctctgcgtcttgtacatacatattcggcacctatttttgctacgactgtacataacatgtccacggctggaattaaacaaacatttgcattcatactattatatgaagatttcatgtctgttatttacccgaagagtaaagtgcacaatgcgtttgttggttggggatgggaactaatcccttcgacatgcaaaacagaacgaaatattaacgcacgattaattaaagtacaagttccttttctttttaaaaatggatttatatgatttttaaaaacaactttcgtatagaaagtttcaccaaaagcacaccgtttagtattttggaaagcgtgtaggtcgaaacaaaaatgatgaattcacttgtagacttttaaatggttagactatgatgaagaaatattgcatgcttatatttaggatgaagggagccactttgataatacaaaatccattcaagtatttaccaaacttttgtacaaaagacaaaagtgttcacagatctgctacgcatttgcaaacggaggtagttgtagtagtacgttacgtcggctgttctgttcccttctctgatataaaagcgtgtagggtgttgcaaagcggaaagtggcaaatacgctttcgcttatgaaccccgtgggccatggcccttatatattcctacctgacaacttagaccgtgaatccaacacacgaacggccaggatgctttgccgcttctcccggttctagtataaaaggccactcgtggcgcaaaccctagtagaggagagattaccttggaggcttctgagctcgaaccccccgccgccgccgccgttgccttctccatccgccgccatggtaaggccttgcttccctatgcttaacgcctagattgctttgcgggattcagcgctgaactgacctctcttcttgctgcatcggcgcagaccttcaagcgccgcaatggcggccgcaacaagcacggtcgcggccacgtcaagtacatccgctgctccaactgcgccaagtgctgccccaaggtaaggcgaagcgaatccccttttgccctctctcgttgcgcgcgaggcacccactggatctctgtgttgatttgggaatctttgctttgggtgcgggacaggacaaggcgatcaagaggtttcaggtgaggaacatcgtggagcaggccgccatcagggacgtccaggaggcgtgcgtgcacgatggtgcgtttcctctcccccgcttttggtttcttttgctgaatttgtatgtgatgcgaaatcgtagtagaggttggatttgtgatcgccgataacacactggcgatttgcatactgctggaaatttttattctatcttgatattgttgaattgatggcatacaatacaactatctcgttgcaggatacgttctccccaagctttacgccaaggtgcatcactgtgtgtcctgtgcaatccatgctcacatcgtccgtgtccgctcccgtgagaaccggagggaccgcaggcctccggaacgcttccgccgcagggtacctgatccccgcctcttaactattatatctagtgcttaattgatagtgtaattagtatatcatgatcggaacgatttcctttatctgttactgcagatttaagaaacaaagtctgatatactaatagacgtaatgattttgcacagtatttgtagatatctcttatctgcacatatggtctaatatctttcaagcacgctgaaaaattaaaattctttagtgtgctgattctatgaagtttaccatttagcttttagtcaaatgtaccggcatacttaaggaagtatactcattcagccagcttctataatctgaaatccactgttcttttttggaactgcatgtcttccctgatggcaaatactacatgttgcctgtgggataaacaggtccttgagattcacagcatcattttcacaattggctgatggtttatgtgtaacatttatgttgggatatgtatgatatcctacaaaaaagccagctaccaaaattttgttagggcctcaatccaaaatggccctaacatcaagtaatcaattttcatcgaattcagtagattgtaagctagctagtctgttgttctttaagacaaccttaatttgtgttaacctgttctaattatggaatgctgattgttttgtgccaatgcttacagtatctagcttcttgctagtgggtttgtgtccctctttgttgcatccagaattcagatgcgtttgtgatagtatagtagtatcaaagtggctggcctatgtatcaaaaccacattaagatatctgcaaatatgtccactcatcctagaaagtgattaagaggagcgcatggtgtagttgcgattgatgtgtttaggctgctgttattgatgggctctattgtttgttattttgatccatatttttttgttctcaagtctatttattttggagcgatcttaatcgtgagattatatgtttctaaactagttgccgctattttgcaggaggataggccccaaggccctcgtccaggtggtggcgctcccgctcctggtggagctgctgctcctgcccccaacgttgctcgcacctgattgtctccggagtgataaaccttttttcagtcgtttccctaaatctagcatgataccagggtgttgaactttatctaggaccaacctgttctttttcaaatatcggatctgctgttactggtttcatctttactaaatgtggtttaccatttattcgattcgttctgttcctactcacgccgtgtcagacgttatgtgccgtgtgagtttttctgttcctgctcatgcttgtgagagcaacatcgtatgttctcctaaatcccgagtatgttactttttctttatattcagccaagtgaaacacaatggatgcttaatgtacgttcctgaccaaaatcca

SEQ ID NO: 57390 - DNA, 1075 bp, Oryza sativa
cggcggaggcggtgttccgggcgcccgagaggtgaagcgggagctcgggaggtggttccggaggagggatcgggtggccggtgaggagttctactggttccggccggcgacggcgagctcggatgacgaccgggtgctcgacgcggcgctgcccggctcgacgtaccaggtgttgaggtatacacgtacgccacattccgcctgcgctttttatgccgctatatgtagtaagttttgtccttttctcgcctcgtccacatcaaacgtaggtgcatacttgaagagagtttcagaatttgagcggttttagaagccgattttgatcggataaaatacgtgcgcacttaaaattatgcaaaaggatcagtttggtcatacttgcgtttttgttagctctattgaactactctccactggactggactgaagaatatctcacttgctaccgttctctcgtcgatgtcaattggaatgagctgtagtctgtagagggtacggaactgtgtacatctgttttgagtaccccagagcctccggtaaccgttgcaacttgcaaggaatggaaggcccatttagatgtagagagcgagctagagaaaaaggctggcacctgaaatgttgcaggggtacaggcacagcccatgcaagtatgcgacaagaaatgttgtgtggttttcttttgaaggcgtggatgctgtcttgtggagtcattgtcaaactctatacaacatgccgttccatcacttattttgttccaattttgatgtttcggaagaaaatatcagtggaacaataataaccataatattctgtttctttagcctgagtgggatttccgctgattcttagcgcagttgtcaaaaactcaaaatacaccaaataaatatagccatgaatgtcgaaaattcaatggatatgcgaacgggcctgttctacaataaccccattgggactttcataatggaatttttgtgtacttacatcagatccttcacttcctaagggaaaaaatggagattgtggcatccaaaatggaggatcttgcccaatgcgttatgagagttctatctgataa

SEQ ID NO: 57391 - DNA, 5619 bp, Oryza sativa
ctttagtcttaactacttatattagttaatatacttaacactaatggtagtaattagaaaagattctgtctatttttttgggagatttttttacttacagaataaaaaaaattaagttagatttgaaaactttcgatttaagttttaaaatttaaaaactttcaactcagatttgaaaactttcaacccagatttgaaaactttcaacttaagatttgaaaactttcaactcagaatcgaaattttcaactcaagaatcgagattcaaaaactttcaagtccatatttgaaaattttgaaaactttcaatatgagatttgaaaactttcaactcaagattcgaaaactttcaaatcgagattcgaaaacttttaaatcaagatttgaaaaaaataaaaattttcaaatctgaacttaaaagtttttaaatcaagaatttaaaaactttcaaactcaaaatatgataaaagattaaaaaaataaacagaaaaaagtgtgaacaaaaacgaaaaaattggaaaaaaaaggaaaaaaaaagtcagaggacgcgcgcgccggggctgggccctctgggccgaaacgcgcgcgcattatcttttctgtgattcaacgggcaatactgacaagaaggtagtcatgtgcaggtgctgtcagtctatcagcatcgacatctatgcctgattacgagaacaacgtgctgctaatcccgggccttggtataagattctgaaaagtccatcttgatttagctttgttcgaatagtaatatttctcaaaatactctaaaaacgagctactactatgtacgagcggcacccttcgaatctcaaaaataatactatacagtacgacattacggctcatcctactcgggtttcgacgtattagcgtcatcacgccgtaacatcgatcttttgaaattgggcatagaccatcaaccaccgtcgtctgaccacgaattccacgaaacatgtgaagcacacgctctcgcttgatcatactgcaaaaacgtgaaacgatgtatatggcgtcgcggccagggcactcgcgtaagcccgagagcgatatggatcgatggtggcgagctgatagctccactgagcgcgcggagaagaactctctcgtctcgtcccgaccgcccggccgcccctgctcaccgaccggtcgtcacgcaacgcagcagccaccggcggcgaatccgtttccgggcttctttggtttagtgccctactaaagtattaaagtattggtagtgcgaaaacttaggtatgttttggcactatcaatattttggtagggtagcattttagatgaatggatttgtattgataccaattggagaccaaattttatattatagttaagaaagttctagaattatgccggcagacagcgacggcgaaagcgatccggagaaaccgctggcaaaagatactgttatcactgtaaccgtcaacgacgatgacgacgcattccccctcctccctcccggctcctgctgcccgcaggctcgcttggcgacctaaaagcaggtttaatacctaactactgcctctaaatcatctataacaaatcaaatagtccacttataaaataggtaacgataaaaatatactacaccatttattacccggtctcacttgtcatacacacataacgttttggagtccgtgggttgcagctgactataaatttgtagcccgctttcttctctcttcttttagaaaatgaaaatgggttatatctccggcttctctcataagacacacaatcataaatttaatagtaataaaaatgtaagataaaagtaaatcaagatgagaaataaggaggtgggataattctctcccttaatttttttcttgatatgtggttatagctgacttatagtgctattgtactgctctcgcgccgccgcttctgctccatccttccagcgaaatcccatgcgaaaaccgaagacggcaaagcgtctagctagcttgtcgcggggcagcaggtgggggaggggaagtaggagagcgtgtgaaaccaagcaccgcacgggcaggagcgcgacgacgcttgatagccaggtagctcgtgaaccaagcccaagtagggatggcaatgggtcaggtcgggtacgggtagagcaaaaccatgcccgatccaatgcctaacattgcccacccgaaccctacccactagagttagcgggcaaaattccgtgcttgtacccatgcccgacgggtacccaatagatctcgcatgaataataacttgaaagatatgtaatttaacaaagagaaataaaatcaataatttaccaaattatcggttattgacaataatttgaattacatcacaacttagtatcagttagcatcacaaatgaaccaaaagaaatggtataagaattaagaaatgagtcaaaattagctaatacatatgtatcgggtcgggcatgtgttacctacgggtaaaaaatgaaacccgccagttgcccatgacgtcttcgggtctcgggcggacgtgcccatgggtaaaaagtcacacccacgtccatgtccatcgggtcgggtatccacagatacccgaactcatggataaaattgccatccctaagcccaagattccagcgttcaggccaaaattaaacggtgggggcgcctccatccacactccagagagagtgctaactaattgcatatgcgcactgcaaaacaaagatatggtcctgagccacgcctaaaacgacagatccgtgtgtagtgatgagtgtgaactgtgtgtaacatgcaatggagaaaagaggaggggaaggaattgtttttttgaccttaaactaatctggcatgaaattgacgtagtaccgttttgcttgagcatgaaagaggacatgcagtgtgtactagccctactggcttttgtcttaaaaaatgcgaaacaaatttcttgttacatagattttgtagtaggggctcatacgacgaacttagcatgtatttagtttagaaacaaagtgagatgggttggactcatccctatttttaggatggaatgatcctatctatctatttggcataagggatgggatgatctacttttgaaggaatgtccacaagttagtgagagaaaaaagtaggttcgattggtccgctagttttttaagggccactaacccgtatcctaggggatatattccttgtcggggaccatcatatcccacatgtgcctaaacaaaacactgaaaaatgggttcaacccaatctaatccatcccaaccctttaaccaaacaaattcttaggctgcatttgtttgagcatttcaggtgaaacagttcgtgacttataaatttagaaaataaatttgttttggttttttctaaacaacttctatatgatttatttccacaaaatataatattaaaagttcagggagcattgctaatgaaaaacaagaaaataccatttcaagttggcgaaaagaacttagccttggtgatattttgtagaatcactaacagaaacagaggacattaccattcaaaaagtttgtgcttttttgcgaggattaagtaattttttttagatgaaaaatccatttagagaccttgaaatgccgttccatatctttcatcccttggcataaaatttttattctacctagccatataagttaaaaccaacaacaaaacaatgttaggatccctttgatttgtaggggaaacattggagtttgggaggatttcaatcctatagggaaaaaatcctatgaaaacatttgaaacaaaagattaaatcttattttattctttaaagttcctatggaatagataatcatataaaaattttggagaaaacttagcaagaatatatctctcatccgtttcctatgttttttttccgtggtcgaattaaatgagcttttttgtgtttgtagtccattgttttatatctgcattttcctggcataatcatgtgtttttttattccttcggattttttcatacaattaaaaagggcctttactagtatagcaagtttactgtgacgaaattggagacaatatgaattctttccatgtgaaagaataaacttttacgaagtattttaatttcaaagaagaaactcaatttcttctttttgccaagatgagctccctccaaaatcgatctaccggcatgaaccatccaaaccctccagtaggattacgcaccaaacagggagcctaccccaaccacatcctagagcagccactgtacagccgtcctggctcactgttcaaccgcctcgagattcgtgcactcttcccgtgaggcgacggacgatgattgcccaatcatggcccctccctccctcgggcagctccatcaatgctcgcgtgcgtggtcctcccccggagcttattactcccgaccgaccggcgggcccggcccggcgatgtgaggcgctggaccgatccgggccgtccgatgcaccaacggacggccgagatgctgaccagtccgatcccccgcttcgtccctttcccgtttgactccacccaccttacggcccggcccaccttggaaaactggacacacacacacgcaccccctctctctcgcggatttttttttctcgtctttgaccgggctgtcagcgtcggcggtgggccccactgccaccacaatgccatatctatgaccacgcttgcttgcttgcgcttggaatttgtggatattctcccttgcttggccattctctttgactaattttaagatcaagagagccttctagttctaacaaatcttgcacatttttgcatcccacaccctctaaaaatacttttattttctctggtcgtgtttgtacttgttcctcagggactttgttctgaaatttcttctccatgagctcagggagaagaagtgaagaactcgtgctggcgtgctgcataagtttctacgggaaatcttccactattcaacatgacttgtactaaccaaatttaactctggatttgcttctgctaactctttaatatagttcagttgcaatgtatttaggttaacttctctatggctgtgtttagttcagcgcaaagtttggattttgattaaaatttaagatgatgtgactgaaaagttgtgtgtgtatgacatgttgatgtgatagaaaaggactgaagtttggatccaaactttgaatctaaacacagcctatgtttggactcccaggaagccaatccataagggcaagctgcagaattgtcatctgctagtcgtctgaatctctttcagtctcagttgttcttttcatctaagcagtctacctctacggttagttgtcataatttagcaatgcagtatgtactactagtgcagaactaaccactagacagcttgtcaagctcaataattgtccctgaagctcactcttaatcaaactgcagcgtcaaatgtcggactggcgatctcgcatcgatgattcaaagactcagaacattgaacataggaatcaccgatctttgaataaactctttcatgttcttgccatgtagcaccagtattttccctatattttagtatggcaatggccaggtcattctggagctatttctagatgaaagagctgtgtgctccaaggaaaatt

SEQ ID NO: 57392 - DNA, 2173 bp, Oryza sativa
ttcgtctcagcatgtctcttgatagatcagtgagctgattgtgggaatgaggcagttttagtagtttagctgtctcttcttctccagtaatggtttggaagttcagaatacattgagaggtgttgtacttaaggagagatatcatagttatttttttttttttttttttttttgctgatgcaaggttcgacgccttttgcaccttctgttgtactgcatttagctttagcagatgcaatacatgacaactttttattgttgccgacgactaactgctatattgtgatggggcagctacttttgtgctatgtgctaactcaggatcctatttgaaattctgtagcagctttccctcattgtacacatgatgggttgcttcactgtcctgagatccaagaagaagaagcctcttgctctcaccaagaaatcggttgatgcaagggaaagcacgtcctcaagactcccagagccagaagcgcatgtgccatcgttacatctgctcctcctagttttaggaacaaggctaaaatccaccatcggaaaagaaagcttcttacagcagagcgcgcgtgctgtctgctccttccagcctaattgtggttgatcaggatggtcttccatatgccgaattcgatgatcaagatgactccaggggcaagggaggttctataaagggccaccgtttctctaatccactgccccttcctctcccatcaccagaaggaaaatcattgaggaactttggcagcttccaagccatcaatgcaagtggaccactcgatgcttcaggccctctgccacttcctccaaagaagtgtgatgggcttaagaatttctcctatgaggaactttcatcagcttgccaatggttttctggtgaccagtgtgtttccgaaagtttgacatcaacatcatacaaggcgtcctttagggatgattttaccgacccaaagaccattgaagcaatagtatctcggttgctctcctccactcaggtactgttctccgtaatattgaattatgtgtttcatcttctttgttttcccctggaaggaagttgtattggatgtaaagcggtagctttgccattttgctttgttggtcagcttgtcaaacagatggttggcatgttatggcttacttttatttctctcttgctagtgagtagtgacttggcaaaatgcttgtacactgtaaggattatactcttttagggctttaaccattttgcagcatttcttctattaagaagctgaccttaggctagaggcacggactggttttgtaggcatgtgatctatgctcttaatgttacagctatgctgtctccagcagaaataactctttctatttttggaatgcaaaccaggaccacaccattggggggtaggaacatgctctggactttgaaggcagaccatgtgtttgatcttctttcttcactttactcctagatgctttctccactccttcctaatcatatccagtgactagcgagattttcttttgacgtttgtttgatactttgatatatgatatctcatgctttccactttatgtggtttattggcatggttctgatcttccctcacttgtattcagtattgaaggaatctaaaaaatcactgtagtgttattgtgtagttctgggaattcagtggttcactagactttgtattgtgtgtgtgtgtctaaatctgataccccctttggtgttacctaatgttgcagcaccgtttattggaccatcctgatctattatttacaatttaactggttatggtactgatgcaacacacattttattaatatgcagagtttgaaagagtttaaaacacaagtgaataccttggcatcacttcagcatcccaacttatgtaaactaatcggctttcacgcaagagaagaatctaatgaaaggatgttggtctatgagcgactccatcatggcagcttagataaactactctttggaagatcggatggtcgtttcatggactggtcagcacgtttgaaggttgctcttggtgctgctagaggcctggctttcctacatgatgaagggccttttcaggttactgcttctaaactttttctttttgacattaccaataagtgaatatttattttacctagttatatagtacattggttgatggtttttgaccttgtg

SEQ ID NO: 57393 - DNA, 2344 bp, Oryza sativa
tgctattctttgttaggctgctgcaaacctctcagtggaaaccttggagaaaggtgtactgactcccaagagcaacgtatggtgctttggagttgtcctgctggagctaataacaggaaggaagaaccttgatgtccgttcctcaaaagaagaacgcaatattgtcaagtggagtaggcctttcctcaccgatgatagtcgcctatcgttaatcatggactcccgtataaaaggacgcttccctaccaaggctgctcggattgtagcagatatcatattgagatgccttaataaagatccatcagagaggcctaccatgagggccgttgtggagtccctagcaagcgtccaggacataaaggttccatgtcgatatcctttgcaagagccatctgctgccccaagaaaggtgatgttaaaatctacaagtctcaatggcatcattcatcaccatcctgtcgtaaccttctcaccgtcacctccttcgcgaaaccaacatttgctctcgccaaggtcatccacgtctgcactgcttcctccaaggaccagctgtgctctggatgaccctagagtaagctctatcaagaaatcgccttcccctattttacggagatctggtgttgagggtttttgattgtccatatttttttttctcttctcttcacttcgatttgtttgttgtttttgctagcctagtggttttagtgtaatctcatatattgcaagacaaatggccttatgaactcccttcagtagtactaagaagggaagggtgaactgtagatagaaccaggttgtagatacttttcgttttctaattggatggaagcagcgtgttgagtgcgccttgtaaactccattatgcaataataaacgtgtgtcactcagttcttttttggggagtcaaacatttcagctatttcggttgggtgccaactgccaaagtgccaagtggtgttgttgcttgtcggcacatagattgtccaatgttctaatccacgtgatgagatcatgtcgctgaagttgcaaggatccattgatgtaatatttgctgctgcctgtggcagttagagatgttgaatgactttgaatccctgcctgtggaaagttcatcccatcgttgcagttgttgactgcgacccagcctgcttttgcttctttgaccaaagtttgtcgatcgccggtcaaacttatctcaagcttaattagagtacgtaacaaacgttttataaacatgtgttttcaattggaacgtcagtgacgtctagttatgatgatgtaatggttggtggcatgaaactctactgcaacagtgcaacagcaaaagaaaattttgttgcatcatcattttgtactcagttcacatctgcaatctgctttttttgtgtatgagtttatagtactgaaatttctttcggcgactggaataggacaatgatcttcagacaagggtagtactactctgaagcattgatgacagctccaggtatcgttatgtttcttgaatcgtcagaagaattggtgcaccggacacggtttacttcagtttcttggtcgtcagtcctcgccatggtgcccggtggcggtgggtaagctgctctctttgaccggatcgcgagctaatcagctaactgtaactatctgaatctgatgttaccgtgagcgcgcggtggcctaatccaatgtaccggcagtgaatcatatgactcgattattcaaccgaaatctcgcacagtttgttttgtccttggacactgtcactttttccctctctttttgctcgccatggctgtaaaggtatctatctgggcatgccaaggtccccgtccttagattgccatgattggatcggatggatccagcctaacctgatcggatattatcgatcaggaagatcagatcaggtaatacggatgattaagattttctaacttctctatgataaagttacaaatgttaagttagagaatttgcttccgatcatgaagaaagctacagaaactaaacactggtcacaagcaactatgcgacgcggattgtcacgttgcgtcgttgatcgatcaaaaattaaaatttcggtcgtcacggcaatttaacatgtctgctgttgactcacaaatcacacggctagttacatggcgtcaggtagtggaggtagtagtcaggtagtcgagaagctgcatcctcggcggcggcgccggcgggcacggcgcggccggctcctcgccccggcggcgccctccgccccacgcgccgccgatgccgagccagcagagcagccgcttcaacgcctccagcagccaggacctccgcgccggcgcacgtcccgctcccggtttctcct

SEQ ID NO: 57394 - DNA, 1290 bp, Oryza sativa
gtttggcaacgcagggaagaggattgggagtttagaattgatggtgagattaaaataggattgggagtttacacgagggaattgatggtgagattaaaatgagaatttgatttttaatcccagtatcttgtttggtagaggtagtggaaattgatagagagtttagttggagattagttcattaatgaaaatgaatggctgagatttgtttaggcaaagtaaaggaggaattccgtcccaattaccaccactacccaggtattgaaaaggagggagttcctccctcaattctctatccctatcccacaaaaattctcatgtatcccaactaaacaaaacaattaatagatgggactctaccaagaccatgacgatgacattgggctacattactagtccatgagaaagcccatgtaaagtaatgcatcctttcggaccaaattatgaagtccgggcctaacaagtgttacccaaagaaatttccccaaacacaaagaaatacggccccatcgtttcacatatgtgtgaataagccaaacggtatatttacaaataaaaaataatttgtgaataaaactttttatacatgttcatgttcttaatgatctaaaagcaaagtctgaaaaataaacctcaatgaaaaaaccccaaaaccaactccaaattaagagttgaaaattcaaaatttgtttgataagtaaaagcataaacgaaaagatgaggccaaataatcccaatccaaataacgccgccatcatctaaactttggggcctcatcttttcccttatgcttatgcttatacttatcagctaaaatttaaattttcaactttaaatttagaactgatttaatggttttttcatcgaagtttatttttcagccttacttttagatcactaagaacacatatacaaaattttattcataaattatttttcgtttgcaaatacgtcctttcatttattccggggcttttctctcccaatttccccgccgcccgaatcggccgatcggcaaggagttgagcgattctctacgcccccaacgattttctctcccccaaatcgatggcttctcgcaagtcgctacgacgatcggcgctgctccaactcccttgcggctgcttcgcggagacgagggttgtgctcgatgagaagacggagcacctccagctccctcccacgaggttggtccggatcacgtttttcgcagtctcgattggattcggcttgtctctgtcactagggtttaagggaagctttagggttttgatttttagtttcgatctc

SEQ ID NO: 57395 - DNA, 713 bp, Oryza sativa
agctcgtagcacgacccgcacgccgcgccgtcgttgaacagcaccgtgctcagcgccgccgtgttggtgccgtacccggtgctgtacaggttcccatacccacacgccccgccttttcatgtacacaaacaacacgacacgagtcagattactcccggttttgtcaatgcgtccaaaagaaaaaaaaacaaagtgttacgaggagcagtgcacacgtacccatcgtgccggacgcatcgccgccgccgtagaacgtggcgtgggcgctctgccaggagccgtagtcggcggcggctcgccgggcgaggaagcagaaggccgagaagaggaggagcagggcactactgcgtgaggccattgttgcaaaacagggagaagatcacactaccaacaatgtcctgctagctacttcactcggcttaagctaggatcgaatcgatggttgcttggttgtgaagagagcggtgctcccgggctcaggtacttataggcgactcctccttggcagttagaatcgttgatagcttttgcccaacgacagaggagagaaccggaaaaggagacaaaaggcggcgagaggaaggtgagcccaccataaccggccacgagccacgacggcggttaacacatacaaatcagggcgatcagccccgcacatgcaagtgctcgtcgcatcgcctcgtcggacccgcgcgtcacgcacaaggagacac

SEQ ID NO: 57396 - DNA, 1580 bp, Oryza sativa
tctgcatcggtggtgtggcttgctgagtactgtggttgtaatcagccttgctattattcccccttttcaaaagtgtagtgcttctgagctgaagatggagttagaggaccaagacttagaccccagttgagttttgcctgtggagtggagctgaagcccgctaggatcattttttttttccgctgctactgcttttgtttcggtgtgaggactaagtgcctcttctgtaagtattttacgcttattttacgtttggaactgtatattacttgtcgttttgtgtaccctggctggttctggacagggatttaatacgcaaaatagtctgaaaatttgggttaaatttttgagcgtgacaatgcctccctcaaaaaatcgatccactacgctaaccaatgtagcaggtgtaggtgagctctagcctctcggcatggaggatgtcattcgcgccatatccctgttgtcctctacttaccaagtgcgtcgcatggactccacaccttgaggccgtcgtcgctgccatcctaaaccaatgtccgggaggatcccagaagcgatctgcttggtgggaaaagcatggagaagacatcgaacgagccattgttgagggagcccgtgcaggggtccgatggccaactacgcatccacccttgagcttctagcgtcattgggaaagaagagggaaagagagatgatgccacctacatcatttttattttctgagagccatatagggcctatatgattttgattttttttgtttatttatttttctttgattgaagtgttatgtaagcatcacatcagatgatcaagtctccgtgtcatgtaggcgttatttacacgtcacataggacaaaaccaacgttcatatcgttcagggagataaaacgaaatgattttgtcgggaggggccaagtcagacttgaggaaaagcaaaatagacttttccacccaagaattatcacgaagcaaagcaacgagggaatacatatgggcttggcccgtcaatgtcttgcgtgccctgtaaaaactgaaacagattactccgtactcttttggcccagagaagatcgatttctctacttatgatgagcttaacagcgaggccttacgtaacttggatccagcagtccagcacaaacttgatggcccatggaaacgtatcgcagtaagaaaaccacaacacaaaagctggccgagccacaagattcgagctacattttaataaccggcgctggttttggcgaggaataagtacacttgtggtcccttaacttgtcaacgaattcgattttcgtccttcaaccagaaaaccagatacaacacgtccctcaactattaaaaccagtgcaaataaggtccctcagcggtttggatggcggttttggctgacgtggcgcctacatagctaattcgactcagtctacatctgacatggcattgagtggcgcttacgtggcaattcgatccagagaaaataataaaccccatgggatccacatgtcagtttaacacacaaataataataatgatggggcccacgtgggcccccacatgtcattctcacctctttttcc

SEQ ID NO: 57397 - DNA, 3505 bp, Oryza sativa
aacttgctcttaagatatattctatttaacgagcttcatcttatttatatcacctttataatatcaaaacattctatcacatattaatataataacaaacgctaactaataaagagttcatcaaatataaagagactagtcactacttcctccgtttcacattgaagactttctagcattgcttacattcatatagatgctaatgaatctaaacattatctaaacattatatatatatatgagcaatgctagaaaatcttacattatgaaatggagggagtactatagatgagaaagaagtcttattctaagtttgttttaagtcggaacattttaatctgtgatcattaattcttataaattcatatagtttatcattataggttttatattttcaatccatcatgaaacatactttcctactaacatataattaacattgttgtcaaacctcacatattgtaaataaaatctatagtaaaaaaatagttatgtttaacttaggataaacttagaacaacaaactaattcaaaacagagtagagtagagtgctagagagctaaaaacttataagctcggtttgactcattatgactataaggctcagttcctttgtctgggttcccaacccctccttctcgttttccgcgcgtacgcttttgaaactgctaaacggtgtgtgtttttgcaaaaagtttatatacaaaagttgtttaaaaaaatcatattgtttcatttttgaaaaaaaatagctaatacttattaatcacacgttaatgaactgctctgtttttcgtgccgagggaaccgttcccaaccactagtgttgaacacagccttaagtcagagttgatccaacccatataagtttggagttttttttaaccccagtgattgctacttcctccgtcgcaccatataattattcttaagatagccacgagtattaagaaaatatgtgtaaatgattagagaaagattatgattggttgaaaagagaaagtatgtgaaaaattaattaaaaataattataattgcttaagaagaggtgatatatgaagaaatgattttattttagaacaatacactgcacattttactttgtagtactacgaacaagtttaatagtatagtcaactactagctcaaaatcatatataatcaatttaatagctaattcatataatagttacctataaacatatactacactattaatatatggttccacctgtcatacacaaattgtgtattagagttccgtgttacagctgggcgctggctacaaatctgtagcacactgctattttctctcattttttttcttgatatgtaggccgagtttagatccaaattttttcttcaacttccaacttttccatcacatcaaaattttcatacacacacaaatttccaacttttccatcacatcgtttcaatttcaaccaaacttctaattttaatgtgaactaaacacacacgtatttagttgtttatagttctattattgtacgtgctctactagcaaaaactgtatagattctactttaccagcattgtcctcggtgcctcctgactcctgagcaagcaaggcggtaaattttaaattttcaaataagttgcactgaacaatgctcaccaaccggaccgtgagggtgtcccagttgctgtgctgcggcgctactcttgccctggttgctccggatcgcaataagttcccccataaatgctgccattcggagtggccgctgtaaatgaaggttgttgcgacgcattgaatacaagcaaccttcagacactgcagacagccgtaggccaggaaccaggagcttttaaaacctctgaccctcttttcctttgtggtgaatttccagagggtttggaaaattgggggtataaaacaaactccgttttgttacactagaacgaaacttctaaaaaattgtgctctactcctactcatcaaaatacttctactagtaagctcaactcctttaaaattcctgcaaaattcctcgaaactaaataggccctaattaaagaggaagatatatacttactatatcatatcatatcttcaatagcgaagccaatgatgtcgtttagtttaaggaaacaaatagcatttttggacgattaactagtttctgtgaacgtcaaaggtagtaattcattgtggagtaatcaacaacagagcctgaagtcgtcctgcagccccgccaccgcataatgctataggaatacgtaacggtgacagtgatatcggaggcgatataaattgtgggactccatgcttatcaaacgatgtttggaggaaaatgttgcaagtccataatggtaacctatttaattccatttcaacaaatgaagctgtggaagataatttatcttcgaacaagcaattaaaattcacttaatatcaatcatatgtaagattaattatatagtttccacctatgaatacccaaaaaaaggagtcgacaacatgagctaagccaagattaaagctgtaccaccattttttctctgcaagataaaaccatagaaatccagaaagccaagagaaatcattttgtcgattcctatttgttctactcgtagcacattaatagcagcacaaggccccccatctcctctcctctgtgcttccctcactgcgccaccactccaccacctccacctcctctccaaaaacttgccttgccgccgcaaatggacaaggcgccgctgtgatccctcctccccattgcgttctcccgcttcctcctcctccgcgcgcgagatggccgccgcctcgccgctcgcgcggctcctcgcggcgctgctcgccgtggcggccgcggcgacggccgccaccgcgctcaccgacgacgtgctcgcgctggtggtcttcaagacgggggtcgccgacccgatgggcaggctcgccgcgtggacggaggacgacgaccgcccttgctcctggcccggggtcgggtgcgacgcgcgggcggggcgggtgacgtcgctgtccctcccgggggcgtcgctctccggccgcctcccgcgcgcgctgctccgcctcgacgcgctcgcctccctctccctgccgcggaacaacctctccggcccggtgctcccgggcctcctcgccgcgctcccccgcctccgctccctcgacctctcctccaaccgcctcgccgcccccgtccccgccgagctcttcgcgcaatgccgctccatccgcgcgctctccctcgcgcgcaacgagctctccggctacatcccgcccgccgtcacgtcgtgcgcgtcgctcgtgtccctcaacctctcctccaaccgcctcgctggccccatccctgatggcctctggtcgttgccttcgctccggtcgcttgacctctcgggcaacgagctctccgggagtgtccccggaggcttccccgggagcagctcgttgcgggcggtggacttgagccggaaccttctcgccggggagataccggcggacgtcggggaggcggc

SEQ ID NO: 57398 - DNA, 2311 bp, Oryza sativa
  unsure (1)..(2311): unsure at all n locations
tggcgggatgaggctgctcgaggtgctcgatgtgagcgccaaccgtctcgacggcggcgtgcccccggagattggcggcgcagtggcgctccgggagctgcggctggggcggaattcattcaccggccacatcccgtcgcagattgggaattgcagttcccttgttgcattgtgagttctttttactcctacttcttttagcatgtattttttattgaattaaatcaaattcgacgtcattgcggttgcttgttagtgaggttgactagttctatttgttttttgtattatttcctgcatgctttgttggctttcagtttcgtaggttgtgcagagacgttgtagaaagtgataggagacaagagatcctgatgtcttattttctgtttggacccccaaaccgcaaaatatgggtctgtgtcatgttttttgctcgtatcccagtgtaacctgggccctcattttcttcgatacactcaaaactgaagtcaaatgtacatgaataggatcttgagcatttgcttcaatatagtattaaactgatcaattcgatcaaaccgtcatattatttggttacggcgatttaacattatgaaccattttaagtttttaaccaagacaatgttttgctcttgaaatgcagggatttgtcacacaataatctcacagggtcaatccctagcaccgtaggcaatctgaccagtcttgaggtggttgatctatcaaagaacaagctgaatgggaccttaccagtggagctatctaatctgcccagcttgcgcatctttgatgtctcccacaacttactatcaggggacctcccaaatagtcgtttcttcgacaacatccctgaaaccttcttgtctgacaatcagggcctctgcagctcgcggaagaacaactcctgcattgctatcatgccaaagcccatagtgctcaatcccaactcctcgacaaacccattgtcgcaggccacaccgactgcccctagcagcatgcaccacaagaagatcatattaagtgtttccaccctcattgccattgcaggtggtggtaccattattatcggggtgatcatcatatctgttctcaaccgtcgtgcccgtgccaccacctctcggtcagctcctgctactgcattatctgatgactatcttagccaatccccagagaatgatgctagctcagggaagcttgttatgtttggaaaaggcagcccagagttcagcgctggtgggcatgccttgttgaataaggattgtgagcttggtcgaggaggttttggtgcagtctacaagacagtgctgagagatggccaaccggtggccatcaagaagctcaccgtttctagcttggtcaagtcgaaggatgactttgagagacaggtgaagttgctcagcaaagtgcgacaccacaatgtcgtcgcactaagaggcttctactggacttcgtcgctgcagctcctcatctatgattacctgcccggaggaaatttgcacaaacacctccatgagtgcacggaggacaactcgctctcttggatggaaaggtttgacattatccttggagttgctaggggtctgacacatctgcaccagcgtgggatcatccattacaatctcaagtccagcaatgttctgctggacagcaatggtgaacccagggtaggtgactatggtcttgccaagctgttgccgatgctggaccggtatgtgctgagcagtaagatccagagtgcactggggtacatggcaccagaatttgcttgcaagactgtgaagattaccgagaagtgcgacgtgtatggctttggagtgctcgtgctggaggtcttgacgggcagaaggcccggtgagtacttggaagatgatgtagttgtgctatgtatttggtgagaagcgcactgaagaaaggtaggctggagaactgcatggatcccaggttatgtggtgaattccccatggaagaggcctgccaatcatcaagctggccttgtttgcacctcgcgggttccatcgaaccggccagacatgggcgaagtggtgaacattcttgagctggtgaggagtcctcaggatagtctagaggacgagctggtttaatgtctcttgccaactctgttctgaacggttctaggcgtttttttttcctttttgttttaatgagatgcatatagtgtaatgctaggtgggaagaaatcagaagaaagcaagagtggntatggatcgtgaaatgcttgtagtttgcttgaagttttagggaggttgcaaggctattttgttgcttctcggcaattctttgatccatttct

SEQ ID NO: 57399 - DNA, 1228 bp, Oryza sativa
attcctgcagcccattgcctcggtgccgcatatgacgtctcacaccgtgacacagtcatacaactgaatgaatgatgatgttcttagggtgtgtttaaggataagaggattgaggagattgggaagatacgcaaaacgaggtgagccattaactcgtgattaattgagtattaactattttaaattttaaaaatagattaatatgatttttttaagcaactttcatatagaaaatttttacaaaaaacacaccgtttagtagtttgggaagcgtgtgcgcggaaaacgatgtgcattcttactctctatcacccaaacaaggctgtgtttgctgggggaggttgggaacaaatcttcttcgcacggaaaacggagcggtctattaacgcatgattaattagaaattagctaatttttttcaaaaatgaatcaatatgatttttttaagcaatttttgtatagaaactttttgtaaaaaacacatcgtttagcagtttgaaaagcgtgcacgcggaaaacgatggagaggtgttgggaacccttgggtccgaacacacccttagtagtgttgctctaacatttttgctttcaaatgtgtggtagatttgactccactgtactggtgagtgtcaataccaacagcccaagccacagcagggtgtttgtacttgaattaggggtactgtattttacttcaccagtgactaaagtaaatcacaaaagatgtacagaaaataatcaagagatgctaatgttgtacagtagtactactagtactgaaccatcacttgaagcttggcattgtttcatgattggtagagttttggcagccgttgaccctgtggaatagggaacagtatccctctgccttccctccagcaggggtgcccccatttgcgcgaggatccatggactcacctgtcctttgaagcttccaaaaacatgggcaatgagaccctgtttataatcacatcgaatatttgaacactaattataaatattaaacatagactattaataaaactcatccataatcttggactaattcgcgagacgaatctattgagcctaattaatccatgattagcttatgtgatgctacattaaacattctctaattatggattaattaagcttaaaaaagttatcacacaaattagctttcatttatgtaattagttttgtaagtaatctatatttaatattttaaattagtgtctaaatatag

SEQ ID NO: 57400 - DNA, 6265 bp, Oryza sativa
ccaccaccacaggaattgaatagatggccttaattgcagcacctacccttttgctcctcctccccttcttcttccacctcgtgcaactgtggatggagtgcgtggcaagcgggctgcatttactactcgctctacctttcctcctccctgatctgcaggagtggagtagcttcatagcttcgcagtaaacgtagaagagggcaggggctttcatggcatcggccgcagcaacagtgctgtggtgcggtggtgttggtgtgaggaccccgtttcgatttgtgctaaggcctggtttagttcgcaacattttcgttaaacgtccaatttttccatcacatcgttctaatttcaatcaagctttcatttttagcgtgaactaaaacacaccctaagctaggagctcaggaaatattcaaagattaagctgggagctcgggaaatattcaaagattttgggtttgggaatctttatattcagattctgtaggatacatgtttcaatttgctcctctttttttttcatgctcaggataaaacaggagtaaggttgaaggatgcttgtattgcaggagcaactcaattacacctttgcctggagtggagtgctcgactgctcctactttgtttcgttgccggcaaaaaaaaaaagaatgaaagaaagacagccacgtaaaaagaaaaaggaccgacagaatgaatccatgcaatgaacaaattattgagggtgtgatgatgaagattcaaatcagaacagtgctataatataccgagtgtccgcaccaaaattggaagtttaaagaaaaaagttggaagttgatgtgagtacgaaagttttaggcctagttcctaactttttcttcaaactttcaacttttctatcacatcgaaacttttgtacacacataaacttccaacttttctcttcaaacttccaattttagcgtagaactaaacacatccttgatgtgatggaaaagttgaaagtttaaagaaaaagttgggaactaaacaaggcctcaatagacggtagaaatccatcactctctccgtttcagtttagatatgtaaaaaatgcaacaaatgtcattggcaaacgtcctattctaaaaatactatcgacgaacgcaatttcaacaaatattgttgtacaaaccaacttaccattaaaaataccattatcgttagggtttcactaatttctctccgctaaaatgtgatgaggttaacaaagagatgcaagttgatttgtacaacaaatattgttatccaaaccaacttatcatgaaaaataccattatcgttagggtttcactaattactccatcgttttagtatagcagtactaccatgttcttagagtggattattgcaagtgtgattcattatctggagtaggacttttgcttttgattcactcagaaggaacatccatagcaaaatatgatatcgattgtcgtcaagatgtaatgagcactactcattactcaagagtgcattgcttaaagggccacgtcacgaggcctcgaataaacgattttttttagataatgaaatataacatcccagcctttgctaaaaaaaagctacaaccaattattataaagtagcacttcaaaaaaaagtgtagttcagataaaaagaacacactaaacaaaaacaatggtaaccaagccaaaataaggagaacacatttattgaagtctatttgtgaacctccacccataattggcaaatagttgcataaccatcgactccaacctgcggcatgcagcctttaggaattccccatcatcctcacacctttgtagctgtgccaaaaaccggagccagtgcattgccctaaaaattacctgtatatatgtaatagatagtgatttgtcaaaaccaaatcatttctactcaactgatggaacgagcagtgtcaaagaggctagcctagcctgtgataacggcaatcaactgatggtaaaatcgtcaccgcccgccgcgggggtcgctggggcgggtttgtcgcgttgctgttgcgaagattcggagaggaaagttctaaaaaaaaaatcggagatcgatgaaatcggctcgcactcggaccaatgccaattgacgacacatggtttgaccacgacaaaaaaagaaacgctactcatgttgtcctactgtctacggcttctcctacgaagaaaaaccgtatcccgagatgttccgtggacgacgcgcgcgcgctgtcccgtgccgtgccgtgaacggtcgtctgccctagtactcctaccgtgctgtgagcccgtgatttttgcccgtttcgcaggagaggcgcccgcgcacctgggcgccgcggtcgcggatgcggatgcggatgcggcgtggtgggacggtgtgtgcgatggcgaacggcgaaggcaggggcttggggcttcgggggcgttcatttatggtgggcggcaagggtgttggtgtgtgtggtgtaaacctggggccgtttggtttcatgggccaatgttagctctcaccttttagtcttaaattaagtcttcaaggatctaaacatgtggtctaattttaagctaatgtgaattagcccccctcaaaacattagcccctccaaggggtgctgatggggctaattttatgtggggactatcaaaaagcagctttttctctccttctctctcctctctttctactctctccccaccttttagccttgaattagcccatagatccaaatatccaccataggctaatgtttagcctaacaatttatgactaaatattagctgtcaaaattagctctggactaatcttccaaatagagccctgtgagcgtcgtggccgtggaaacaaaatgtgtcccattagattgtgtgggtgcttcgccccacacagctcgcccattagattgtgtccgcaatcgatcgtgtcagccgtcaaccagacagcaacaacagtgctgtgctgctacggggaggggagggtgtgggggctgcatgtgtcgtccactcttgcatgctgtttgactagtacgtgatgcacatactagtagtctagtgttacgtggtagttgggcacgttgtgggcgtctcggagtcgccacgagcacacgagccgaacaaaatcccagtccattggacccatttggcctcgtatatattcgttataattaaaaaggagaaaaaaacatatccagagattaaaattagaaaatcggctaataagactcggagttttaacctccgatccccttgacctcgatgctttggtagtcatcatgtaattttccctgttctttctgcaacaaaagttggataaaattttagatactcgtggcacgctttttaaatcgttaaacgatgtgtttcgtgtgaaaactttatatatgaaagttgctttagaatatcatattaatctttttttcaagtttataacaattaaaactcaattaatcatacgttaatattacctcgttttgcgtaaaaaacttaatctttatctttaggagaaaagaacaccgcctttattgttggccgatctttgtgctgattcatgcatgcttcatccgctagattgtttctgtcctcggcagtagccatggatgatatatgaatacgctagactccgactcatggtcgagagtctagtcaatctaggtgattagatgatatactgtataatacttctgtcagggttatgggtaccacatacctaatagtagtcgactaaatctcggcatgacccaccatataccatgtcttatacgaaaactgacctcggatatggagggagttccgaataaggaaagagaaccagagttctacatggaaacgacaagaactctcagattgtatccatattggttttcctagttctgcttggacaaggggacacctatgggtataactacaaggccccttaggaggagaggggacacacccaccatagaagacacggaacaatagatcaagacagaagatcaacatacaagccaacatacgccaagacaagacgccagatatcaacttcagagataggcatgactagtcccctacggtgcctatggctaccgtcaggagagacataacgctatctctgatctcgccggatgcggattcgaggaggaagtctaccctggtgtcgactatgagttagaacttcagaccgccaagtcgacaacagttagataggctaccccaagtattgtattggtgtgattatggtgaataagagcaatgaccggcttcggccaacaggatgtagggttattacctgacaattcaggggcccgaacctgtataaaaatcctcgtctctgtctcttttactacaatctcgcgtatatcctagtaccaacgatccccatactatgcaaatactgaaatcgcgacatcaaatgtcgacaacttcctccatccacaaaagttgcacatattacttttgtcaccaagatcaaggagaaattaaatcatcttggatgttacaaaatcaacgagtaaatgtaaacaagcaatcaatgaatatttagattactcattgggttctcacaaacatttaatttatctcttcatttaagtcttagatgtataaagactacaaataagaacaacttatttgaaaaactcaaatgtgaaacatgtctaacttttatggatggagatagagtatatcatcggcttttttagcacgcgtataaattcacttaacatgtttggagtactagtggcacaataatagccaggtgcagccactcacgtacaacccctttagagcaggtacaatagcaggctataagccagctgcaaacatattttaagaagataaataaggagaaagaagagcagcgggctacagatttgtagtcagctgtagcacggactccaagacgcagtgtgtgtatgactggtgggaccaggtattaatagtgtagtatgcaactattgatgaatgagctattagattggctatagatgaattggagttagtagttggctatactttgctcttagcctcattcaggctgtgtttagatccaaagtttggatccaatcttcagtccttttccattacatcaacctgtcatactcacacaacttttcagtcacatcatctccaatttcaataaaaattcaaactttgcgctgaactaaacacagcctcagtcgttgattaagaaagagaaaaacatgaccggagattaaaattctgttccgccgcgtttgccctcgtcaactaatcttcaaaccctagtgacatcgttcgagaaagaacccaaaagagtaaacccggctacgggggttcggaatttttatctccgaacccccttgaccttgctttcactcgtgctttggtataagacagtgaaagagagaggagatttcatctccatgtacatagcgacatgttatgtgaatttgcggtgatcagattctgcggctaaagttgtgtgcttatgttgttcctgcatgtttcggttgctagattgtttccttgggcggaagcggccatggatgatactgtggtactacatgacgattcattctttaagaaacaaagggagcgcagtggaaaatggtgaatgaagattacgagatggctgcgttcgttccatccaacactacagaaatttttagcgcacgataaaactcattagcatgtaattaataaaatattaactattataaatttaaaaaatgattttctttaatttttttaaacaacttctatattttattttaaaaaacgtatcatttaatagttagaaaaatatattgacgaaaaataagtaagatgaagtttggagtttaagaaaagaacttgttctccccctaagccgagctcgataccagccacgagctctcgggcgcaactagcacaggaagtgaagttcgtaaattaatcagaaaagaagcccgtgggctcaaaacgctccaaatattgcctcagtacggcccaattcactccgaaggccagcatccattgggccattggcccattggccgctccaactgcaacttgaccctaaccatctctgccctcttctccacttcccccatctcacccccaagctcggcgcaacctctctcgacgtgctaatggcggcggcggcggcggacttcgcggcgagcaagcgggccatggcctacgcgctctgcaagcacctcagcctcgatccggtgattccccgactctctagccataaaaccgtggatttctgttctggtcgcttcgaagcaaaagctttctcctgctattgttgttgtttagtgctgtcgttg

SEQ ID NO: 57401 - DNA, 1810 bp, Oryza sativa
gaaaacgagttgcagaaatatccacatgtattgcggtggatggactatatccaggttcgaaataaaactttatttattttgtactatcatactttgttagtatcttttttcatactacctccgtgccataatataagcacatctagcatttgaaatgtgttccaaaatataagcacgtctagagtaataattcactcaccaaccaccctaatttatgagaggcatcatagtcttttatgcttaaccatagtctttgctagaacacttagattcgcttatattttggaatggaagtagtagtttgttgctatatgttgtcaacatgaagtacatgtgcccttcattatgcattaaatacccacacgcatatagtttttaggccgtttctattgacagtcccctatgttgctttttgtggtataccagcactgaggtgaatgcacataccatgttttttttccttgtatgtggcctggtcttattaccagtttgttcatactttattcgttaataatcagacccatattaccattttatttttacatattatgtgagtccttattgattgacgcagaacatcgttgactttggctcaacagtacaaaaggttaacttgaccaaatatgtcttcgatccaccttctgtaagtaaagatcctttcccaatgtgggctagaagtattacattttgggggtacacatattcttgaatacctttgttgtatactatcgatgttataagagacacagttgaaaaaaattaactctgtcaacttaatgcaccctactgtgtcaaaatacaattgtgtgcttgttctgaaaatacctgtacatgttcatatcagattatgtttaagatctggttgatataaaacctttgaaagaactactgacataatctgtggaagtgccatagtgctgggaagaaatatcaatatcaacaatttttgtagaataatcatacagtatactctgttgagtatgctatttgaataaacaaatctgttgaggagtaatcgtacaatgtcctatttatgtgagacaccatccaaagaaggccgataaaggtgacactgatccaagttcaaagaaagttgtttcaggacaaaagaatgtgggcaaatcggatgcaaatgttgattccaagaaagctgcaccagaggtagttcattatgcaattatgccaattatcactagtactttgcagttctggattagtatgatattatctcagagaggtattggtaattcatgttactttgaagatttggctggaattgatattattgcattttcaactcttctctagctgcaattcatgtagggtctcatgtgcaaatgcagaacaaaactctgtggactttatgtccaataaagctctttaatcagcacataaagtattaaaatgctttatgatgtacagatatctgttgtggaagctatttttttcccctttcaagttagttgattagttcctttgttggttgaatcagaataaagctcctgagaataaggcaaatcctactccagcaaaaaataacaaaccttctggggataaaaagaaagcccaggagaaatctgcaggaaaaccaaatgagggagttgcggataaagctccacagaaaactgcagaaaaggactcagaatgcaatgtcagtatcctgaatatacaggttggccttattcgcaaagcatggaagcacccatctgctgacaggtacccataacttttctgcttatgcaacaattcaaaatggttcaacagttgtattgggctctttgaacaaatattctaactggtctctcttttc

SEQ ID NO: 57402 - DNA, 1716 bp, Oryza sativa
gtgtgacttggaaaggtgataggatgtactccctccgtttcatattgtaagactttctagcatttcccatattccatatagaatgcctaatgaatcctagacacaatatatatacctagattcattaacatctatatgaatgtgggcaacgcctagaaagtcttacattgtgaaacggagggagtatcaaacatttcagacgtttctgtacatgttttctgcaggacaagtacgagactcttggcagaggctggttaaattcttgctttgctgaaggaagaagatgccaatggtccaacctgtgactgtcacgatgacaaaacgcattgccaggtggacttatactgtgatttgctttatccttatcaatcatggtaacattggcaggaatggataatttttctatctaagccaccagaaatcaatgggtctacttttgtgtgtcatgtggaggaactttggggcaggttaaccatgtgaccagaaaaggattccacacttagttctagtggtaggaatgcagtcatatgttgatatttgccctggaactggaagcaaaatcataattaaatattttctgaggaacatcagatctttttttatttaattcatcctgattccttttctttgcagaactgccttcagatatatgcaattatccatatactttttgtttctattgcttctgctctcttctgcttactctctcttatactgtatagaaacatatactagctgaattccgcaacacaatacctttattttgtagcaaagcgcaaccttttcagagctttgcatagctgtggttgaattctttgtgaaaagaaagcaaaagatgataactgttccctttagaaacacatttcctgaaacatttgttgactgggtctaccacattcgagcagacgctatcagttcaatcaacaaactgcccaaacatatttgtatacaacatctcatatcctcacagaaagcagctacagtgagtgatctgtaaagtcaattgtagaaaatctgctgggtggcattaagaataacattcattgtttatgcaagggtgcagattatactaatgcaaaatatgattgtttggagcaaagctacaggcatctgcatgtggacgtggatctcagaaggtaacttgtgcagaaagactaattgagattgcattatgaaagacagcagtaacactagcagcctgtgggggacaccatcagcaagacagcaaaagcctgcatgattcatttcttcccccaccacaaagcattgaggtttgctctcctgcctcacttattaaatctcacttttccgcttaaactgttatagcgcagcaccctcgtcgctgtgtctgggatccacggcagtaaaataacattggcacatgcttactatacactggctgtctgttaattaagtgtcattggcttaagcaacactgcatttagaaaatgtttactactgggaattcacaatgacagtgacgtgaatgagctgacaaggaatctggggtggtctgatctcacttgcgtatttttaaaccgcgattaaaaaaagtcaatttgattggatctttaggttttgtacattctctcgcctaactctatctgtccttttatctttaacttccctcttattgttcacaatgtaatcttgtactgaatatacaaaatagtagagctggctctacatttttccgtaaaaaagagaagaaaaact

SEQ ID NO: 57403 - DNA, 1981 bp, Oryza sativa
ggcttaccgcgggggtacggtaatataaataccgcggtaacctctttaaattcaaataaatttaaaaaaaaatttgaatttttgataaattttacacagttttgtacggttttttgcggttaccgcgcggtaaccgtgcttaccgccggggcacggtaaccctagccccaacggtttgggaaaccctgttgaccaccggagaaatctggtgagcaaaaaaaggagaggaaaaatttacagcaggtccccgaatagccgcgcgctattctgaaatgaatgacggtgcagagacatcagtggaaaatgtagcgagtagttcgcgtgcacttaattttcacctgccaacaaacttcttctatccactgccatgaacagctaccacgtaatcaacaacagtcggcacgcaccatacaggcatgcacacactattggccattttctttcccctgttgatcgcaacaagaacttgcttcatacagcgcatgtacgagacgcgatgttgcaatgttgcatgcatacgatcgagacgtacgcagtaaataaaaggcgagagctagctagctagccggctatcgcattgacgcctcctgctgctggcctcacagaccggggcagcagcggctgtaaatgtaatcagatggctctcacatggccgctgctcgtatagcttcataaattcgtccttgccacctacacaagcagagccagcaaccccgtcgtcagaagtgttggcagatctaaatctgtaaggaagcagcatctgatgaacccgatcgaccagcatctagctcatctagctccgccatttacgctcgatcgcagaggtgcaatggctttaggcaggccacgtccggggcaagtcattaaatcagaggtactccatggctccatgcaacagtcacgcgttacggactcgctgtcgcctgtcggtgaacgaacctgtgcaattctgcgtcatattggacggtctcgaattattggccgaacaatctggaatctgcaggactatacgtcggtccatgcagaatttgttcgtcgatctgattattgtagcaaaaaaccgagctagacacacgataggattaggatatacatcgacacccatagtctcttgcaacacgtcggatctcaattagtatctgcactaaccatattgatctaacaaaacatgattatagtgtaagatcaatgtgtgttttgattcttattctgtgatgaacaattgacatatgtgattatcggttttgatatttggagattatcgtcgaagtggttttggagataatcaattttcaggagatgaatagggtttactgatttgtcgggaccggtcagaccgggcggttgttgccggtcagacaggagctatgtgagcggtcagaccggcttgcccgcggtctgaccggccgacgctgtgtcggtttcggtttcgggttgtttctttggatatccgtgattgtttcatggttatggcttatagatggatactatacgtatataatactgttgtttgctacgaatgagttaagttggagatagcttggtctcgaaatatggtttctttgtttgtttcatgtataggtgactcgatgcctcgggagagtatttgcggtgatggaccgggagtcggcttagtggtaagacgatatccgtggtggttagatatcatacgagatactaagactagagttgatgcacgtggttggtgaagattccatatggcatacgatggaggtattgtgtgcgtatggatgcggagtcgaatttggaaggagtccaaatttggtacgattggttatgttgagtttctttcttgtactagagggtttcgtaaggtgtttaggactcttagtatgagtttggttcgtggctttaggctgcctacctcatgtataaatagagggggagcgtgaggctttccggtatcgcttttttatcgcttttcaaagcgtggagttgatagtttagttagggtttcgag

SEQ ID NO: 57404 - DNA, 972 bp, Oryza sativa
tgtttttgggtataccaaccattcactcctctctggttggtttagttcttgtgatttaatcttacatatagtgagttctcgcttgctgtttttgcttctcttccttttgctggagcttattggtttcttagccagcgtttctagtttctctttcttttcctgttcccgaatcccgggcgatggttgtccggctgccgtgtcgtgtaaaaacttgcttttgcttattctaatagaatgacgtgtaattccttgtcacattcataaaaaaaatgaattaatcatcgcttcaccgtcaaaagttgtatggttaatcctaccgaattgtcaaatcgagcatggcatacgttaaaaagctcaaacagcaagtgcatcttgcagactacaccatcacagagtccagaattatcagaacgatcaaacgtctggtaaaaatgcatcccccaaaaaaccctcctcctatttcagtcaaattctgaccacacacacggccatctgctaccagctcgcgttcttaactcctcccctaaatgcactcaacaaccttagtaaatccaagctaagcttcctccgctatataaacacccccaggaagccccattccatccacacgtttcagctgtctttcagtgttcacgtaggttgtagagagcacaacaacgtacgtacacagcagcaaagactgagactagctagcttagctgacatggctccaaggtgcgcgacgctggcggtggtggtggtgctggtggcggccgtggtggcgccgccgacggcggtgcgcgcggctatctcgtgctcggcggtgtacaacacgctgatgccgtgcctgccgtacgtgcaggcggggggcacggtgcccagggcgtgctgcggcggcattcagagcctgctcgccgccgccaacaacacccccgatcgccgcaccatctgcggctgcctcaagaacgtcgccaacggcgcctccgggggccc

SEQ ID NO: 57405 - DNA, 3109 bp, Oryza sativa
cttcctctgtggtgtttagcagtttagggatcgtatgtctccacagttcctactatagtgtcgcttgggcgatggtggagctatattgtgcactttataaggtggtgttattatgtaacgcctgtgctagctttggtcctgatgttctccatgtgaactgtgtcaaccgtccattgttctgcaaatctgcagtatgtactgtgtgtgatagtatcaagctgaacttctgaacatgcatatgaaccctcttcacatgcacgggaaaagacattccgaacgccatcatttagcaataccacgctcttatcactcgatcattgttacggattatctagttgattgtaagggtgaatattataaaaaataaacttaaaaaaacagcttaacacaagttgtttaaagtaatttaagtagaataaagtccttcgagaaaatatattttcagaaaatggaacaaataatccgttcatcaataactagcctactatggtaatgagatcctattattttccatcggtgtgtgttttatagcctgtgcacatatattttatatatgtattttataatatttgtgcaaaatcattaaacctatatacagtgaaaaccattatgaaattattctaaaaacctaggcgatcatggccgcctggttggaaggaatgtgggtacatatccttgtaatgatttcttcctcaaacacgttcttttgaaacaactaaaatatagtgcaatgttttccattgatatagtaggaaaaatatcaagtctatatatagctctaaggctatagccatgaaaaaaaaatacacacataaccatacattttgagtgcatcatgaatagcttacccaaggatgaggatattatttataaacaatgtttactatagatgtatatatacatatatcgaaaaattatatgcaccaccttatctcttcccctgcttattctctaggtcttttcttttccttctgtctttctttccagtatagcaaaattatatgcaccaccttatcttttcccctgcttattctctaggtcttttcttttccttctgtctttctttccagtatagcttcatgcaattctggaatcctcttgaaatttcccatccatctaattcaatggttaagattgattgacccttttttgtctcccagtgaatccgacggctaatatttttcagatgatgtggttaatctcgtgtttcacttttcgttagttaaagagatatggcgaccaaattcgagagcgttttccttgtggcttttgtaggtgaactatctatatatttttcaataaattttctcataaagtggaggttggggggggggggtagaatactcccactcgtgcatgccttgtgattttttcccttagccgtttgcatgaattttgagtaaatctaactattcaaattatatgaaagttccatcaagttacaatataattacactataattatattgtatttaattttgatttttgggagaaattttatcaataaatgtttagcaaaatcgttgtagattaccgataaatattatagcaccctcaatgcactgagctgctgaggtaatatatgggcttaattcgaaagcccagttccggcctctttctatccaccgtacaaaaggaccgtctcgtttcagttgaaaggccgaattttgagagaacggcccaaaaaaggggccaaacggcccacttctccgtgcctactgcctacgcgtgcgtgtggcagcctggcaggtttgcagcagtggccaggatggtaaagcagtagcattgctcgatgccaaaccggcggcccggcgccgacgatcgccgtgtgccgacgcccgtagagattcgccgatctgtccttgctccgttggttgattgcggccacagagaatcgcgcctaattctccaccgtccgtttcaacaagcttaacggtgtagatcacccgacgaatttttttctcacctgctaggcgtgccgttgattgcaaattcgaacccgacagcaacaatgccgccgatgacaacacgaacagtcgaacacgacgatgatggtgatgaagaaaagggcccatgttgtacaaaaagtttctgcagcgtgtgccggctagtaaatctatagtactagtactagtactaccttctactgcctgcaacgaaaggatactcgacaaagaagactaggcgaatagcaggcggctgcctttgtttcctccgtcagccagccgggcatcgctaatgctaatgctaatgcagtcttgtcaagtggcttttgaggttttgctaaaaagatactgagcttccgagagatgacacgattgatcagagatagaagaacgatgcggagagtgagacttgagagatagctcgaggagttggagtacgcccaatgagccatgcacacaacgggccagggatacgtacttgctgccaggcctcctagtgttaccgtgtcagcaccggatattttcactttacccttcggtggaggtaaacagccaagatggccccggtccaccgcaaatatctttcacaccgtccgtcactctagccagccagcgagcatcagtttggcagaaatcactgatcaggtgtctagctgtcgcgctgaccaaaagaaaatgcaaagtttacagaagaagtccacggtaagtgttgtggtcatggcaaatgttcagcggaaaaactgccacgctggcatcgttagttgtcagttgtcacagccaaatggtcatatgttcctggcgttaatttatccttacgattttgttcaattaatcccatctaatatttttttcatgggaaatggccaaacaaggcctaagtaaattttgaaaaactatggttgtttagttcaaactatcactaatcactttgctacaattttaattgggtatttcacaaaattataacaataacaaatgattttattagaaaactataactacattctctatgtgtatggcgtgtaaggccaacttaaaacgatgtgagtattacatatttggatgatatgtgggctcaaatttatgagacaaataaagtcgcagctttattaaagaactcccatgttacactattgttgcggttctctgaaatgatgagttaa

SEQ ID NO: 57406 - DNA, 746 bp, Oryza sativa
tacaatgccaatcatgtgcagcaaaaaagtcaatatcgctaatactccatccatcatgttttatgtgcagtgatagctagcttgtagcctgctattatacttgttcttattgatgataaacacggctgatagacacgcaaaattcctaacagatagtttcagatcatgtagatttcgtttcgagttttgactctagaaattaattcaagatgaagttcattgacatcatgacatgcaagattacttatttattatttcagaataaaatgaaagctgcaactagaagcaaaaggaacactcagttttggatttggataatacatgtctgctatcaaagattcaagaagtggcttagttaaggaagagaattttgatatccctcgaggggatatcccctcgagggattaaaacagtttccccttatttaatagaatttgctccaagaatttcgctgaccacacgcttgagcgctaattcatcggacatgacacccttgtgcgtcgtgttggggatcaaaattgacttgaagtaaccctgatccgggtcatcaccgatcaacctttttaatgccaacacggtgtccaaggttgatctgcccatcgccgtcgccgttcaccacctgaggctttgccctgaagttgccgtcccaaaacaccagcttatctaccgttggcacaccgaccccgttgatggacgtcaccggcacgaccggggcccggaaatccagggtcaccggcagcgccctc

SEQ ID NO: 57407 - DNA, 7562 bp, Oryza sativa
cttgcatgtttgtggagtgttatatcacatattaatacatcttcttaaatttttttaatttttttcataatcatttgaatgacatgcaaacaacgaggggatatcccctcgagggatatcaaaattctcttccttaactaagccacttcttgaatctttgatagcagacatgtattatccaaatccaaaactgagtgttccttttgcttctagttgcagctttcattttattctgaaataataaataagtaatcttgcatgtcatgatgtcaatgaacttcatcttgaattaatttctagagtcaaaactcgaaacgaaatctacatgatctgaaactatctgttaggaattttgcgtgtctatcagccgtgtttatcatcaataagaacaagtataatagcaggctacaagctagctatcactgcacataaaacatgatggatggagtattagcgatattgacttttttgctgcacatgattggcattgtagcgcccgttccgtcgtggcgcctagcgggaaaactatctcttaaaaaccctatttgcgaaatttgtttcttttcttgtcgtctagtgtccgtgccatctcagatctcaaatccccgatctatcgtcgaattcaatcccgaatccaaatccttccaaatcaatccctccgcaaaagtctatttcgcctcccccgggtttgatgggccgaatctctctcggcccatctccctccctctctctctttctctctctctccgctctggccgcgcgccgcgcgcgcgtgcgcgtgagccgcgccgagcgtccccccctccctcgctctctctctccccgcctccatccctggcgagctcctcgcccgcggaatcggcccccgcgcgccgttgttcgcgcgcgcgcgcccgcgtggtcgccgcccgtgccgcgcctgcgccgtctgcgccgcccggccccgctgccctgccacgcagccgctcggccccgcaagccagcacgcgtgcccgagccgtgccgctcaaatcgccacgccgcccgttgcttcccgcgcgcgcgtgccgtggtggccgaccgcctggtcgccgccgccgtcagcgcctgccgcgcctgcccgcgcctgccgcccgtgtcgtcgctccgctccaaatcgccccgccgtcatcgccgtcgtcatcgactcggccccgcctctccccgcgcgtgcttccaaggaaagaaggcagggctcctcctcatcgccttctctccctcctccttttcccaaagaagcaaggaggcaagccccctttccctcttcctttcttctttttcctcccatcgccggcgtcacctcctgtcgtcgttttggccgctagccgggcgccagcccaccggcttgaccgtccaaagtcggttcccctctcccaaaccgacattgtcgcccctttaaacccaagctcctccctcctccaatcttcctcgttttcgtctctcgccgccacgccactgtcgcccctgttcgccgtcgccgatcgtcgttgcgcgtgtcggaggagccggcacgagcgaggacgtggaaggggactccgggcgcgccctccccttcctcttcctcggcccgaggccgaaacgatcacgtttcgcgccgtcggctctcgtcactgcgcccgcccgcacggtagtgcatccctccattctccctcctcgttccatctcctccctttagactcgggtagtagcacgagtagcctccccgtagctagctggcgccgccccgacctttgccgtcgctcgccgtgtgctcgccgctgtcgccgcccgaactcggaaacgcctctcgtcgccagcctccctcgatgcgtttcctcctaatccggcgcaagggacggattcccgtagccgcgtagatgctctcgccgccgggaatcggcccctcgtgacctcgtcaccgttttccccttttctctccgccggtggccgccgccacaatccgccgccgtcgagctccctccggcgaatccgagccgttggctcgtctcccctcatctcgtgcaaccacccggtgtgctcgctttcgcctgtatcgccgtgattcgctccgccgctcgccgccgccgcccgccgtccattcgcggccggcgtcttcgtcttcctccagccggcccgcgaggcagccacgtaggtgccacgtcggtgccacctcggcacaaccgagtcggctgacccggtcagccactccctccgttccaccctccccgtgcgcgcggtccatcgcgagccgtgaggctgcgcgtgggcccgccgcacccgcatcccccgcgagccgcgcgcgtgcgccgcccaaaccctagcgccgcatcgcgtgctccctccgcacggtgaaccgtgccaccgacaagcgggtcccacccgggaccacgcaaggtggacccggcccaccggctccctctctcctctccgcccgcgcgcgcgctttgggccgccttcttgggccggccggaccatttagctcggccgagccgccccttcctctcgggccgcgccctagccgcccgaggaaagtctgatttccctccctccttcttttcttttctttttctttttcaaaaaggatttaaataaatcatttttcctttagaccaaaaatctaataatcttagaaattcaatatcttccaaccgtaaatccgtttgactccgttcaacttccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctcaagatctcgagcgaggcaagccacccttgaacatcttgagcctatatttgaacttaattatgttgcttgaaaaaatattatgcattgataggatcacacttaatctgcttgtcccgtctgcaaggcagattggcggacctacctatttgttgcatttgatccttcctctgttaattgttataccatgtttccttgtaaccacctagtcgcgcctcgaaaatcgtgcactctgcacgagtatcgacggtcgccttcaaacttaaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacataggacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccataagctaggtgatccgggttagtaatgtcgtgtgggtaaagtgtaccacctctgcagaggttaacaaactgttcgaacagccgtgcccacggtcatgggcggatgtgaggtgattcctagcgtagttttgtttgactactgccttgtgaaatttgctgttgtggaaaggggatcgatgtttggaaaatctgcagctgatgggatcagctaggcccgggtggccgtttgaaggttgttggcccgggtggccgtttaaaagttgttggcccgggtggccgtttgaaagttgttggccgggtgccaaccttgaatcaattcaaaagactgatacattgcacatactccgaccggacgagacgcactgtctcatccgtgtcgtttgagaagcactcacttagttgatttcagaaaagagttcaaataaaatcaattgcaaaaacaacagcctttccttgaagcctacattaaacacttatttcccgtggcttgctgagtactcccgtactcacccttgctctatataaataatcccccccagttgctgaagaagatgaagcggatcccgctgacgaggagttcttccaggagcaagccggctacgatgagttttagggttttggcctaattcccaagtcgcgcctgtgatgtttggtccaagtcttggcttccgcttcccttttgtaatgcagttgtgagctcgggatctgtccgcagcccaacatgactgtactcctactctataataaagagacctctgttactgtgatattctgtcttcctgtgataccagcactgtttcctgggactggtatcgattaacaggttaatttggagcgtcacgggctagttccggtcgggactagtccggggcgtgacaggcatattaccgaatatatgcatatggtactattggctggtttggtggaattccaattctgagccttttttatccacagctcatgttctctgtttttattaagacggatgttctctgtgattagaatatttggagaattatgatcaaacatggactatactatatcctgactagatgtgaattatatttgtataaatcaggatttgttatgtgaactagcacattgccaatgccaggtcaaacagtaagtttttttttcttcactaaatatgagcgcatggatctgaaatatattaattcatcggtcaacatggagcaaaaaaaaacaagcatagcacaactgatctaaaaacaatgtctgacgaattccagtccattaattgcagaaacaaatgtgcaaattctttagttgctataacaaagggaattccagtccattagtgccgcaagccagagcagcttgagtggccaaaatcgagctggtgaagcagtcttctctgttcatgatctgtgtcctctgttctggaactggtaagccgaaaatgtttgcgtccatcagtacgtttatgtgccatttgtttggcacaagatggtaccaatatatagtcacagcaggctgctgtcattagcagataaagagatcctgaatatttttattttacaaacacgcaaaatgattgcacgtcggtatattagaaaaaaaagtatttgtttacctaacacaatcagcccagtccaacttataccaagggaagggagaaaagacaaaacaagaaaaaaaaacaaggaaaaaagggaagaggcctgaaattttctttttaagaaaaaaatttggaacttttattcatgtagcattgtcaaaaaaaagggccatacagagtacatgcattaacgttcaaccaacattatttaaccatggattattcgtctctggaaatccttatttgcaccggcatggcatgctcagctgctagttcggaggaaacgtaatcgggtagaccggcgtcttgtcagggtagaagagcccaaaatgcctctcggtctcatccccgggcttctggttctcgttgaacatggcgaacacgtacgtctccagctgcccgggccgcttcggcgtcccgttcttgacgttgtcgatcacgccctggttgtgattcctcgcgttctccacgttcgccgcgaaccctcccgccgacggccacccgctctccgacacgacgacgcggacgccgggcgcgccggccttctccagcgcggcgtacacggcgtccaccatggcgttgaagaggttggtgtaggtgaggccgctgtcgttgtccctcaccgtggtgcccggctggaacgtggcgtagttgagcgggatgtcccgcgggttgtccctgtaggcgaagtaggggtacacgttggcgagcagcggcgacatggtgttggcgaggaactgcgcgatgggcaccatgaactgctgcaggtccgggcggaacacgccgtgcgacggaggggacgaggcggtgatcacgtccatcctcaccgccgtcgacaccttgatgctgttcgagaggccggcggacacgagcgcgtcgtacacgttctgcatggccgggaggatggtccccatgtcgccggggccgagctcgttgccgacggcgatgtaccggatgatgacgttcggccagtaggcctggacgttgtcacgcacccagtcggcggcggcggaggggttgttggcgaggttggccaccgcgctgctgccgccgacgtcgatgatgacggcgacgccgctgccgcgaagcgcgtcgagggcctgctggtccgggctgtagatgcgcatagcaccgataccattggacttgtacagctgcacgacctcgctctgcgacgggaggttgtcgccgttcatgccgtagcaaacaccgtggacacctgcaaaaacataggagtgcatgtttatgccaaatcagacgatttaattgatgtgtaggaaaataaaatatatatatagagagagagatatcgaatctggatttttcacattttgatacttttgaaaaacttatttcacaaatagacccctaaaaaaacttatcctagaaatggtcttttttggggcgccagagtggctggcgccgtcatccaacgggatggcgccagcctctctggcgctgtcctcctgccaccgtggcgtacgcgaaccgacgtggctccattcctgtttctctgtatggagttgcaacggtgttatttttattttattttttcggatgttttttcacactcaggatcacgatacaaccaaccacaaaaaaaatttaaactcgaactaccacttagctaagtctgaaaatatctagcataccacttagtctactttacaccttcactaaaattagaccataactcatttagtaaaaccctttgatcagcatgttaaacataatgcactctaccactatatgaaattacttaatctaattcaaaatataaccacatgaaatgacatatataagttaaacagtatatagagatgcaatttttttatttttattttatttttttgatattttttcacacttatgagaacataggaaccaaccgtataaaaaataaactcaaacggacaaaatatgtgacatgtagaattttccaaaattctaccgaaacggacaaaatatgccatctattaaaataggcgtaactttctcatacggactcggaatcaggcaaataatatatgcacggacatctacagaaaaagttacatccgattctcccccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcttgtgagttcctaagtgtgaaaaaaatatcaaaaaaataaaataaaaataaaaaagttgcacatctctctcctctgcactagttcggagagaggagaggagaggaaaaattctacatgtcacatattacgtccatttgagttcaatttttttatggttggttcttgtgtgtccctaagcgtgaaaaaaatatcaaacaaataaaacaaaaataaaaaatttccggggggggggggggggg

SEQ ID NO: 57408 - DNA, 2668 bp, Oryza sativa
ccccctagccacctcagcatcgccccgccacgtcggcggtgggacggcgccaaagaggctggcgccatcctgttgaacgatggcgccagccactctggcgccccaaaaaggactatttttaggataagtttttctagagatctacttgcgaaataagtttttcaaaaggaccaaaatgtgaaaaatccaggagatcgaattgcatatgagaggcagagagggttagttaattaattgattagcaatagatcagctcagcatgaaagagaaaaggaagggaaaaataagttctgaatatacctcccatttgatcaaatagctatgataactcgagctctgatctgcttgatcagtatctggagatggaattatgaatggcgcctcgatgctcgcgctcgctagctcgtgatcgtagctaggaaagaatgtccccccttatatactgcaagatggcgtgacttcttcctcttgtcaatgagacacttcaatcggttaaccagtaatcacgagatccggccgacggcggagatcacgaggtttgcctcgcgttgggattcgacttcggttatacttttgctttggaattgtgttcctttgctttattcctcctctagcatctgcccatacattccgtgtgatgaacactgcgaatcaaatgggacgtttaagatgttgttgttgtactgatagcgtgattgaattcatggcctctttctgccaagccgcatatggagttttttttggtgtttcagtttcaagtcgcggttggtgaatccgaaatcacgtgattaaaacagtaattatcgagcacggaaggaatggaatttttttaaaaaaaatgcagaacggagtaatttcttacagatcatcctgtttctgcttgatgcgatagctaatcgctgtcggtgctctattactgctccagctcaagctcgaacagcattccagcttgtcggccaaattggacatatctttcggcccaattggtttaatccccatctcttttagccgggccgcaagttatcccctcctcgtcacgctatctataggcccattattatctatctgtgttatgttttagaacaagctggaaatgctggttgagctcgagcagtagtagatagggatgaaaacagtccggaaagtttccgaattcccgacgtgtttttggaaacgggaagtgtcggtcagaattttttcgaaaaatttggaaacggaaacgaattccgaattccgaattttttttctcggaaacggaaacaaacatgataaggctgctattcgttggaaaccgtaatccgacggaaattttcaagaaatgaattcaaaaacagaaatgaattcgttggaaaccgtaatccggctgtgggagaacttcacggcgctgcaggaggaccccgcgctctcgccttgctacgccgaccagctgcgcctcgtgtacgaccccgtcgccggcgactaccgcaacgtgcccggcgtcgacacccgcgtcgtctccttcggctccacccgcggcttccgctccgacgatcctgctcgaaagtaagcgatatcatgtcgaatttatcgtactccactccacaaggagatgaacatgcaatgcatatagggacgtgtgcatggagaggctcgtggaggcgctggaagaggagggatacgcggagggagagaacctgttcggcgcgccgtacgacttcaggtacgcgccggccgctcccggcttgccgtccggggtgttctccgacttcacgtcgaggttaaggcgcctcgtggagcgcgcgagcgagaggaacggaggcaagccggtcatcctcgtgacgcacagcctcggcggcctcttcgccatggtgttcctcgaccggaccccgctgccgtggagaaggaggtacatcaagcacttcgtcatgctctgcctcggcgtcggcggctcgccgctgaacatgtggcccctcgccgcctcctccatcccgtcgtcgtcgtcgttggtgggcagcgtgctgacgtacgggaacaggagcttcgcgagcatgttctccctcctgccgtcgccggcggtgtacggcgacacgccactggtgatcacgcgagccaagaactactccgccgacgacatgccggagtttctctcggcggctggtttctccgacgacgaggtggcgctctaccgggcgagggcgctgccggtgaccctggatttccgggcgccgctcgtgccgctgacgtccatcaacggcgtcggtgtgccgacggtagataagctggtgttctgggacggcaacttcagcgcgaagcctcaggtggtgaacggcgacggcgatgggcagatcaacttggacaccgtgttggcattagaaaggttgatcggtgatgacccggatcagggttacttcaagtcaattttgatccccaacacgacgcacaagggtgtcatctccgatgaattagcgctcaagcgtgtggtcagcgaaattcttggagcaaattcaattaactaaggggaaactgttttaatccctcgaggggatatcccctcgttctttgcatgtcacttaaatggttataaaaaaatttgaaaaaaattaggaatgtgtattaacatgtgatataacactccacaaacatgcaagttcaaattcaacttctacatctcgtaacgaaaaaacaaatt

SEQ ID NO: 57409 - DNA, 756 bp, Oryza sativa
catgcattcagaacgcccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttattcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctca

SEQ ID NO: 57410 - DNA, 19958 bp, Oryza sativa
  unsure (1)..(19958): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggctggcgcggcgcttgcggtcaaggagcggcaggtggtgacagcggctgtggtcggggaaaaaggcgaaaaggggagggaaaagagcttggctcccttgccactttgggaggaaggaggaaggagggagagagaacgagggagaggagcacgagctctgtctcttggttttggaaggatgcggcatggaggcatcggggccgagcgatgatagcggcgatgacggctaaaggcgagcggggccgggcggctgcgcggcgcaggcgcggggacaggcggcgtctgggctgacgtggcggcaaccgggcggtcagccacgcgcgagcgcgcaggaacgagcgaaggcggtgcagatttgagcggcgttggcgggaatcgacgccggggagagagagagcgaacggagagggagagaaaaggcagagaggcgggagctctcttcctctctcagctctgctgagtgaccacgtgcagcgcacgtgagagagaagggcagaggggagagatgggccgagggaggggattcggcccacgaacctgagggatgaaaattagacttttgcttagaatttgagttggagagaatttggattgggaatggaatttggatatctttcgagttggtacaagtatttggcgagaattcaaagagaggaattgaatttcggaatttgatctcggtgacttgaatcaggattggaaatttgaggtggaggatttcgattttgatgagagggggcaacgggatttgaattgagatcctggcacgacttagactctcacacaaagaacgaaaattttcgcaattaggattttgccgaattagtttttaacgcctcacgaaaagcggagcgttacaatagctcatagccgaaatatttgaccgaataaattaatatacggtcttgatttccgttggtatgctactgtgtgtatgtagcaaaaatttacaaaaactgaaacttcctagtgatagccgatgcaaattgaatcggctttgattttttctttttcggtaacagcgtgcagcaagaacagaactgtttctgtctcgtgtgtattgttagcgatgctactccacgtgacaaacgtataaagaggtgtcacactctcgcagcggcggtggacggtttacggtgcaaaccgacaaagatggactaaaactagggtaaaataaaaaacatagtaaaagaacgattgaagtaagcggcgacgaggtggagaggcggcggctcctctcccgacgatgatgatgactgtcgcgaccaagatgactaccgcgaccacgacgacgactgccgcgaggacgactactgccgcgacaccgacgccgacgcctatgggggcggcggtggatgaaggaggagagccattgtcggctggagggggaggctggcagcggtgcgtttttttatttgctgaaatgtttttttgcaggcgggtgaatctatcgcctacgaagatatcgtccgagggcccgcatgcgaaaatcatctatttttgcaggtctttgcttgcaaaaagaatgcccgtccgcctggaaagatggatttggcccgccagcaaataccttttttttaaaggagtgagagcaaactatgatgacaaagctcagctagataaaaaaaatgtgagcctagagctaaattagtcaatttttatttgaagctcagttgtgtgttttcgcttttactttttaacaaatacgcaataggaagcaaggataaaaatgtattttcaaaacagggcaaatatttgtcatattttgcaaaatctcagtcaaaacaagttgcgaatacacgagtgctgttcaaaattgaggcaaaaatgcaattgtaaaaaagggtaaaaatgtctttttcatgctcaacttaacatggttatgttgtgaaacaaatctctaggagataagtctcttatgggccaatctgaaccagagtagagataagatatatctcttcctaagacccatatatatacaggggcagggtgagacatatgagattggcttgtactcagatgagatctataatgaagagagagctacaacctatatatgtgttcattgtctacttctgcaatgttcttgagggcaaagggatgggcctactgctatgggagggacagggaacggatctggtgatccgctaataggcatgttggtttacaacaggttaaactcaccatatattcaaactaggggcagaactctgcttcatttcaaaaaaaagcagggaaataccctaaaaagttagggcaaaattatcattatcggtaaatataggatagctccgaattctgaaggactacttacatatatagttttagagctaccccgagggctcaagccacatgcctggctttgccactgtatgataatgcaaagctcgttcttttgtgtgtaagggtgtatacaatgattcttgagtgtgttttggtctaggaaaaaaatacattgtaccaattggattatctcttgagtgtaaatacaatgtaatatatttgtaccaattgaagtttcttgtcttagataattgaaaaaaatgtttttgcttaaaagaaatcacaaccacttatattccataattcacttaatagagaacatataaaaactaggatataactagacaataactaataataccaatacaaaatagagaaacatgtattcaagtctgtttgtaaatctccatccgaggctgggaaatatctgcatgaccgttttctctagatttcgacccacagtatgtattagttccttgtcatcatcacaattttgtagttatgtccaaaattgaaaccaatacattgtcctaaatagtgtctggatataagatttcatttagaatttatcaaaaatcatatcatttctacgaggcaatgttttaccactatgtggccacagacttgcagaagactgcagcagtcttgcatgctattgttgttgtcaaccaaccaataaaaaaccttgaaggttttctttattcatgaagcataccatcatcaaaaccataacgccgtatgtcacaaaaaacacgcgcgcgcacacacactaatgcgacatacggagaacgttaacatacatccagcattattagagcattgctcacctgcagctccatgtttatttatattggaagctgctagttcggaaagcaggtaagcggatacaccggcgacttgttaggatagaagaggccaaagttcctctcggtgagatccccgttcttctggttctcgttgaacatggcgaatatgtcactggtagagaaatcgtttgtagtcccggttcgtaactcccctttagtcccggttgtccaaccgggactatgaatccgggactaaagatagcgatctttagtcccgagtaaaataaccggaactaaagatcgatctttagtcccggttggtaacacgaaccgggactaaagatcggtcagccacgtggccggctgatccatctttaactgggactaaagatctatgtaccatttttttttatttacatggccctgtttgctgcatggttgattatatatatatatatatatatatatatatatgcgtatgtatatatgtataaatacatatattacacacatatttataatttaaagcacttaacatttaacattttatgtacatatatattaccaaaatatatattaacactaaagtaaatgtacgtacatatatatacatatatatatatatacatatatatatatacatatatatatatatatatacatatatatatatatatatacatatatatatatatatatatatgcatatatagtacaattcatttgctcgctagctatagctacgacttcgacgccggtgttacgtcagaagaggaaggaccgacgttatgaattgtcgatccgtcgtagtagaattcaccatcgggattaaggacttcttcgttgatgaaccccatcagttgttcttgaacagccgtgataaattccttatgtgggagtttttccctcatgtgaatacgctatcattcgaaaaataatgacatatcaatatatgaaattaataaacaacttaacaaatcgatacgcaatgaaattttaaatggtttatgtatacgtacatcgagctctcgtgtggtgtatatttggtttgataggcagtgggcatactcgcatacgtagtagccgcataagttagttcccttatcctgctttgcacactacatgagaaacgatgagagatttaatatactctttatattaactgtaactagagattcaattcaatataattttggatcatgcatgtactcactggaaaatgaaacctcgatccaagtttttctttccaagtcccgcggaccaattgacggaaccgatcccaagccctacatgtgcagttgcaagctatgattaattaattattacccgagatcaacataatagcaacagagtcccgtgactttggaatagatggcattatattacctgtctatcagttggaagacctttgtcaaaaaccttctcctcgtacacagtgactctgcatgcgtccaagtcgaaaaagaacaggacccagtggaatctggaatatgcgtgagatgagataaatatcagaatgtacatgttatatgtatgggaatgaaatttgttcgaacgacaataaaaactcactctgtgttgtacgacaatagtatgaacgtcttgaaatgctgctgcgttaggagatggacgagattgtcctctgtgtctttctcgtacttgtcgagcatttcggtgttgattttccgagggtcgatgaacccagtatcgtaaaccccccgccgtcgggccctttgaatctccattctacaacaatgaaaggaaattattattgcttacatatatgccaggagctaattattgaacgaaacaaatcgaactcaaagatacttacaaaatccatgcgctcagaagagagacgtcgagggcgtcccgatggtacagatcgaagacatccttgaaatggatccatagaacatcttctccttgcaagaagtcggggtttctaatcctcgctccgaacatctctctaccattggcgctcatttccatgtaccgttcatggaatttatacatttgtgtcggtagggactgcagccgctcaggcctgacaagcggtttaccgagttcaaacttgtatgccacttccgccttcgggattggtgcgcctccaaccaacagagccacagttagaccggtgtccgaaatgaaatccgttatgccaaagtcttcgccggtcaccaacggctcgaccacttggtgtggttgttttccaagctgaggaactggattggacttcttgtaataggctttcctaagtgttcggtcatagtccgatagctttaaggcctccttgtttgcggtggatattcccttgaagaaattcttcacgctcgggttaataggtatcttcttttcaggactccgaggcttgagttgcctcttcacttctcctgccacataagcgtcaagctcctcttgactgcaaccgtacggcggctccttgtttttggtggtgtcaactttggccttcttcgttgcccttgtgctggcaggaggtggagcttggcgagaccttgtcttgggaggtgcaggcggacacggtggaggtggaggcggaggaggcggaggagccggaggagatggtgcaggaggaggtggtagaggagccggaggagatggtgcaggaggaggtggcagaggagccggaggagatggtgcaggaggagacggcggagccggaggagatggtgcacgagacgccgcttgttgcccagggaggatgatgtaccgcttgcgccatagtataatggcgtggcttgtgtctcgtagatgcgtctcaccgtctcctcctgggtagtccaactcgaggtcctcgtacacggcttccaccagctcaacttcgaccctcgagtatcctgctggaatcggccagtagtggtaagtccctgaaatgtccgttgggatggccattcccgacgccaccttcacgtgatgagaggttatctattagtaatcaacctaagcagcaacttgcggaacgtacaagtcaaaaatcatatattacatcgagcataccttgattgataagttcttgaagggaatatgcagcttacatggtgtccgttgcgtgatctcatcaacggggcaggtggtttcgtcctgggtttgcatggcgtccatgctatgtgattctacctgccccgttgaggcgcagctgctacgattgcctgatgggctgaccattggaggaggtatgtatggctggggatcgtgtgaccgatgtgctgccatgcgttcatccaccttccggaccacctcctcttgcatgctgagctcgtagctcgataccctgtactcaagatctgcaatcttcgcctcggtatctctcttgctcctcatccgactcttgtacgtgtggatgtcctccttgaatccaatcttccagggaatcacgcctttccctcgtgttcgtcctggatgctcgagagtctgtagggcgagtgacagctcgtccttctctctgtcgggttggaacgtgccatgagaagaggcttccactgcgtccgttagtcgactggcagcctcgcgtatctgatcgctgaagaccagggagccatcaactgggttaagcgttccaccgtgagcatagtaccagaacttcgatcgatctggccatttagcggtggctggttcgatacccctctcaatcattcttgcctccatctcctcccacttcggtattgcgacgctatagccacctgaccccaagtggtgatggtacttcttcttggcaacgttttacttgtttttgaccatcattgcttgcccttgttgccctgtcttgtaagcaacgaactcgtcccaatgatcccttagctttgggaatacgtcgaagttcggtgttagtcccttcaggatgtatttcttgtacagatctcccttgaaggtctagaactgttctgccattttcttaagagtccactatttcactatgttctccgtacccgcagggagcgtgaacgtcttgagcattgtggtccacaacatctctttctctgattccgggacaaagctgtcattatccccacgtgcccttgttttgctgacaggcacgttatccctcacaacccaaccgctgtggcgtacaaaaattcttggttgcttctgccggggcactaggtcggccgtctgcgtccacctcagttatgatgtgccgaccctctatcttcttcgcggcacctcgttgtctgcgtgccctcttctgtccagcggagggatgacttccactagcctcctcctcgttcccctccgcattcctctccacgttcccctcctcgttcccctctgcatccctctccacgttcccctcctcgttcaagtactggtttggatcctcgttcccctcttcttcgttccagtactggctgcttccctctgcgattgtatcgtacagtatctgttcctcatcgcgatcagccatctgttcatagaagaaatatttgctaagcgtaatattaaaactctactaattaatcttgtattaaaactcaaataatcatatatgctaagtctaagtgtcgtgtattagaaccctagataatcatatatgctaagtttaattaagtttcgaatattatatctctaataatcttatattaaatctctaacaatctctaacaatcaaatatgctaagtctaattaagttccgtatattaaacctctaataatcttatattaaatctctaacaatctctgacactcacatatgctaagtctaattaagttccgtatattaaacctctaataatcttatattaaatctctaataatcttatattaaaattgtaataatcatatatgctaagtctaacaatcttatattaaatcgctactaatcttatattaaaattgtaataatcatatatgctaagtctaacaatcttatattcaaactctaataatcttagattaaaattgtaataatcatatatgctaagtctaacaatcttatattcaaactctaataatcttatatcaaaattgtaataatcatatatgctaagtctaacaatcttatattaaatctctaataatataataatcttatattaaaactctaataatctaataatcttatattaaaactctaataatcttatattaaatctctaacaatcacttctttacatcacttgcctacgcgaattccttcgatggctagctaccacttcggcttgagggacgacaacgacgtcttctctgcaatattaccaggaaaatatattatctaaacagggccaagttacatatattgtatttcacgttttaacctatatatataatcatatatgtatgctaagtttaataatcgtttaattatcttgttcgtacacgtttcgctcgcgttcgttctcacacttttagtacaagtgcattcactttcataagcgtttcgttcacgttcgttcgcgttccttaatgtttcgttcgcgttcgttaacgtttctttaacgtttcattcgcgttcattcgcgttcggtcgcgttcgttcgcgttcggttacgttcgttaagcgttcgttcgcgttcgttcacgttcgttaagcgttcgttcgcggcggcggcgtctcgcggcggtgggggcgcggtccggcgccgtgggccggcccggcggcgtgggggcgcggcggcggcgtcgtctcgcggcggtgggggcgcggtccggcggcgtgggggcccgatggcgtcggcgtcatcggcggtggcggccgcgccgaagtcgttcgtcggcagtggcggttgaccgcggcgtggcgtagtggcgtcggcaacgagctatagctaggcacgcggcagcggtttggagagagagagagagagagagagagagagagggctatatcgagaaagagagagagagggcgggggctctcacccaagagacgcggcggcggcgtctgcggcggaggcggcgaggaccgccaggcgacggtgagagacgacggcggcgtcggcgcggggttgccctagacagtggtggcgaaggagaagccgatgctcgatctcgatggaaaaacgtcgaagtgttggtggagaagacaagggcgcaccgggaatatatatacccccggatctttactcccggttgaaccgggagtaaagatatctttagatttttaatcccggttgttgttacgaaccgggagtaaagatatctttactcccggttgttctcaccaaccgggagtaaagatattttcccgctatttccaaattctgttttaaacccggttagggttaagaaccgggtctaaagataatagcactgaatattgaatttcgttgcatatgtgtttctaaaatagtaaataatgcattaaaaattctaattaacatatgtaaatcccacatgcatgatttaaaacctttaaaaattctaataatcatatatcattagcatatgcatgatattaaattgttaaaaattctaattaacatatgtaaatcccacatgcatgatttaaaacttttaaaaattctaataatcatatatcattagcatatgcatgatattaaattgttaaaaattctaattaacatatgtaaatcccacatgcatgatttaaaattactaaaaattctaataatcatatataattagcatatgcatgatattaaattgttaaaaattctaattaacatatgtaaatcccacatgcatgatttaaaacttttaaaaattctaataatcatatataattagcacatgcatgatattaaattgttaaaaattgtaattaacatatgtaaatcccacatgcatgatttaaaacttttaaaaattctaataatcatatataattagcatatgcatgatattaaattgttaaaaattgtaattaacatatgtaaataccacatgcatgatttaaaacttttaaaaattctaataattatatatacctagcatatgcatgatttaaatttgttaatcatcatatataactagcatattcaatacatccaaaatagtttacaacaattacggcaatacatcggcggtgacggttgtccgcacgtactttctcctcactattgttccttccttgtgatcgctacgtgagtaaggggtgtcttcatttgataggaggatgctagggtcaatcgtcactgtgaaaggggattgcccatcaaactgatcgtaatcctctactccgacgatttttcttttgcctgggagaaccaagtggcgcttcggctcgtcaggccctttgcccttctttcctttgctagacatgtccttcacgtaaaaaacttgcgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatctcctcgatggcaccgtaatacatgccagttgtaccatcgtgtcccatggcatcgatatgaacagcactgttctggttcgtgctcttcatgtcttgggctcttgtgtagaatgtatacccattgatctcatatccctggaatgccgcgatcgagccagatggacccctcgccaggaaggccagttgctggttaattgtctcgttacccatgagatgttgtcgcagccatgcgaggaaagtatcaatgtgatgccgtgtaatctatgcatcggacttaccgatgtttctggcgcgaactagagtcaagtgctcctcgatgtaaggagccaccaatgaagattgttgtaaaaccgtaaaatgggctttacggaataaattgttgtctaccgtcattattgctttccttccgagagtcccctttccccttcatggcgtgattcaggtaccccgattgggcgaaggtcttcaataaattctacgcagaattcaatgacctcctttgttccataccccttggcgatgcttgcctctggacgagcacggttatgaacatacttcttcagaacgcccatgtacctctcgaaaggaaacatgttgtgtaggaacacaggcgcgagaataccgatctctttcactaggtgacaaagcagatgcgtcattatattgaaaaatgaaggtggaaatatcaactcaaagctgacaagacattgcaccacatcattctgaagggcctctaacctatccggatcgatgaccttctacgaaattgcgttcatgaaagaacatagctttgttatcgttgcccggacattgtctgggaggataccccttattataactggtagcagctgtgtcatcaacacgtgacagtcatgagactttaggtttgtgaacttcttctccttcgtgcttattattcgctttatattcgtggagtatctagatggtaccttgatgctctccaagcattgaaacatactttccttctctgccttgctaagagtgtagctggctggactcaagtaatggctgcctttctcctttggttccgagtgaaggtcgccgcgttgttccatatgtttcagatcattacgtgcttccagtgtatctttcgactttccatatacacctaggaagccaagaaggtttacgcaaaggttcttagtgaggtgcatcacgtcgattgcgtgacggacgtccaagaattcccaataggaactcccaaaatatggagttttttttccacatcgccgcgtgaccatcttcgcactctataggctggctgccaggcccctttccaaacactactttaagatctttcaccatagcaaacactgttttcccgctgtgatgtttaggcttcgtacggtggtccgccttatgttcaaagtgcttgcctttcttccgtactaggtggtttgcagcaagaaatcgacgatgacccatgtacacaaccttcctacagtgcttaagatacgtactttctgtttcatccatacagtgaatgcaagccttgtaccccttgtttgactgcccggataggttgctaagtgcaggccaatcgttgatggttatgaacagcagcgttcgtaggttaaactcctcctgtttatcctcatcccacacggggacacctttcttcttccacaacagtttaagatcttcgaccagtggtcttaggaacacatcgatgtcgttaccaggttgcttagggccttgaataataatcgacatcattatgtacttcctcttcatgcatagccaaggggggaggttgtagatacacatcgtaacgggccaagtgctatggccgctgctcatctctacaaaaggattcatgccatccgtacttaaaccaaaccgtatgtttcgtgcgtcctttccaaagtctttaaattttctgtcgatgtttcgccactgcgaaccatctgcggggtgtctcagcatcccgtcctgttgatgttcttcagcgtgccaacgcatcattctagcattccccttgttcctaaataaacgccttagccgtggtattatagggaaatactacatcaccttagtaggaattctcttcttcgttagctgcccgtcaacctcacctggatcatctcgtctaatcttgtatcgtagtgttttacaaacagggcatgcttctaggttctcgtactcctcatcgcgatataggatacaatcattcggacatgcgtgaatcttctgaacttccagtcctagagggcagactatcttcttagcctcgtacgttgtctcgggcaatttgtttctctccagaagaatgttcttgacaagtttcaataaatcgccaaatgccttgtcactaacaccattttttgccttctattgcaagaactccagagtggtatccaactttttgtgcccctgctcgcaacctgggtacaacgacgttctatggtcctctaatatattgtccaatttatgggcccccttttcactttcgcagtcctccttggcatcctgcaacatctgaccaagatcatccgcaacgtcgttataatcagcatctctgtcctcctcacccgtttgatttccttcaaatccagcgtactgagcaaagtctggaatattgtcatcttccacttcatcttcttccatttcaaccccttgctctccgtgggatgtccaacaattatagcttggaatgaaccccgactcaaacaagtggaaatgaatagtcctggatgcagaatactccttctgattcttacacttattgcatggacaacaaataaaacccttctgcttgttagcttcggccactctcaaaaaataatgcacgccgtcaataaactctttggaccgccggtcagcgtacatccattgccgatccatctacatgaaatgaaaaaaaaatcgtatacaaataatcattcgtacaataatgacagtcatataataatgataaaataatcacaaactctttcaacagtcatacaataatgacatatcattattcatacaaaaattataaaatattccaccaaataattcttatttattattttttaagttttaaattattttaattttcaatttagtttgttttcttttatttaagattaactttcactatattttcctactcaactattttataaaaccttatttagcaaataaacaaaatttctatatattctttcttttcccacacaaattttctctctcatcaacttacaacaaaattttggagacaaaaaagtgtgcaaaacatagctccaaatgtaatatgaccaaaaaaatattggaggatgaagttgctaatattttaggcacctccgatttgtatataatcaccaaagtaaattcactataaattttggcatgacctcccctcttttttaaagaaattttgaagcttgctcgggctggaggaggaagaagacatatataaaggggtgggactttagtcagatcccggtgatctttagtaccggttggtaacaccaaccgggactaaagttatgaccaaccgggactaaagatcccagggggcctgagatcaaatatgcccgttaccctttttaaccgggactaagatcggtttttattgcaaccgggattattgtggaattcggccgaccgataaaagatggtttctccaccagtgtgtacgtctccagtggcctcggcctcctgggcgtgccacgcctgacgtgatcgatcagtccctggttgtatgccctcgcgttgtccacgctcgccgcgaaccctcccgccgacggccacccgctctccgacaccaccacattcacgttccccgcgccagccttctccagcgcggcgtagatggcatgcatcatggcgtcgaacaggttggtgtaggtgagtccgttattttggtccctctctgtggggctcacccggaacgtggcgtagttgaggttgatgcacggtttatccttgtaggcgaagtaggggtagacgttggccagcagcggcgcgccggtgctcgccaggtactgagctatgccattcatgtaggtatacgcgaacacgccggcggagggagggtaatagttggcgatcacgtcggatttcaccgcggtggaaaccttgatgccgccgatgccggccgcggcaagggcggagttgacgttgcgcatggccgggaggatgctctccgtggtgccgcctaccacctcgttgccgacggcgatgtacttgatgttgacggccggatagtaggggctgatgttgtcacggacccacgcggccgcgttggaggagctggcggcgaggttggacaactggtcgccgacgtcgaggatgagggcgatgccggagttgcgcagggcgttgagagcctccttgtcggggtagtagatgcgcatccgtttgatgcccttggatatgtacatatgcaccacctcgctccgcgacgggaggttattacccaccatgccatagcacacaccgatcatttgcacggctgcacgtgcaccgcaacagttagctggagtactacaaacgtggaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcaattgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacatgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgtagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgttctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgctgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccaca

SEQ ID NO: 57411 - DNA, 2840 bp, Oryza sativa
agaacgtgtgagcaaggaaggtgatgaagcttcggcgtcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccggcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtgcccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttagccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtatacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcggccccccggacgctgcggaggcggcctcgcggagggcg

SEQ ID NO: 57412 - DNA, 30910 bp, Oryza sativa
  unsure (1)..(30910): unsure at all n locations
taggcgactatttccgtcaattttcaaaatggaaaattatttttgtaaaacttttaataagaaaaattataaataaaaaaaattctacaaacgtgtacatacgtgcggatacgatcatgcgaaagacaataataacgacattggggaaccaaagcctcgggctacctgggccgtgaaagcccacgatgtgagccgtctttttaccatgtaaaacttacggacgtcactacacagctacacagcgtgatagtctaaaccagctacctaatccttttcataactagtacccttttcaatcgagtgtgctttctgaaaatagatatgtctaattagaatttatctttttctcacgtagggagtatacaagcattcaacaataagagtcctaatagctaaacttcaaataaacttctctttcaaattacatatctgatttacaatccaattatactattgtattcgttgtaactaaatctttgcatcattatattctaatgaaaataaacatatatgttgtaaattacttttataatagatgtaagttatttttatcacatatatatatatatatatatatatatatatatataaattactgttatatttgattaaattactttttataaatttagtgaacagtttaatttattggttaattctataatatgtcaattaaatttaatttttagatagacatatgtagttaccccccaccaagatttacttttaatatcgtgacaagttactttatttttttagttacttctataatatatttaaattacgtttagcctttattgaatttacttttatatgttcaagaagtaatttaataaaatctaaaagtaatttgtaatttttcataaaaatatataatcatatgagatcttattataaagatttagttgttacggacataacggtgtaattgaatcgtagatcggatgagtaatttaagagaaaattttatttaaaacataggtgataggaatatattttctatacttgtttgatggactagtactatagttaagtagatttttctagtcatgtgatgcttcgtcactagttacaattaaaacgagatgctctagatttagattttacgaaaacttaagcacggtttaatatgcgatgggttgggacgggccttcgaccatactgggtccgccacttaatacgaggtggagcttgcacaaccgaataggtgggtgtggtgctatgtgcgtttttagattttcgttcgaatgaaagctcataggaacgcaaaaaagaatgtaggattctttttatttttgccaccttacacatgtattctctattcaaccatgaaaaaattgcacttaagagtaaatttgacctaacaacgtgtattgtagtctaagttgcacatgacatataactccatgtattatagccatatagtttcataaacccacaatcatcttaattttgatctatcaaattttttagttctacaatcaatttcttagctatttatcaatcatataaatgttacatctatgtaagtaatgttttttaaaatttgaaaatagatgttaaattggttaacggtgtggttttgtgaaactttagaatcataatacccgaggttacgtgtcatgtgctaaaattcctataattttgtaaaacttagactatagtaggtggggttttatgaaatttactcttgcaacttatcattttcaccactctttcgttagtgcatatctttcgtttgccatcactaataaatgtagttattaaaaacaaatttgtaatcaatgtcagttgaccgttaagtttgtccctaattaaacaaccactgttcccttgtaaaagttcaaaataaagtagcacttgaaattttaacatgtaccctaatattgtcaagaaaagtaaattatagcaacttaaaagatacttcctctggtttatattataagtcgctttgatttttcctcatcaaacttaatcaagtttgatcaactttatagaaaaatttagtaacatctaaaataccaaattagtttcattaaatctaacattgaatatattattttgataatatatatgttttgcgttgaaaatgctactgtgtttctttaataaacttagtcaaattaaaaaaagtttgactagaaaaaaatcaaaatgaattataatatgaaaaggggagtagtaatattgtggagagtatggttactaagtgtacacacggtctacacatccgattacagataggtggtgagctatatgatataataggccagtgatagagtaggaccggtcgtcatgttgccttctatcctaaggttgtgttcggcactctgtttttccaactctcccctctcgttttcggcgtgtacgtttttcaaactgctaaacagtgtgttttttgcaaaaagtttctatatgaaagttgcttaaaaaatcaaattaatcctttttgaaaaaaatagctaatgcttaattaatcacgcgctaatggaccgctccgttttccgtgcatactgttccggttgggaaccagagatgccgaacatagcctaaaggtagtgtatagagctccaattggagacccgtgtaatagattagaaaaccgaagtcatgtcttcgagagggcttaaatctatctaaaccattgtcttcagtatctatgcaattttaggtctcacgcgctaccatatttattatcaccgatatagaatatggagaaatatatttttagggaaaaaaagtaaaattgggtttcatgctagagataatccattatatgccactaagtttgtcatatgtctacgatttttcactgactttgtcacgttataaaatatgccatcgacttttgtttaacttctacgatataccatcatcgtccggttaacctccgttagtaatgtacaattttgtccaaataaccaaaatacccttgggacaaaaacttctaaattttagattaaaaaatctaaaatatcatattacttagtggcatataatgatagtggcaaaagataaatgaatactaatgaaatagtggcaaaatagataagtgtaaaatttcgatgatgggaagtacaatatggtttcgacaagtggcaaaaaggaaatttcccccaaaatgtattattttcaattctttagtttactctaaatagcgactagctacctccatctcaaaatcttgcccatataactacctgtagtacgtgcgagtgtgtgcgactgcatgcaagaaaaaatgacattcatctattgtaacacggttataggacatgagaatttattgtatatatcataacaattcttgagaggaattagttaccacaagtagatcagatcctcaagagaaaaggagagggaaatgaatctaaatataccttccatttggtcaaatatacagctaggcgaattcggtttcactgcttgatcgatcgagtatctcgggtatgcttcgatgctagcttgtgattttccctaggaaagaatgtgtggccttatatagcgtaagacgatggtgtgatatttcacgagaaaagtccatatctacgcttgtaaccactcttaatctgttggttatgtaaatttgactggtaatagccaactactaacattcaaattaagttggctatgtaacatagtcaacttaattaatttaaatgttaatagtcaacttaagttggctgttaacagtcaaattaagtccgtatctacgcttgtaaccactcttgatctgttgggctaacaagagaagtttactgttggctattaacagtcaaattaagttggctaattaaattcattatcgacgcttgtaatcactcttgattatattactacactatctagggaaatgtcatttacgaacaaatgccaagatggctagttgtgtttcgctgagtagcttgattaccaaaattttttttcccaaaaacatcacatcaaatttttggatacatgcatgaagtattaaatatagataaaatgaaaattaattacacagttagggaggaaatcgcgagacgaatcttttggacctaattagtccatgattagctataagtgctacagtaacctatatgtgctaatgacggattaattaggctcaacaaattcgtcttgcggttcccaggcgagttatgaaattagtttttcattcgtgtctgaaaacttcttccgacatccggtcaaacatccgatatgacacctaaaattttttatttgacgaaaaagggcctatatatccatgcgcgcactggcccatcttatcaaagaaaccggtggtcagacagaagctagagacaaagttagttttcattatttgatcacgagacaaacttgcattgtagttgtagacatctttctattggaactcatagactcagattatttcactaaattaatctccgccatcctgtttcgctgaacttccaggtatttaagctactcgtgttttttgctgactggaacacgtacttaggagctcatacaaatatgaaaaaccacaaactcgctaatgggcctgttcggctgccgttttattgcagttgcgcgggctgcagctgcaagccggctacagaggcctatgttttcacctcgatggaccagtgggcatcctcggtcctatacgccatatggaataagttcacctgacatccctcaactttaagtccagtttgcctagggcccccaatccgcaataccagaaatctctatccttcaactatcacaaaccgtacaaaaaaagatctcaagacagtattgacccatttttccccggttccgctgacgtggcatacggtgggacccacatgtcagtgtcctatctttttctcttttctttttcttttttcttcttcttttctctttcttctcctctcttctcctcttctcttcttccccgagccttagaggctggtgggtaggcgagcaggcaagcggcggtggcggtgggtggagcaggcaggaggcggcaggcggagttccagcggccagaggcgagcgcagagggcgtagcaggcagggggcggcgggcgcagcacggcgtgtgagcgacggctccgcggttccgagcggcggcacctctgagagagggtgtggtgtgggtgtcactgtgctacggcgggcggagtggggtggcggcggcggtggggtgcaaaggacgacggcagatggagccggccacggacggtgaggacaacgacgacgtggcggacatagtaggctgggagaggacgacgacgacgcgcttggggtttcaccgggagacctcgccttcaccatcttcgtgccctcaccggagttgttccaccgcgtccttaggctgcggcgtcccaaagacagtgttgtcgataggaaggccgatgacgccacctacgccgtcatctcccacgtgctcggcttctccatcgttcccttaccgcctgcgcgctacggatgtagcagcagcgccgccgataacgggcggtggcgcttgtcctggtctcttggagtccgtgtctgggctgaggatctccgcctggagaaggccgacggcctctcacccctctcctgtcggcgtggcctgcctcctttcccccttatcctgccggcacagccggcggcctctcccctctctcccgctggtgcggcctctcccgccagcgccctcccctcccgccggctgtcccatgtttgggaagaaaagaaagatgatggtgctgataggtgggtcccacatttttcttctatttcacttacatgtgggacccacatattatcttatttctattttgccgactaggatgccacgtcagcaaaaccaggcatctatattaccatgggacctaatttgaacagttttgtatagtttagaggtgaatatttctggtattgagaataaaggatgtcaaacaaactcggtgtaaagttgagggatggcagctgaacttattcttacgccatattgactgactcaacatgcaaggatttcttcttttactccctctagttaggagcccgtgcgttgcaacgcaaaaaaaaaaagtttttcggctcgtacaacgaaaatcgattaatataacagcacagtaagacagcacgtccatggatgtaaatatatcaagcatcttgcttttgtttaaaaataattgtactgatttgaaagcgataccaacattacaaataattattgatcgttcagcgaaaccgtatactacgtctaactatggagaagatgactcaagtatcaggcagacttgaaaaggctttatacacactaaaaggccccatagaggcttgagtagaattgcacatgagcaattgagcatggagagcgtccaaagatatagcgcacaaaaagatcgcaacaaaaaggagaaacaaacgttgagttaaaatgtaaggaccatttaagaaacaaaaggcattacacaaatactgctaaacctacgtttgggtgtactgatatgagcactcgtcatttagagtaaattcacacttgaaagccaaactctttaaaatatagatgcaggattaactcgtcatgttaattcacacttggaaaacatgtgagtattaaaaccggtgagtttttttcggtaacatgcaaataaatcacgagttgacaaaaatcactcaattgtccttgctgtagattctcacgatttgtccacaaactcagtgacctccaggcatttgagacaaacttactctaaaaatggcttaaaccataaaattttgcaaacacctaaaccacaataaatttattccatgtctgcaacaacagcattcagtgcatcaccagtccaaaggtatcagtggagttgtcgccaaacagacttgaatagctagcaaatggtgatgttgcatacaaaagggtgtttttttttttgagttgtgattcaaattcatttgcacataataaccatcgccggaggcttgggctggagcgaagcggagaatcgttattcttttagggtttcaccttcgtatactttcatgagttcagttgagaatccatttggtcgatggaaccattttaatcacaagatggcaaattctgctttctctttcccttgaaagaaagtccatgtccctgcaaagtgcagaatcagaacaccaatgattgataagtgtgttcatgctgaaattgaaaggaaaagtttagagtttagttgactacatgaataaatcttctatattttagaaggagaaacatatgggtagcaaacttaatcaattgcaatgacatcagattcgtcaaccagaagggcccaatctctagctattgtgacattctcctttcccttcttgtggccactaccggaagtggattttgatccctcgaggggatatccactcgttgtttgcatgttatttaaatggctatgaagaaaattaaaaaaaattaagaaaatgtattaacatgtgatataccactccataaacatgcaagtaaaaattcaactcctacatcttacaacaaaaaaaataaatttgactctgaatatacgttaactagctgcggtttaatttgtttttttgttacgagatgtaggctgtgtttagttcagcgcaaagtttggattttggttgaaattggagatgatgtgattgaaaagttgtgtgtgtatgacaggttgatgtgatagaaaaggactgaagtttggatccaaactttggatctaaacacagccgaagaagttgaatttgaacctgcatgattgtgtagtgttatatcatgtagcgcccgttccgtcgtggcgcctagcgggaaaattatctcctaaaaaccctaattgcgaaatctgtttctttgcttgttgtctagtgtccgtgccatctcaagatctcaatccccgatctatcgtcgagttcaattccgaatccaaatccttccaaatcaaattcctccgcaaaagtccattttgcctcccccggggtcgatgggccaattttctctcggcccatcttcccctctcccccggccctttcccctctctccccggcgccctctctctctctcgctctctcccccggcgcgctcccgctccctctctccctctctctctccgctctgcccgcgcgcgtgcgcgtgagtcgccggcgccgagccgagtcttccctctccgctccctcgctgccgctccccgcgctcgttcgcgcgcgcacccgcttggttgccgcccgtgtcgcgtcgcgtctgcgccgcccggtcccgctgccctgccgcctgcagccgcgcagccgcttggccccgcgagccagcgcgcgtgcccgagccgcgccactccatccgccgcgcctcccgttgcgagccgcgcgcgcgtgccgtggtggccgaccgcccggtcgccgccgccgtcagcctctgcacgcgcctgtcgccagtgtcgccgctccgctccaaaccgccccgccgtcatcgccgtcgtcatcgcccggccccgccactccgcgcgcaagccgccaagggatggaggcagcatccctcctccctctgccgcgtcgcccccgctcacctcctcctttttcccgaatcggcaaatgggcaagccccctttctccccctccttttccccttttttctcctcgccggcgtcatcctccctgtcgccgctttggccgtgaccgccgaacgccagctcgcgcccttgaccgcgcaagtcggttcccaaaccgacattgccgcccatttaaaccccagcctcccctttcccttcctcttccattcgcctccgtgccattaccgccgcccccgtgctctgtctcgcctccgccgtccttcgccgagcgccaggaggaccggtgcgttcgaggacgcggaaggggacttcggccgcgccctcttcttcctcttccccagcccgaggccggagagattactcccgcgccgtcggcctctcgtcacagcgccccgtcccgcacggtagtgtctccctccgttcttcctcctcgctccatctccccccccttagttttcggtggtagcacgagtagactccccgtagctagccggcgccgccccagccgttgccgtcgctcgccgtgtgctcgccgccgtcgccgctcgagctccgtagcacccgcacgtcgccagcctcgctcggcgtagctccgtccaatccgacgctagcatcgagttcccgaaaccgcgtagatactctcaccgccgggaatcgacccctcgtggtctcgtcgccgtttccctcttccctccccgccggttgtcgccgccgcgattcgccgccgtcaagctctctccggcgaatccgagccgttggctcgtctcccctcatcacgaacaaccgcccggtgtgctcgcttttgcccgtatcgccgtggttcgctccgccgctcgccgccgccgcccgccgtccattcgcggccgggtcgtcgtctacctcccgccagcccacgtggcagccacgtaggcgccacgtcggcgccagctcagccgaggtcgggacgggccgacctcggtcagtccctccccgtgcgcgcgttccaccgcgagccgtggggctgcgcgtgggcccgccgcacctgcgtcctccgcgaaccgcgtgcgtgcaccacgtccatcctccaccctagcgccgcgccgcgtgctccctccgcacggtgagccgagccgctgacaagtgggtcccacccgggaccgcgcgtggtgagcccggtccaccggactctctctccttcctccgcgcgcgcgcgtcttgggccgctctgggccgccttcttgggccggccgacccgttaagctcggccgagccgctctttctctcgggccgcgccctagccgcccgagaaaagtctataatccctccctcttttcttttctttatcttttccaaaaaggatttaattaaatccttttcctttagaccaaaaatccaataatcttagaaattcaatatcttccccgccgtaaatccgtttgactccgttcaacttccaaaattccccaaatctcgagatctacctaatggcatgcttagaggtcattaataaggctttattttcgccgtttgttgagttgtcccatttcgcgtgtagtttcggagcccgaagacccgcagtgcgaggatttcgaggatcaagctccagatctcgagcaaggcaagccacctttgaacatcttgagcctatatttgaaatttaattatattgcttgcaaaatattatgcattgataggatcgcacttaatctgttgtcccgtctgcaaggcagattggcggacctgcctaatttgttgcatttgatccttcctttgttaattgttataccatgtccccttgtaaccacccagttgcgcctcgatattcgtgcactctgtgcgagtatcgacagtcgccttcaaacttaaaatctgaaaaacaacttgggtaaaacttgggttttacaaaagacttggaaaacccgacacctgggtcggtgcttgtgaactaaatgaatttctaaaaccgcggaccggggaacgtaccgggtgtacggttttcccgctcccgcacttaaggaccgattccttggaatttcatccgaacaaaagacaagtacgaccacatgggtggaatgggacacccctggctgagtaactagcttatcaggggagccatgatgccgagagacatgtggattcgccggggtggtgtcggagaggacccccctgggcttcctggcacagtatggtctgggacctaacctgttgttggtctgggacccctctcgtcggcataaggtaagcctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagtcgtgcccacggtcatgggcggatgtgaggtgattcctagcgtagttttgtttgacaactgcttgtgaaattactgttgtgaaaaggggttcgatgtttgaaaaatcagcagctgacgggatcagctaggcccgggtggccgtttgaaaagttgttggcccgggtggccgtttgaaaagctgttggccgggtgccaaccttgttttaagatctaaagattgatacattgcacatactccgaccggacgggacgcactgtctcaaccgtgtcgtttgagaagcactcacctagatgtttttagaaaagagttcaaataaaatcaattacgaaaacaacagcctttccttgaaacctgcattaaacacttatttcccctggcttgctgagtactcccgtactcacccttgctctatataaatattccccccagttgctgatgaagatgaagcggatcctgctgatgaggagttcttccaggagcaagccggttacgatgagttttagggtttcggcctagttcccaagtcgcgcctgtgttgtttggtccaagtctcggcttccgtttcccttttgtaatgcagttgtgagctcgggatctgtccgcagcccaacatgactgtactcctactctataataaagagacctctgttgctgtgatattctatcttcctgtgataccagcactgtttcctgggactggtatcgattaacaggttaatttggagcgtcacgggctaattccagtcgggactagctcggggcgtgacatatcacatgttaatacaccttctcaatttttttcataaccatttgagtgacatgcaaataacgagaggatatcccctcgaggaattaaaatagtttcccgccactgccaccatccatgacccatctcatcagctctttttccttgcctctccaaagtcaagaccatgaccggtgatggtgcttcccatcctctgctgcaagggaaacatagtcaatatagtcaacagtcgaatggaagaatggtcctacattaaggtgaaatcatgctttttatacaaagccactatataatcaaagagctaatatttgaatcaagcaacccttgttaccaatcaaagtaggaaatattgaggatagtattaacgttgaagtgaaataaaaaggtaaaaaggagttcagggcctgtttagatctatttggaatggcaaatagcaaaagttttggtggcaaaagttttgatattgtaaaagtactagttggtgtttagatgcatcctaaacttttgctattctagcactaaagtgagagagagaaagagagagtgagtggtcccaaagcactttttggcacaatttactactatggactagcaaatgctaaatgccaaattgtcaagttttgctactagtgtttagatccaaaatggcaaaaagtgcttcagatctgatttacaattcgttggtgtgcattcaatgtagtaatattgtcaccaaaggcgctcaattagcattctcgtaattggccacataaaactttttttatctgtgataaagaaattatataaaacaaacatgtggtagcaacttgcaattaaaaatgcagaaaaaaatatgtctcgcctatcatcgaatataaaaatcatcaggaggggcatgctgcactgtagtctgattgtgattccatttttcgcataacaggagacaggttgcgtcatggagtgtttaaaatgaaccatcggtaccaggtgaccaaagaacgaactgatttatgtcgctgcctcgaaaaaattatcctcctggctcttcctgttgacgatgttgaaaagagagagtttgcacaaaagaaagttttgacaatgtaaatggcagttaggaaaatgcaccagcctccaataatagctgcagcccgtagggcatagatgtaataacacaaatatgtatataatgagagttactaactaaggtccaagaaacttcctgataaataaattagaatcaaattaatccttaacgttatatgcatgctatcttcaactgcagaaaaagtccaaattaactttctacttcacaaataattgttttttttcctgacagtaaataaacagaccatactttctttcacgtttgaaaaaactaaagatattggcacatgcacaattatcaatgttacaagaaaataaataaggaatcacacaacagggaattatcaaagttctgaattttttgtacctaaaaagcttagatctccgaggcatatcccagagttgcacctaccaaccaaccaatcaatccatattgcatttgaaatccataactgtcaagagcaaaccttttttcagttacgtgaccaaaccaagaagagaatatcaaacggtattgtcaatgtttgcaacatgcttatgactacgagatttcgttatttatatgaatgcatattgattgtggatcaaagagaacagtgtgttttcacatgcttgcctatagttatcttttgagtaaattacactttggtccaccttttattacccaagtttcaatttggaccacccttaaacctatttttttaatttggaccggataaatttaccattgttgcagtttggactaccgtaaacaatttttctcgtcatgactaacttccctttcaacaaacatatgaaccatacatataggagtttggccgtatactaaagctgatgtgtttaagatcgttaattgtactgaaaaaaatcgttcgtggtggtccaaattgcaacaatggcaaatttatccggtccaaagtgaaaatatatgtttaagggtggtccaaagtgaaacttaggtaataaaatgtggcccaaagcgtaattcactcttatctttttcatgcagtcctcactcgtgtgcacccgggaagaatttcccgatcggtcacatatcttttctgcacactttgtcctcactcgtgtgcacccgggaagaatttcccgatcggtcacccatcccaaattgctccaggccagttatttggagattggcttccggaaaagaagttccaacttgttgatatgagtattctattaatcctattaagccctaggccaggatgttacaccctcacccccttaagagagatcgacgcccccgtcgatcaaccctaggccaggaacgtcctctcttggccacgtccatgtgtccagtgccagcacatgtgccatgctgtgtaaccactcccggtctacaccagccatgcgcaccatgcctgcgcaactgcaacacacgcgcccgtgaaaccgcgagagtcggctctgataccaatttgtaacgtcccgccttcccccaggccaggcccgcttacatctgatagctttcataggtcatagactgccctcacagaccaacacatatctcacccatcccaaattgctccaggccaagcacgcttaactctggagttatttggagattggcttccggaaaagaagttgcaacttgttgatatgagtattctattaatcctattaagccctaggccaggatgtcaacccatgcaataccaccagtgtcacgccccgaactagtcccgaccggaactagcccgtcacgctccaaattaacctgttaatcgataccagtcccaggaaacagtgctggtatcacagggagacagagtatcacagcaacagaggtctctttattatagagtagaagtacagtcatgttgggctgcggacagatcctgaactcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggggattatttatatagagcaagggtgagtacgggagtactcagcaagccacgggaaataagtgtttaatgcaggcttcaaggaaaggctgttgttttcgtaattgattttgtttgaactcttttctaaaaagtctaagtgagtgcttcccaaacgacacggatgagacagtgcgtctcgtccggtcggagtatgtgcaatgtgtcagtctttaggattgcaacaaggttggcacccggccaacagcttttcaaacggccacccgggccaacaacttttcaaacggccacccgggcctagctgatcccatcagctgcagatttttcaaacatcgaaccccttttcacaacagcaatttcacaagcagtagtcaaacaaaactacgctaggaatcacctcacatacgcccatgaccgtgggcacggctgttcgagcagtttgttaacctctgcagagggggtacactttacccacacgacattactaacccggatcacccagcccgtggggatcagccacgtcgggagacctccaagctttcatgacaaggcatttcgaaagccgatacaggtttaccaaatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcaaaaataaagccctattaaagacctctaagcgtgccactagatagatctcgagatttgagaaattttagaagttgaacggagtcaaacggaattacggttgggaagatattgaatttctaagattattggatttttggtctaaaggaaaaaggatttatttaaatccttttgggaaaagaaaaagaaaagaagggagggagggaatatagacttttctaggacggctagggcgcggcccaagagaaatggagcggtctggccgagctaaatgggccggccggcccaaggcggcccaaactcgcgcgcgcgcgggagggaggagagagagggccggtggaccgggctcaccacgcgcggtcccgggtgggacccgcttgtcagcggctcggctcaccgtgcggagggagcacgcgacgcacgcgcgcgggcggggaagggacgcggtgcatgcgcgcggtccgcggtggacgcaggtgcggcgggcccacgcgcagcctcacggctcgcggtggaacgcgcgcacggggagggactgaccggggtcggctcgatccggtctaggctgagctggcgccgacgtggcgcctacgtggctgccacgcgggccggcgggaggtagacgacgacccggccgcgaatggacggcgggcgacggcggcgagcggcggagcgaaccacggtgatacgggcaaaagcgtgcacaccgggcggttgcacgtgacaaggggagacgagccaacggctcggattcgccggaggttgctcgacggcggcggattgcggcggcggcaaccggcggcgggagaagagggaaacggcgacgaggtcacgagaggtcgattcccggcggtgagagcatctacgcggcgtcgggaactcgacgctagcgtcggattggacggaactacgccgagcgaggccggcgacgagcgggtgctacggagctcgagcggtgacggcggcgaacacacggcgagcgacggcaacggtcggggcggcgccggctaactacggggaggctactcaagctactaccgaaagctagggggaggagatggagcgaggaggaagaacggagagagacatcaccgagaagaggaggggcgctgtgacgagaggccggcggcgcgggagtaatctctccggcctcgggccggggaagaggaagaagagggcgcggccggagtcctcttccgcgtccttgctcgtgccggctcctccgacacgcgcaacgacgatcggcgacggcgaaacagagggcagcaatggcgcggaggcgaaaatgagggagtttggagggggagggcttgggcttaaatggacggcaatgtcggtttgggagaggggaaccgacattggacggttaaggcgcgagctggcgctcggcgcttgcagccaaagcggcggcaagaggatgacgccggcgaggaggaaaaaggggaaaaggagggggagaaaggggcttgcccctttgccgattcgggaaaaagagggggaggggaacgggagcatcgcggcagagggaggaggggcgcggctccgtcccttggcggcttgcgcgcggaggggcgggggccgggcgatgacgacggcaatgacggcggggcggtttggagcggagcggcgacactggcgacaggcgcgtgcagaggctgacggcggcggcgaccgggcggtcggccaccacggcacgcgcgcgcgggaagcaacgggcggcgtccgcgcgggcgcgcacacgctggctcgcgaggacgagcggctgcgcggctgcaggcgcggcagagcgaggggaagggagggggcgctcggcgcggcggcttacgcgcacgcgcgcgcggcgggcgggcgaggctgagcgggggagcggggagagaggcgctcggggcggctctcgcacgcgcgagcagcgtacgggcgaggccgagcggggggagagatgggagagcgcgagagagagagagagagagcgcccggggagagagagagagagagagagagcgcccggggagagagggggccggggaagaggggaagatgggccgagcgagattcggcccatcaacctcgggggaggcaaaatagacttttgcggaggaatttgattggaaggatttggattcggaattgaactcgacgatagatcagggattgagatcttgagatggcacggacactagacaacaagcaaagaaacaaatttcgcaattagggtttttaagagataatttttccgctaggcgccacgacggaacgggcgctacagcaaatctctataacttctgaaagaaagtacatgctaagaggcaggacaagttatttgtgacatgtctgatgtccctcatactattacacagccaaagatagtaagtatgatgatgcggtattcgttctctttgcgtggtattgtggcctcagaaaataactgtgtaccaatttaattgttgtcaatcgataagaaaccttgaaaagtttatattcatgtagcttttattataaaacataaagtaacatactgagaacattaaaatacgcccaacatttaatgaagcattactcgatcgatcacctgtaaggctgtaactcatttatattggcagctgctaattcgaaaaggcaatctgatagaccggcgacttgttagggtagaagaggccaaaatgcctctcggtggcagcccctgtcttctggttctcgttgaacatggcaaatatgtacgcctccatctgtccgggcctcttgggcgtgccacgcccgacatggtcgatcagcccctggttgtacgccctcgcgttgtccatgctcgccccgatcccttccgccgacggccacccgctctccgacaccaccaccctcacgttcccggcgtcggccttctccagcgcggcgtagatgcagtccaccatggcgtcgaacaggttggtgtaggtgagcccgttgccgtcgtccctcaccgtcgtgcccggctggaacgtggcgtagttgaggctgatctcgcgcgggttgccggcgtaggcgaagtaggggtagacgttggccagcagcggcgcgccagtgctcgccaggtactgagctatgccattcatgtagggatacgcgaacacgccggcggagggagggtaagagttggcgatcacgtcggatttcaccgcggtggaaaccttgatgccgccgatgccggccgcggcaagggcggagttgacgttgcgcatggccgggaggatgctctccgtggtgccgcctaccacctcgttgccgacggcgatgtacttgatgttgacggccgggtagtaggggctgatattgtcgtggacccatgacgccgcgttggaggagctggcggcgagataggacaccgtgtcgaagccgccagcgtcgaggatgaggtcgatgccggagttgcgcagggcgtccagcgcctccctgtcgggattgtagatgcgcatccgattgatgcccagggacacgtacatctgcaccacctcgctacgtgacgggagatcgttgcccaccatgccgtagcacacgccgatggattgcacggctggacgaggataagctacaaaaattaccaacacacgaatgcacgcacccgttagctacatgtaccaacgtacgtgtatacgcggatatatatacgacgatatatcatacgaaatgtgataatggcatacgtgtaatcgggtaggccggcgtcttgtcagggttgaagaggccgaaatgcctcctggtctcatcgccagtctgctggttctcgttgaacatggcgaacacgtacgtctccagtggcccgggccgcttcggcgtcccgttcttgacgttgtcgatcacgccctggttgtggttcatcgcgttctctgccgtcgccgcgaaccctcccgccgacggccacccggtctccgacacggcgatgcggacgttgggcgtgccggccttctccagcgcggcgtacacggcgtccaccatggcgttgaagaggttggtgtaggtgaggccgctgtcgctgtccctcaccgtggtgcccggctggaacgtggcgtagttgaggctgatgtcgcgcgggttctccctgtaggagacgtaggggtacacgttgacgagcagcggcgacacggtgttggcgaggaaccgcgcgatgggagccatgaactgctgcacgtcggggcggaacacgccgtgcgacggagggaacgtgttggcgaccacgtccatcttgatcgccgtcgacaccttgatgctgctcgagaggccggcggacacgagggccttgtgcacgttctgcatggccgggaggatgaggcccatgtcgccggcggggagctcgttgccgacggtgatgtagcggatgatgacgctcggccagtaggcctcgacgttgtcccggacccagtcgccggcggcggaggggttgctggcgaggttggccaccgcgccgctgtcgccgacgtcgacgatgatggcgatgccgctgccgcggagcgcgtcgagggcctccttgtccgggtagtagatgcgcatcgcgccgatgccttgggacttgagcagctgcacgacctcgctccgcggcgggaggttgtcgccaagaacaccgtagcaaacaccattgacagctgcatcatcaccacggcaccacgcaaccgtattacgatcgatcgatcgatcaaatcaacgaaaatagagaattaattgcttgaaaaaaggaaggaaaataatgaataatctaaaatatatacctcccatttgctcaaatagctaggtgactcgatctgtctcagctagtatgcttgatcgagtttctggagatggatatacgtatgcttcaatgctcgctcctgatcgtcgataggaatatgaatgggcagcttcatatatatagcgacggatgatcaatgatgttaacttcacgtatcagagagccaatcgttcttctcttgtcaaaggggcacgagtttttagccaagtggtgccaccagtataaacaagtggcactaatttcatccgttaaatttgccgatggatcaaggatgtgcaagcctggtagcaccgtgggtccgtggcggctatcagctctattttcatttgcacgttaatctacgacgtggtttcgtacgcgcacatggtttacagtattcaatcggctaatagcttattgattggtctctatgtaataattaggcttgacaaattgcattagcatgcatggttccgatgattacttgggagggaagagcatggcatcctcctgcgatgcatgcatgtacgcaagttccatcgcaatgtcaagttcccccggccgtttgttgagatgactatatgcgttttgttatttgcgatattgaaattgggcgcacatggtaggcgtgtacttgtacagtatttttttttagataatggaaaaaaatacaatatatatacatggggaaccacctatgcatctgtcgggtgattttttctcaaaaatcacccagatttttccttgcccttagattttcatccaatggagtaaaaaaaaaccgaacagacagctaaaaaaggccaaaaatgactgggccaacacactaaaaaaatagataaaacatgggctgcaatctggcccaaacaacaaattagaaaaataaatcaaacaaagaacagatctgagaggctcaaagaagtaaagtcaaccctgtccaaaagcatcaacttggctgccaagaaagctaaaagaaaaaggacaaacacaaatccaaactaacacaccagatccaaaaaagcaacaccacgcacaccatggagaacgagtaggagagaaagaagagaaaaaaggttgaaccaaagcaaaattcttcaaatcaaagtgaaatcacaggggagaaacaagaaataaggaagaaatccaaactaggtatgttccataaacctgtgctcatcctcaaaattgactacaaatcttagatcatagcaccatacgtgcccccatccataaggagtgttttgaacaaaatacagggcacagttcatacactgaaagtaaaacttacagtgcatttgcactaaaattacattgtaaaaacagtatatatgacatgtaagtgcactgtaagtttagtacaaatgcactgtaaaattatcaatcaatcaaacaagtagaccatacagaacaacttctgttgtttactacctaaaaactgaatacatcaattcaaacatgaactcaggagttccagcaccaaatacatcatatcagttgggcagcacaaaaaagaaaataaaaccacaatagtgagtagtatggtgatatgggttagagacaactaacctgcatgatggctgccgggtttggtcttgatgctggataggatagttgagatccatggagtcagaaccaaactaaaattaagagaacacaagcatgaattaggacatgttccacagtaaacttcagttacaaaccaattggtatagggcacaatccatatgaaaaacaaatatatgcacaagggataaataatgaaaaacaagttcagaaactaaaaaacaacccaccaaaccaatttcacattcatatatgctcaaaagtagaaatttacattgcatttgcactaaaattacatttgtaaaaacagtacatatggcatgtaagtgcattgtaattttagtacaattacactgtaaatttgggtaacataattttttgcattattgaagtgtaattgataaaatgatgcttgattagtaatctgtcatacagaacacctgcatatttcactcctcaatactaggtattcactcatttaagacaaatggctggataaaattttagtgatttccaatttggaactagcaaaacagattcatagttctctatatatttggcttagaatatagaccatagatcacatttaatactctcatacagaacattcaggaattatataggagcaggaccctccaataatccattcaaatcaaatctaggattaaaagaatatcactccaagaacatcatagtaaacaatctagggtactcaatatcttggaaatgtgtgatgactcgatctgccatataaacaatcttagtacatgcagagcccgatccacaatattttagtacttatttaactaatacaactacaagtatatatgcattatgcaacagttacatcatcattgagaatcatttatgcacatcaaatctatatctctagatcaggatagattcattagatcaacatgactagatgatacacatggaatacaaaaattactgtcctacataactaaaattacatctgtaaattcaggtcattgtgtatgtaagtgtactgtaatttttatacatttgttgtgtaagttataatgtattactctatgatgtattgttgtattctaatacattcaataaaattttgcagaaatgaagtcatatgcagatcctgtcaaaattagcatcaggcagaaaaaggaatctggggagacaaacaaggaaaaactacaattaggtattttcttttaaaaaaatcacatactatgttgatctgaacatcatgtagaaatttaaaaaaaatatcatagtacaactttgaaaaaaaaatcacaggaaaatgttcagctgcagggtgaaggatacaaaatattaaaaaatacattaagggttaaacactactactttcacaccattgttatcaaaactagaaaagggttaaacactcaaaacacattaacatagcacccaatcttaaatagcactatccatgctgccatacatatgcaaaatcaaacactggaagtagaaattacagtgatttgaaattaaaattaaaattagaaattacagttgtaaaaacaatttatattgcgtgtaacttcactgtaatttttgtgaataagctatgtaaataaatatgtaatacttaacattctagtaagatggtttcagtggacatgtatactaatttattccatgaattttgcaggaatgaaatttactgaaccagtcaaggttggatccatggagaaaaaaggtattgcaacactacactacttattcaagtacaaaacatctcacaatttcaaaaacttcaactacatagccaaatataataatcacatatataccactcctttcacttgccactcaataccaaacacacagaaatacaatcacatatgtgcctaaatacagaaattttaaaaatatatgcaaaaccattctaggctaacaatcataatttgacctaaatattatggccaaaaattacagtgctttatatctaaaattacatttgtaagttcagttgatacaacatgtaataaatccaaaaagtataaaacttacagtgatttataactaaaattacaattgtaaaaacagtttatatgacaagtaagtgcactacaaatgtggttcagtttataactaaaattacaacaatttatgactaaaattacatttgtaaattcagtttatttgtcatgtaagtacactataattttggtataattgaagtgtaacatgtatgtgtattgtaattttggtgcaaccacaatgtatttgaaaaatatattcatgtttgacataaaacatgcaaatgccacactgaacatatactgctaaagctcaatacatgctaaaaaatacaaatgattctcaaaagacatacctatttaacaaatcagtacctcatatacttcatttctcccatggcacaggtcgtgaagcaatacaagaaggagaaacaattagacaacaatcagaggagagcaaaaatgatgcaatgcatattgaaggaagcaaaagaaacatcaacatggctccaggtcagaaaatatatttgaataaattttgctctaagaataaataaaggtaactacaattatgtttgttgattctaacatatgctctaatgatttatataaattttacagggaggctggcatatgcaggaagtcctaatatctacaatttgcaggagggtgaaggaagcagcagcaaaatgccccatttaggtactaactaagtttctaaactaccaggtcgacaagctccaacaaaacaattgcaacatacactgatctaatattctgatctttatctttttcaaaatgcaggatgcaggaaaatacaacacgtaggaaaaaacttcaattcaccagaattaagcaataccataggaacaattgcatcagaagttgtcaattatggaggacaaatgctatatgatcaattcacattgctaaactcagacccaagacaggtacactaatcaaaaagcatagatgtagcatataaaactattttatacatgcagttataaactaataaacatataactgtgcaggaaggacagttgagctacactaacctcatgcaccaaataattcatagtccaactgtcaccatacagcaacaaacagtaagcatatcaacttacattatatacctaacaaaaaaaaagagaaaataataaatgaactgatatgtaaactatgaatatgcagggaggacaagaaagctttacaagtctacttcggacaccagcatttgatgtaagaataaaaatttatgaatacttatgtaacaattccctaattagtcatttaaatcagtactaactactgttttttgatattgcagaattcaatgatcttaacaaccagtagattttctccagaactagaagagcagcaggatatgacatatgagcaacacatatcaactacacactggagctatgaagaatttgatcagatttacaacagcaaatacatcacaccttttgctgaggtgattttagctaaaatattgacttcaaattgtttagacttaagctattttgcactattgattaacaagaacttattgtttggcagaatacaacagcaagaatagaagagctgtatcaatcaaaaaatagccatttcactacaaaggtaaaataaactttgcaacaaaaaaaccctatatcagcaagaattatcaagatataagtctaaccatcacaaaacatgcaggacaatgaagtggatatggcgactgaaaatgatgattatgtggagctgaattcagatgatgaaaatgagcaggtatactatcacttatttgaaaaacacaatacttattcaaataatgttaggaggatagatctgcaatggtgctgacatattacttgaacaaaattttcaggaagggacttcaaacatgcttcagcaagattcccaaatcaatacaatcacagcaattgaacaagttgagcaacagtgttgggcaagaagaaacaacaagtgagacaaaagctacctcagcagaggacaatgacactatcaatgaagaagacattaacaactacttggctaatgaagaagatagccaagataacactcctgtagtaattgacaagaaacacataccttgcattggcaagaaattcagaactcatgaagaagcgcgtagtttcttcaacttctatgcatatcaagtgggattttctgtagtcattacacaccactacaaatctacaagcaaaaaaagatttggtcagatcaccaagtacacataccagtgctacaggtatggtaagaatgatgatggtcagaagaagaaaaaaaagaaaactcagcagcagaggaatacacaggtgattgacagaactgattgcaaatgcatgctaacagtgaggcttgaaggtgatgtttggagaatactaagcatgaatctcaaccataaccatacactcacacccaatagagaagcaaagttcctcagatcacacaaacatatgacggatgaagagaaaaagttgataaggactttgaaacaatgcaacatacccacgagaaatatgatttcaatattgtcatttctcagaggaggcatagcagcactgccatataccagaaaagacgtcagcaatgttggaacagcaattaactcagagacaagaaatactgacatgaatcaagtgatggaatatctaaggcaaaaagaagcaaaagatcctggctactattacaagctgactctagatgagaataacaaagttaagagcatgttctggactgatgggaggtcaacacaactctatgagcaatatggtgaatttgtgagtttcgacacaacttacaaaactaacagatataatatgccatttgctccaatagttggtgttacaggccatggaaacatatgcatttttgcatgtgcatttttaggagatgaaactacagaaactttcaaatgggtttttgaaacgttcctaacagccatgggaggaaaacatccagaaacaattataacagatcaagacttggcaatgagggcagctatacgtcaagtatttccaaacagcaaacatagaaattgtttgttccacattttgaagaaatgtagagaaaggtcaggaaatacattttcagacaagagaaggaaagatctctatgcagaatttaatgacattgtgcacaatagcttgacaagagctgaatttgaaagcctatggttgcaaatgattgcacagtacaacttggaaaatatcaaatatctggaaataatgtggagaacaaggaagaattttataccggtgtattccaaaacagatttttgcccatttatacatagcacagcacttagtgagggcacaaatgcaaggtttaaaaggggagttggcccaacacatagtgtcatgacttttctactggaatatgaaacaatcaatgacatcatcttcgacactgagtatgggaaagattatgaatccagaaacaagaagccaaagtctttttggtcaaattacatgatagaagaacaagcagcagacctatacaaccatgggatatttgataagtttcaagatgaattgaagggaacactaaatctagaagtggcagctatacaacaaggaaaagcatatgaagtatatgcagcgccaaatctgaaacaacaagaattcagaccaagaagatatgttgtgatgacagacttaccacaagaaaacttcatgtgcatatgtgcaaagttctccaaagatggaatcctatgcagccatgttttgaaagtgatgttgtatctgaaaatgagcaagattcctgataagtacataattgaaagatggaggaaaaaggagagaaaattaacggtgagcatgcaacttgcaacaaatgacgagaacagttctgtgctaaggttcaatgtattatctagaagaatatgcaacatggcatcaaaggcatcanaaagtaaggaaacatatgagtacctgctaggagagattgataatctggatagcaaccttgacttgataattgaagatgcagctcaaaatcaagcaacaattgatgaaagcaacacggtggaaaacacaagtgaggatcaagcagaaaaagaaacaacaaatgagcaagaagatattcaagaccctgacatagctaacacaaaggggaaaaaatcaacaagaacaaaagggatggtagagaagataaaagaacagccaaaaaaacattgtacaagatgtggaagaacaagtcacacaatagaaaattgcccgctgatgcgaattgcaagaagtacaaagaaaatacagaagactacaacaacaagtaaaagaaatgaataatatgtaaaatattacaaacatgggcaagcaaaaaaaatcaagctaatggatataaatttttgtattgcagggacaatagagaagcaagcaatgcccgctaggaagaagaaacatgaagaaaatgacaaaggaagcaagctacctaaagatcaaggaagcacaaaaaagaacaaattaaattagaagacagaaaacaaggatgtcaaattttgagactgaaagtattagaccttaatgtttttcactgtattactgcactacacacactatatatgtgtattcatactaaaagtatttgatgtaagtgaacatctgtattcactacaggaatatgtaatggcactgcaaaaatgcattcactatgatcctatacattccactatgctagcacacactacagttttatatagcgactaatcttctggacaaattcagccttcaccagcaaattgatcctacaataacaaacaaaaataatattttcaaaactatgaaagaatccaaaaaacaagaatggcaaaaaataaaagacacttacaagattaaaccaattttcatagcaactatctttctgaaaaatttcagccttcaccaacaaattgagcatacaaataaaaaatgaaaaacatttttttcataactaaagatgtatcaaaaaacaagaataggaaaaaaataaaaacacacttacaggattaaaccaattgagcacaacttcttcaacttcagtctgcagcattttattcgttggatggaagaataactgatttgcatatagcatccgaatattgtcaatatcatctgaagaaaattcatttggtagaacaacccttggtgaccacaattccatacacttcataacaaaaattcagaatcaaagctacaaaaaaaattgaaacaactctttaaattacaaaaaacaaagaaataaaacctaggtagcactgttcatgatattgttgaatttagttgtaccacaatggcattttttcttgtttcttgtattattattattattattattattattagtatgttaaaaattgggcaagtgttattactaacatcctaagaatatatgcaatacgcaaaaaatataaaaatatatgcagcacagtaatatcacaaaatgtaaacacaaactactcaccacagtaatatcagaaattaaaatacacagcaaaagtgtgagcatagcacacacagaataaaaaaatatctagctcacagaattacatggtaatttcactagttaacaaatgaagcaagaacattctacaatgccccaatgagaggacaattaatgacatttagaaaattagaaaacattggccaaagtaaagaagtattgagaatttggacatcaacaaataagtaatgtaatacaagcgtgactctgcacattcctgaaataacgtattttgcaatgctccaattatttgaacagaaaacattaaacacaaaaaatataccaagatctctgttttggaacacaagggtaaactttcttcaaagtagtaaaatcaattgaagagccatcataagaatcccagaatgtctgtaaattattgatctgaatacaaaataaaaaaaaatcaatcaactacaaaaaacaagaagaaaaaaactgaatgaaaacgcatttaaaattaaaatatcataccagtaagcattcaatgtcttcaaaatagggatcacctttttcatgtaaagaatctaagaggaccaacattctgtcctttatatcaacaacaaaaaggaaccaatgttcaaggtgttcgatggggaaaaatagctgcaaaaaatcattcagaattaacaacataactttggaaaatttacatgagcatgaaaacaaaaaaaataccatgtcagaaaggtgcaacttcctagcactagctgctccaagaaacgatcttttcaccttgctcaaatcagcacaagatagatcagttaacaatagttcctgaaaaaaaattaaaagtgaaataaacataccaaaaaatatgtaacatatcaacattaacagaaaaaagcacaaatttgaaaaataactacttacaccaatagaagagaagaaatagtgtctcttggagtttgaaggatgattgttgttgaacaaaacacggcaaaacacattgataacatagctcaatacagtaccacctttcatgagagattgcccaaaagaagagaattttgctctaacattatcaatgtctacagcatcataactacaaaaaaaagatataaaaagaaaagcaaagtaagaaacatgcataatgc

SEQ ID NO: 57413 - DNA, 11114 bp, Oryza sativa
ggtaattttccaccggtagaactcaaatccaggttgttacttttcaacatgttcttggcattatacaaattatcagtctgggtacacaacaccttgcagcaatcaggaaatgtagaatgaccaagatattccacatcaggagaattctaaaaaaaaaagcagaaaaaaataattatagaaaaaaagtaacttaggacaatatataaatatagtcaacaagaataagaacatacagtaacatcatcaaaacgcctcttcttcacattctgaatacaatgagttctgcttgttccttcattattatttataccaattacttgaacaggtgaattgtcaagacagtgaaaagatataccaggctacaacaaataaaaaaaataagagaaagtcaaaaaataaagcatacagaaacatgacatcacaaaatctattcaagaatttttaaaaaaagaaaagacacaagccaataaaaaaggaatacctgtgatgaagaggaagtgacatatcgagggttaagatattccttttgacatgaaagtgacttagcataaccaacagcttcatcttcacaagaatcaattaaatcagggaacaatggtcctcttttgtcatcattgttgagttgagataatcttgatttaattttatttgcaacattcctaacagcagcaacagcagatacagtaggacctgaagctggcaaaataactatgataagaactaacagaatttacaaattttcgaaatagaaaatttaagataaaatctagcaaagaaaaatcacaaaccagatcgagaatgttcaaatcgtgaattggagttattagcatatccaacttcaggggttagtaagccttgatctaggcaaaaataaaaaattaacagcaacgcaaacttaagaaaataaaaaattaacaatgcatcaccaagtaccttttttaaagtttggtgaaagggaaaatctaacagcagatttagagacaataacagaatcatcatttacctaaacaagaacataaagttagaaaacttaagctaaaaaaataaattataatcataagaagcagacacatacccccaattccttatcatgagaaggtgtatggcgaaaacttgtttcattagctttactagcaacagatttattggtacctaaaaaaaataaaacatcaaagaacatataaatagaagaaaaattaaaaaatataataaaattaaaagaacatagaagaaaacttacttccattgttatgagcatcacaagggatttcattttcaacatcaattgcatagttaggctgaaacccagggttgatatcatcaaaaattaagttttcatcaggatcaccaccatctctagaaccagcatgttcacatagcaagagcataatgctgatagcaatatcttcacaagactcactgtcaacaatgtgattggcagaacaatgactaacaaccattgaataaattttctccttaatgaaagcaggtaacatggtaccaatagcagactccaatttatctctgaatgtattaattctattttcagggggtacaacctaaaacaaggaaaattttaggttgtaaagataaatgaatgataagaattaatttataaaaagaaaaacacaagtaaaaataaataaaactaattgaactgaacatgtaccttgaaataagttgtatcattgaaatccttaatgggcctaaggccaaagttttcttcatcaactttgtcaaggtcagaatacaaagtaatcatattattcttccagtgagaaattctaggaaaaccaataggaacattcttgtcaccaaactcaacataatccagataaagcacctagcaaaataaaatatgaaaaagcaaagaaaaattaattaaaaaacaataataatatggaacaaagagaatggaaaaaaaattaataacttactgcccagagaaaccagcatccacccaaggtattaaacttttggatctttttgatggaagtcatcatccattcgtacacaaattttgaccaatcatatgaccgaagctcatcaacattctcaaacacagtcaaatacttggtgctagggaccaaagaagagtttggacaaagaaaacaagccattgcaacaatcaaaaatgaagtaataacttcatcatcagagagagtttcctttcggatgaacatatcaccaaagaatctcacagatggaagagcgctcttgccaaactttgaaagaataaaagactttccagcatcacaatcagttgggaactccataccaccaataggcagacccaaaatatgatgaacacattctttattaattgcaatgactttatctttcaaaacaatttgagaagacttcacatcaacatgatttgcaatccaagaagcaaatttgtttgggacataagcattgtcaaacatcagcaaagaattaaaaccatagtcaccaataatacgcttctgatcaggagataaagaagatagaactgttgagaaatattttgttgagaatctgctatatgagggctcagtcttcgaatgaactttagatttcttatcctaaaaaacaagtgtagaagtgtgttaaaaacttatttactaaattagaatatttaaaagctaaaagagaaagaaataataattacaattacatataccagaacagtacattagcatgaataaaaacaaaaaaaaatcatagggaggtagggagtgagggggtaaccatataaagcctaagaggcaaccatatacactcatgaacagaaacatataaaatttggtcccggctgtatagcctaacatttaaaatcataatatatctgaaaccttactagtaggaaactaatccaagcaaactaacacaaaatcacacatcaaaacagatatacttgagatagcacccaatcttaatagcaccatccatgctgccatacatatgcaaaatcaaacactagaagtagaaattacagtgatttgaaattaaaattacaattgtaaattcaatgcatatagcatgtaagtgtactgtaattttagtagaaattgtctgtaaaattttggaaacctaaactaagctataagtgcagaaaccatcactactgactattattttgcaaccttacaaacctgcacagccccgaaaaaaagtttaagctcatatcatattaaaatctgctgcgtgtagaactaaaaaaaacacttgagaaaactaatccaagcaaactaacacaaatcacacatcaaaacagatatacttgagaaaaaattagacacgatgacacacaaaaaaaaacatatccataacacgtgttatggtggctatgtttgcataatactagattgaattagttacatgggaaacatgaatatgacgtcgcatgcatgaaagctaccaaggatacttaggtgcaggatatgtgaaagaaaacaaagaaggtattagtgccaaacaacgagagaagaaaaaacaaaaaactcaacaacgttggctgcactgaactgtgttgagagaatagatacgaatctgtatagtcacaactacaacctgaaaaatactcacatcttcaacataactaatagtagcctataatagcatggtagcaaggttcagagtaccgcattgtacacatggaccaaacagaacaaatataaaattttattttgcaaaaaaaaaaaacagaacaattccaatctgaaaataactatccacttcattagtactacatttcctttgaccgaattaattctccgtttcattgataagttaacacaagattataagcaacaagaaacccaataaaatagaacaaataaaatgccatgcataataaaatatgctaataaaaaaaagatacatacaatgggattgtgaaaattgacagaagaagtgtcaaccaaattctttttcacttcttgaacaatctacaaatatgaaattgagcaacccattaaacaatataaaattaaattaacacaactcaacaaaaaaatattcacataccattttcctgagcacaacagagagtaaaccatcaatttcaccatgttcaggaccttcatcaacctaaaaaaaaagaaaaataatgtaataccaaattaaaggtaaacttaaacagcataatacaataataaaaatttaaaatataacttacatcattaccaacttcataatcaacatgaaaatcttcacctccatcagaatcaacttcaatgggatttttacccaaccttgatgtttggacacgaggcatctgaaagaacaataaataaacatcagcttggacatgagttaaaatgaacaaacaatacaaacttcactttacaacaaaaatcatacataaaaaacacaatcatgtagaaacttcactttagcacaagtacaacatccagatccatttacattgacataaaaaatataatcactgtgaagctttacaaagtaatgaacacatcatgtatttgctggctaccaaatttagtaattcagtaaaaaaattcactaatacaaacataacaaaaagccatgtcatgattctgaaaaattgcttcacgcctagaatttgccactaaatcacacatcaacaagcacaaaaacagaaactggatttgctaagcaaaaagcacccctaaaatcaaaagcctcccctaaaacccccgaatccgcgcgctaaacaaccattccccaactcaaaagcaacgctctgcagcaacaaaaacaacaaaatctcagatccattccgtgaacgcttcccacagcctaggaagaacaaatctccaaacctggaaacgcaacttggcgaagcagcagcagcatcacgatttcaccgaccaaaaaacattggatgccacacaaaaacgatgagacaaactaaacaaaactacggcaaccaacgtctccggcgagctctccatcatattacatcgattcaaaaacaactaaagccgagattgaaccctaacacaatttgaatcggacctacactgaatcaaatcgaacaaaaacaactaaaaccgagattgaacccgaacacaatttgaatcggacctagactgaatgaaatcgaacaaaaaaaaatctagacactaaatctcgccagcgaccaacctctccggtgagcaaatcggacctacactgaatcaaatcgaacaaaaaaacaactaaaaccgagattgaacccgaacacaatttgaatcggacctagactgaatcaaatcgaacaaaaaaaaatctaaacactaaatctcgccagcgaccaacctctccggtgagcacgcacaccgacaagacagtcctctccggcgagcacttacaccgacgagacaaacctctccagcaagcactcactccgacgagatctctctctcgcctcgcggagaaaacgagaagagaagagaagaaaaggggaaagcgagagagagaaatgcgaggagagagcgggatcagcgaggggaaataaaaaacggctacggacaagcgcggaaatcgaaatttgcacagtgcaaagtaatcgggccagggaatccaacgcgaggccctatccacgtatgaccacgtccaccccattcctggcacaaatctcggcgcagatccaacggcaacaaaaacgggaaatagcaacaaaaaaatcacccgacagattcctagcaaaatcgtatacatggtatacaatgaatgttttggaagttgggccaaatcatgagcacgtgggctacaccgttgacttctgggccttgttgctgtccgtctcatgggctgcctcttctccagttgggccgtactggctgaggcctggagcctggagggcaatgcaaagcggtttcctgaacggtccggagccgccctgagatgcgatgggtagaatcgtggatatataataaatcgaagacccaccgattggtggactcgatccggagcgaggaggtgtcgtcgctgctgctactgcctaccatggagggctcgagtaagcttcccaccgattgttcatctctgctgcattaggctagtgttccggccggtcgccggcacctgtaacttgttcttgatatcacttttccatccgttgtctcatgccacaagaactcccataattttagagttgatttgggggttttctattttccagtatatttttaaattgctaaaataatgtatatatatttttaaaaaaattgcttatattttttttggcaaaattccgcttataacaagtataagcaataccatgaggctcaaaagttatttgaccgtaagatcttcttcactttggtggatagcaaagtgtgctcattctttctgtatgatttgagcaggctagtgtagtgctccagcaatattccttcttgttccaatgtggattatatttgattatatcagaacatttaagattaagaattcagtgatcaatcaacggtactagccaatctgctcatgagtcgccatgtttagagaaaccaataaccatactccgcaagaaaaagttccaggtgtaaaataaaagggaaaaatgttaagctcgtgtgctttagagcaagtattaagtaaagccaactatgcgcttatagctcatattagagttaacatacatggtagatgagctttaagcttatttttatttttcttcttctctctctatctctcatctatgcatttaatgtatttatcttgaattacgtgaatagttagctcttacatgggagctagctctctttattttttaaactattatacttgctcttagtttcttatttttcttctgttattatctgcagtattgatgaccatatatgacatgctgcagatgaaaaggtgcacactaagccaaggagatgataattttcaggttgataaaacattaagatattcagggccagacctcccagaggtatgtggctttatatatttcttatggaagacttatataacaagtaaattatcactatccctactctaactgggcatgtgaagttgtgaactatgcttgctaaatataaattgcgtgaacagatagtcaagtactttattgcttttttttttactgacattcatagtatgctctagtttcctcataactaatacacgatcacttatgtggcaaccataaacagaacctcttttgtttttatggggattaaaatgtaaagtttccaaaaaaaaagaaagaaaaataacatggaccaaccacttcctaggaagagttaacaaatcattgtctatcagtttggtgcagcttatttatccaagcaatgttactcagagcacctagggtagaatgttattatactccatatgttcatattgttacttagttggtgtaatggtttgtctttagagtccctaacattcaacaattatttccgtgcttgtgcaggacatttggcatcatatccattccctaatgccattgcgagatgctgcccgtgctgcttgtgtatctcgtgcatttttatgtaactggaaatgccatcccaacctcatcttcactgaggaaacactgagcttggaacaagatgcacgtcgaaagggtggtaaagcacgcgctttcgctagcaaagttgaccacattctgaaaaaccactcgggcattggtgtgaagagactcaagcttgtaatatgttattctggcaagatcaatgtaagttctctcaacagttggcttcagatagctattacaccggggattgaagaaatcacccttcttctgcctacaaaatatgagggaaggtacagttttccactctcacttctatgtaataggagtggaagctcaattcagtatattcacctcatgtattgtaacttacgtcctacggttggccttggttgcttcacaaatctgacaaagctgtttttatggtttctgtgtattacggatgacgagttagtatatcttctttccaagtcttttgctttggaggagttggatctcagatattgcagtgagataatttgcctgacaataccatgcctactagagagagtcggttgcctcactgtatttgagtgcagcaatctgcaaatgataaacagtaatgctccgaaagtttccacttttacctttagtggtgacccaatagaactctcacttggagaatcatcgcaagtgaagaagctagatatgagctgttcagatgtgcccaacttcatatattattccattaccaagcttccctatattgtgccaaatcttacaagtctcaccttatcttcagttaatgagctatacatattagatatctttgtgatggcataatcagtaatcatgcactcatctcctgggatatgattaatttttacagggtattaatacaccaacagtagctgccaaattccttcatctcaagcacctggatatttgtcttgatgcagataaggccttgcccccagaatatgactatttgtctttggtttcttttcttgatgcctctcctgttttagagaccttcatcttgtgtgtaagttatcattctttctgctgacatctatggtaaaccaatttaaagttcagttttggggattttttctggtgtgttgttcacagccacacacacactatttcacttagctacatatgcaagaaggtccccaatacaagagcatattacatcaacactccccctcaagatgggcaaaagatatcaatcatgcccatcttgttacacattgactcactctcactaggacctaatcccttggttaaacaatcagctagctgctcagaagatttaatgtattgtagtctaagagccccactatcgatcttctctttgatgaagaacctatcaatttcgatatgtttggtgcggtcatgttgaactggattgtttgcaatgttgatagcagatttgttgtcacaatgaagcaccacggtattatttctgaacaaccgtagctccaacaatagattcttcacccacaacatctcacttaaactcaatgccatggctctatactcagcttccgcggtagatcgagccactaccgcctgcttcttgcttcgccaacagacaacattgccacccacaaatacacaatatcctgatgtagatcttctatcatccacactgcttgcccaatcagcatcacaatatccttccacatccaagtgttggttctttctaaaccacaaccccttaccaggagttcctttcaagtacctcaagatcctatgaaccacctctagatgagttgttctaggatcatgcatatacctactaaccacactcaccgcataagagatatctggtctagtgtggcatagatatatcaaacgtccaaccaacctctgataagtttccctatcaactggatcacctgactgtgcactcaattggtgattcctatcaatgggagtagcacttgtacgacatccaagcattccggtttctgttaacaaatcaaggacatactttctttgagagagaactatcccctttgatgatcgagcaacctcaatcccaagaaagtatcgaagaggtccaagatccttcacctcaaaggcctctcctaatcgctgctttaagcatttgatctcttctacatcatctccagtgatcactatatcatcaacataaacagccaagatagtgatgtgtgtccccctatgtctatagaaaactgtgtgatctccattacattgtgaatatcccatattgcacaatacacgcctaaacctgtcaaaccatgcacgtggggattgtttcaaaccgtacaaggacttcttgagcctacataccttcccaacagtctggctatttccaaatccaggggggaatctccatatatacctcctcttgtaaatcaccatgtagaaaagcattcttgacatctaactgatgaagaggccatccaaagttaactgcacatgatatcaaaatcctcaccgtactcatcttagccacaggtgcaaatgtttcatcatagtcaattccatatgtttgactataaccttttgcaactaatcttgctttatatctatccactttcccttcaggggtttgcttcactgtaaatacccatttacatcccactgctcttttccccattggtagtttcacaagttcccatgtcttattcttttcaagggcacgcaactcctccttcattgcatccttccatcttggatcttgttttgcacatctccagtcctttggaataggcactatttgcaatgatgcaatgaatgctttatatgcaggtgaaatatgagagtatgagatatagtttgcaatgtcatgtctagaactaaggtgttcaaaaccaaggcgtataggaggtcttccagcattagatctagtttctctacgttgtgcaagaggtaactctacttgttcaaggtaggagaaatgttaccacttgtctcaaggagggaggaacttgttggagagaggctagaggaggaatctgggactgggtactcaaactgttgcagctgttgtgactccttgtcttgctcttgcataggctcaccacttctctccccctgattctgaatttggctcctctggtgcacttgctccttccctgtcaccttatcaacttggttcttgttccttctttgatatactctcatttcagtttgttgtacttccacacgctccagaggacatgggattgtcccgacaactaccccctcatccttgtcacaactaatgtctactaccttctcaccaatgtccacaaccttctcaatagtatcaccaacaaaactcggaattgacccaataaccacatcctcatcaccttgcttatgtgcatcaacctcaactatctcccccactcgactgtcgatctcgatgacagttgagaactcctctagaaattgatcaaggtctcctcgactcctgtaataaggttcaaactctcgaaatgttacatccatactaacaaataacctcttcccaatagggtcccaacacttataacctttctggttagatgcatagccaacaaagacacattttactgcatgaggatccaacttgccaacaaaaggtcgatgatctctcacaaaacaaacacaaccaaatacctttgggggaactttaaattctcgcttcccaagtaaaagttcagctggtgatttcataccaagtatcctggatggcatg

SEQ ID NO: 57414 - DNA, 3510 bp, Oryza sativa
tgggcatggtccccaaacatcagaatgtattaatataaaaggttcacaactacgaagaccaattccagcatatgtagaccgtgtatgtttgccaaactcacaagcatcacaaacaagtctactcttgtccactttggtaaagaggtcaggatacagcttactcaaactctcgaaagatggatgtcctaattgacaatgaagcaaaataatctccttctcagtatctcccactactacagccaatcccatctcctcttgattgatgtaccacagcccattacgcctgactccagtcccaatcctcctcccagtccccttctcctggaagagacatgaattctcatcaaatataacgatgcacttgaattgatcaatgatagaactaacagagaggaggttgactagaaaggaagggacatgcaaaacagatgacaagctaatagatggagtgcactctactgaccctataccatgaatgagttgagatgaaccatcagcaatttggatagtttcagagggagcaataggggagtatgaggagaaattattaggcaagcctgtgacatgttttgatgcacctgaatctattatccagtctacatgatgtctatatgtggatgcaagtgcatgtgcctgagtaccttcgcccgtgtgggcgtagttggcaaagttaccgaagtggctggttgttgctttagcagaattttgttgattggagtccacggggcccttattcttttgcattcctcccattgtgcagcttgttcacctgttagagtgatagatgagctctcccccatgacaacattggccctaggaccacctaggcctctacctcgacttccaccacggcctccacgttcacctcctcggccacctcggtctcctacatagccaccatagccaccacggctcccattgaagccaccatagccaccacgtgctcctccacgagctacaccccgaccattattgttcctaggagaaggacaattgtagctcacatgcccctttaacccacaattataacactccctgtcattaattgtgatgtatgcagacctcacaggattacttcctttcatcactttctgcctcatctcctcctgaaccatggctgaaatagcttcctccatattaggtaatgtagcttggtgaaacatagctgctcttctatcctcaaactccttgttcaacccctttaaaaaatgaatgactcttctcctttgcagccatttatttccaatcacaatatcatcatcatgctttaattgtaggggattataatgatcaagatctgcccataaatgttgcaactcgctggcatactcttgaactgttctcccttcttgcttcagattatctaccttgtcttgagcctcaaccatcatcataacatttccctctcctgaatacatgttgctcaatgtcttccatataattgttgcattctgaatagcttctatcatcctagcaatagatggggacaccgaagtcatcagccatgctaccactgtagaattagtggcattccacatcttccattccacactagatttatcaataggttcaacacaagtttcctccaaataatgttctacaccttttgctctcagcatcaaccttgcccttctagaccagctcaagtagtttttggtcccctccaacctcacttcatttggcattacttccaattttatctcagatggtcctatcccactcctaagacccatcatacctgtagctatgaggtcctacaacagacttttcatctcacctttagtgaaaaaagaagattctcctgccacactttccttcttcccagcctgcagtgcagcatcctcctcagcctttctttgttcttcagtaccctcggtgttcaccatcttctctgcactccaaaaaccactctcaatagatcactggtaccccacttcccttgcttccccttatcaacaatggtaggaaaaactctcctctaatcttggataaaagaaaaaaggaccaggcttcttcccctcacagaccacaagtcaaatgctcctccatccaggcagtagccaaaaaacaagcaaaaacaagagacgtaccacctccttcctagttcctgcagcaaacaatcctcctatgtcaccaagtctgcagccaagccaccatcctccttttcccttagctgagctcctcacatttcctgtgtgagcagcaggttacaacacacgcgctgcgcccgcgcggccgcgcgcagcgcgcgctcaccagcccctcaacgtggctgtgtgtagaggctggtcaggccggatgagagcaggggcgacgtgcgacgacggcagcggcgacggcggcggcgatggacggcggcggcggcgacagcaagctagggttagggctctgataccataaagttcagttttggggatttttttctggtgtgttgttcacagccacacacacactatttcacttagctacatatgcaagaaggtccccaatacaagagcatattacatcaacacaattattcaagtgccattatttttttattttatgcaggtacaacaacatgacatgaagcatgagtgtgtttctgaagatgcctcacatacgaggcaaatgcctgaacacaagcattccaaccttaagaatgtgatgatccttggcttctgcactgcaaagagcatggttgaactaacatgccatgtcctggagaatgcaacagcctggttgtttagttccagtccattagtgcagcaagcgggagcagcttgagttaccataatcgtgctggtggaactgaaaaactgaaagtgtttgatgtgtccatcagtacgtttatgtgccatttgtttggcacaagatagtaccaatatatagtcacagcaggctgcagtcatcaacagattaagatatcctgagtatttttttgtaaagaaataaatttggaacttttattcatgtagcattttcaaagcacaatgtgccatacagagtacattaacattcaaccaacattaattatttaagcatggattattcgtctatggaaatccttattcgcattgacatggtcagccgctagttcggaggaaacgtaatcgggtagaccggcgtcttgtcaggattgaagagcccaaaatgcctctcggtctcatccccgggcttctggttctcgttgaacatggcgaacacgtacgtctccagctgcccgggccgcttcggcgtcccgttcttgacgttgtcgatcacgccctggttgtgattcctcgcgttctccacgttcgccgcgaaccctcccgccgacggccacccgctctccgacacgacgacgcggacgccgggcgcgccggccttctccagcgcggcgtacacggcgtccaccatggcgctgaagaggttggtgtaggtgaggccgctgtcgttgtccctcaccgtggtgcccggctggaacgtggcgtatttgagcgggatgtctcgcgggttgtccctgtaagccaagtaggggtacacgttgac

SEQ ID NO: 57415 - DNA, 46107 bp, Oryza sativa
  unsure (1)..(46107): unsure at all n locations
gaggaactgcgcgatgggcaccatgaactgctgcaggtcgggtcggaacacgccgtgcgacggagggaacgagttggtgatcacgtccatcttcaccgccgtcgacaccttgatgctgttcgagaggccggcggacacgagcgcgttgtacaagttctgcatggccgggaggatggtccccatgtcgccggggccgagctcgttgccgacggcgatgtaccggatgaagacgctcggccagtaggcctggacgttgttccggacccagtcggcggcggcggaggggttgttggcgaggttggccaccgcgcccttgtcgccgacgtcgacgatgacggcgatgccgctgccgcggagcgcggcgagggcttcctggtccgggtagtagatgcgcatcgcgctgatgcctttcgacttgtacagctgcacgacctcgctccgcgacgggaggttgttgccgacaacgccatagcagacaccgtgggcacctgcatgattaaaaatctaaaattaatcgatgaagaaaaaatacagagagattgaattgcttgagaggaattaattgcttgttgattagcgaacacaattactagttgattagcaatagattaacgcagcatgcaagataagaggatcaaaagaaaaatgaaaactgaattaatgtacctcccatttgctcaaattactcagttgtcggagatgctcaaatctgaatatgtatgcttcaatgctcgcttgtgatcgtcgctagggaaagaatgggcctccttatatactgtgagatggtgcggcttttcgtatcagatgatctataaacaaccaggtggcacttcgaacggttagtacttagtagttagataggtttaattatatttatctctcgaaaagttgtaattgtatttgccgaggatttgcgcgcaaacctcacagttcagattaagcttgctcattactatttcttgcacatttgtttggataataactaaactatttcttacacatgtggcttgcagtattaggttaattaatctaacggttgattctccgttcatcattaagcttgacgaatgatagtgttgtggcctcatcgtggccacgtaagttcaaacacaatgtcaagccgcctcgttttgttttaagataagatgagctggccgtcatgactcgtacctatactgatgatcaggtcaaatatacatgcatgtgcgttctttgctactgacgactgacgagtagtgacgagaggcatgctcggttttgcttgcccgcgacaagttcttcgcgtggctatctgaagatcaccaacagcgacaccgtgaatgcatttctctgagtattcaatattagatatatttccaatattaatattaaccatcgacatcaacgaataagtagagggaactaatattattttagtgtagctagcttgcggtgtggttggtctctccctcttgctttcccacagtcttcgatgataatctgacatataaatatgaatgcatataaattgcgtgtcaagatgagcattagagaacactgtctaggggaatgtcgtcttgtcaaatctctatgttgaaacaattccgcatatgcaagttttatgccaagctggcaagctagatggcttgctgtgtttatatatctgagctggttaacttgatctgcagtatccgtgacccaacttaattgtcgaagaaacgggtggtcagacaaaattaagcttacaaggctgggcattcatggcatggggtgcaacgtgtttagttttgattggatcacgacgagcttgtggttatcttcttattgggacctcatagcctgagaaatatttcactgaacttgccttatattccgctgaataggagcacatggctgagttttggtacctcctaacctatgtaccaagagttactaaattaaaaaatagtacctcctcaagaaatataaaattgctcatataacaaacacattggcaattaagcctctatggaatatggtaatattcccccatgatatgctatgccattgatcatcaactcaatagtctaattgattgattatactcttaaaaaaaccagttgattgatcaagcaaaacgaagatgtccattccaagtgggatctgcattcttcttcttcttgacaattggcattttgtataagccgttttacctttttttttaagaacaatagccggcttacctagatgccattttacagattttttttatttttatttattaaaatattttaaaaataattttttatttacaaaactaatcgcccatcactctttgatagggcaacttttaaaaatcacccctccaaaggacaatttatccaacatggcagacagccgttggccatcgcctaatggccaaccaccgaggacgccgaaattttgcaggcggcccctttgacgctagggctgtcaacgagccgagctcaagcgagcttgcctgcctaggttcgagctcgagccgagctcgagccgagcctataaaatgttcgagctttcaaacaggctcggttcgagctcaatcaagctcgagctcgactaccaagctcgatttttaattagaacagtgtattttcaaaggataatttttttaaaactatttaatttatggtttatcatattagtagaagaggaaaagaataaaataaatatttgattccaatataagacatacaaataacatatttggtctactaatttattaaatagcaacaaaaaatcataaattactaggctcgttagaagctcgagcttggctcgcaaagctcgtgagctttgggacaggctcgggctcggctcgtttggaggtcgagcccgagctcgaatcgagcctaggatgagtcgagctcgagcagctcgcgagcctcgagcttttttgatagctctatttgccgccctcacagagggcggtttttggctctaggggggcgcctgcaaaagggctaggagggtggccagacttttttgcagatggcccccttgccgccctcacagaaggcgattttacactacgcaggggaccgcctgcttaaagggcggcaggagtttgccactccccttctgctccccctcactctccctcattttcttttttttttggattttgagtgaatataatgaaaaatcagagagggagaaggagttttatatcccgcaggggcataaaatcgccctcacagaggactgcaagggagccgcctacagaatgacaggccgtcctcgctgcccttttgcaggcggtaaggggactgcctgcaaaaatgctaggctgccctcgccgcccttttgcacgtggcccccgcatagtgaaaaaacgccctcccagagggcggcaaaggggccacctgcaaaatgcccctccctcggtggccggccatcaggtgaggggcaatggacgtctgccacgtcggataaatcgctctctgggagggtgatttttaaaaatcgatctccatcaagatagcgatggggcgactagttttctaaatttttcaaataattttttaaatattttaataaataaaattaaaaaaaatcccattttacgtgggcagcatagtactgatggccttgttttgggctaatccattcggcccatggatttgttatgaatgactttgttccgttcccataaacaggaagagttcatgacggattagtccaaagcaaggccctcagtgctgctatgctgcttatgtccctatgactgatgaacaatgtccgatatggtgtaattcgatctcgatatacagcttcagaatgcacaataatctcgtcatgatccaatcaaagcttaaacaccttgtacccatgaatgatctgccttctagcttttatctgaccaccggtctctgacgattaagccatggattctagatcaaagttaaccagctacttggagaaacatagcaggcaatcttggcataaaacttgcatacatggaattgttccaacatagagatttgacaaggcattcccctagatacttacacagtgttctagtgcgcatattgacacgcaatatataacataaatatgcatttccttctgaacttcagattgtcatcgacgactgcgggaaagcacgagggagaccggccggccaccacaagctagctacagactaaatcaattaatttcatctgcacttactcgttgatgtcgatggctaatattaattcgaaatatctaatatatgaagtactccacttgacaagatcagagaaatgcatgcacgatgtcgctgttcttgtcactgtcagatagccacgaagaacttgtcgcgggcaagcaaacaagcatggctctcgtcagtcgtcactactccctatatttcgtattataaagagtcaagtaccataaataaattaaaaactacatattcaatatttaacatgatgtacggtaaaaatacatatttaaaacttaatttatcgcagaacgataaatttaaagtataataatatcacaaaactatgatttagtaacagatttatcataaaattatagatttagtgtcaatttaatcataaaacttggatatttataatcaaacataacattgatgtcaaatatttaaatcataacattagtgttaattatttaaaccataaatatgtagtatttttttgcgaggataaatatgtagtattgtgataattttattgttaaatatgtagttatacgatacatcaccttaaatctgtaattttatgataatttagtcaaagtatatgtagttttgtaaaatttattctattataaatcgtttgattttttttctcaatcaaaattatttagatttgtccaaatttatagaaaaaattagcaacatttataacaccaaattagtttcattgaatttaccatcgaatatattttgataatatatttgttttgcattgaaaacattactatttattttttttgtaagctttagtttgactaagaaaaaaaattcaagtgagatatagtataaaacgaaaggagtagccagcacggtatatacttgatctggtacgagtcattatggccagctcatatattatcttaaaacaaaacgaggcggcttgacattgtgtttgaacttacgtgcccaagatgaggccacagcactatctactcgatccaaacacaagaagttccatgcatgttaatcgatcagtcgtcattcgtcaagcttaatgatgacaggaaaatcaactatatattgggttatccaaacaaaatgtgcaagaaaccttactggttaaccgattgaagtgtctcattgacaagaggaagaagtcacgccatcttgcagtatataaggggggacattctttcctagctacgatcacgagctagcgagcgcgagcatcgaggcgccattcataattccatctccagatactgatcaagcagatcagagctcgagttatcatagctatttgatcaaatgggaggtatattgagagcttatatttccgtttccttttctctttcatgctgagctgatctattgctaatcaattaactaaccctctcatatgcaattcgatctctctctctctttctctctctcttgctattttatttccttacacatcaattaaatcgtctgatttggtatcaacatgcactcctatgtttttgcaggtgtccacggtgtttgctatggcatgaacggcgacaacctcccgtcgcagagcgaggtcgtgcagctgtacaagtccaatggcatcggtgctatgcgcatctacagcccggatcagaaggccctcgacgcgctccgcggcagcggcatcgccgtcatcatcgacgtcggcggcatcggcgcggtggccaacctcgccaacaacccctccgccgccgccgactgggtgcgtgacaacgtccaggcctactggccgaacgtcatcatccggtacatcgccgtcggcaacgagctcggccccggcgacatggggaccatcctcccggccatgcagaacgtgtacgacgcgctcgtgtccgccggcctctcgaacagcatcaaggtgtcgacggcggtgaggatggacgcgatcaccgactcgttccctccgtcgcacggcgtgttccgcccggacctgcagcagttcatggtgcccatcgcgcagttcctcgccaacaccatgtcgccgctgctcgccaacgtgtacccctactttgcctacagggacaacccgcgcgacatcccgctcaactacgccacgttccagccgggcaccacggtgagggacaacgacagcggcctcacctacaccaacctcttcagcgccatggtggacgccgtgtacgccgcgctggagaaggccggcgagcccggcgtccgcgtcgtcgtgtcggagagcgggtggccgtcggcgggagggttcgcggcgaacgtggagaacgcgaggaatcacaaccagggcgtgatcgacaacgtcaagaacgggacgccgaagcggcccgggcagctggagacgtacgtgttcgccatgttcaacgagaaccagaagcccggggatgagaccgagaggcattttgggctcttctaccctgacaagacgccggtctacccgattacgtttcctccgaactagcggctgaccatgccagtgcaaataaggatttccagagacgaataatccatgattaaataatgttggttgaacgttaatgcatgtactctgtatggccctttttttttgtgacaatgctacatgaataaaaaattccaattttattttatttttttaaaaaaattcaggatctttttatcggttgatgacagcagcctgctgtgactatatatcggtaccatcttgtgccaaacagatggcacctataaacagatagacacaaacatttccagcttttcagttcctgaagagaggacacaaatgcagatcatgaacgcagaatactgctccaccagctcggattaattatggccactcaagctactcccgcttgctgctactaattcccttcgttaccgggtggatgatggccgagtacgagatcaccgatccccggtgctaccgccgcacaccgacgacggcgaggaggacgacttctgggtcctctgccctctgccaccaagatcttccagccaaagcagcacggcggcgcaagcccgccgccgcggatggccggccaggctgcgtgatccggacgacggtggaggcgaccagagttcgattcggacgcacgtgagatcacgaggtttgcctcgcttttgtattcgactccggttatacttttgctttggaattgtgttcctttgctttcttcctcctccagcatctgctcatactatacattccgtgtgatggaacactgcgaatcaaatgggacatttgagatgttgttgtactggtagcctgatgaattcattgtctctttctgacaagccgcatatggagtctgttaggtgtttcaagtcgcggtttggtttcctctcactttctctgcttcaatctccagattccagcgggcagcggcctcgcagaaacagatatcaactcgattaatacaaaaatgattcggtcgtagttatttcgcacgcggaggaaatggaatcttttagaagaaaaattgcagaacggagtaatttcactcagatcaattccacgttttcctaatcggtgtcggtgctctactactactaggatgaaaacgggaatacggcaaaggatatttatcaaatacgaaaacggaacgaatacgatttggaacgaatacggtaacggatacttatcggaatataaaaagcccttaaattgaacttttcaaattaagaaagagatgtagctcaatatttttttctaaaataacaaaccgatatttatttttttttaccaataataataataataactagttgtaccctttactttcttggagaaaaagaactatattcatctataactataattataagtagtatgacatggtctaataaaaatttaaaaagtaatcatgcaaacaaatctaaattactggaactaaaaatatttctatttaattaagcacatcaatactagtataaacctaaacattaaagagtagagaagaatgaaactaatcagttgtatatgagaaatactcccttttcgattctaagaaaaaaaaatttgaattcatttcttgaaaatttccgtcggattacggtttccaacgaatagcagccttatcatgtttgtttctgtttccgagaaaaaaattcagaattcggaattcgtttccgtttccaaatgtttcgaaaaaattctgaccgacacttcccgtttccaaaaacacgtccggaattcggaaactttccggactgttttcatccctatctactactgctcgagctcaaccagcatttccagcttgttctaaaacataacacagatagataataatgggcctatagatagcgtgacgaggaggggataacttgcggcccggctaaaagagatggggattaaaccaattgggccgaaagatatgtccaatttggccgacaagctggaatgctgttcgagcttgagctggagcagtaatagagcaccgacagcgattagctatcgcatcaagcagaaacaggatgatctgtaagaaattactccgttctgcattttttttaaaaaaattccattccttccgtgctcgataattactgttttaatcacgtgatttcggattcaccaaccgcgacttgaaactgaaacaccaaaaaaaactccatatgcggcttggcagaaagaggccatgaattcaatcacgctatcagtacaacaacaacatcttaaacgtcccatttgattcgcagtgttcatcacacggaatgtatgggcagatgctagaggaggaataaagcaaaggaacacaattccaaagcaaaagtataaccgaagtcgaatcccaacgcgaggcaaacctcgtgatctccgccgtcggccggatcacgcagcccggacatccgcggcggcggcggcggcgggcttgcgccgccgtgctggcttggctggagagatcttggcggcttggggcctcgagctcttcctgacatggcagagaacccagaagtcgtcctcctcgccgtcgtcggcgcggcggtagcaccgcgggtcggtgatctcgtactcggccatcatccacccggtgctccgctgctgccccatctcgccgcgcacgtagaagcagtagttgatcctgcaccaccgcaccaccacgccgaggtcggtcacggactgcccgttcttggtggagctgtgcatccacgcgccaccgccgccaccgccgccgccgcagcccgccacggtccgccgcaccgagggcttcctccgcgcgcgcgccgagaagaagaacccctcctcccgcctcccgtgccgcgccaggagctcccacggcgccgcgccgcaggggtcggcctccaccacggcgcccgccacgcgcggcgcgaacccgcgcagctgcggacggaggaagtggagcatcagctcgtcctccgtcggctcgaacccgacgccgccgccgccgtactcgtcttctcggatcagattcatctccttccccattccgagtagtagctagtctagtctccgctcgaagtcaacagcgagaagacaagatgtggagatgaacagagacgggtaggggtgtgtgtgttcctcgtgagttctttctccggaccaccagtatttatctcgccatcgaatggagcccatcgtaagtgcgatgagttcttcagtccggaatcttcatattctgtgggctgagcccagccgtgtcggctcaggcctgaccgtgcttgggccgtgccacttcgggcggcccatttgaccatctatacatctccatacttttttaggacattaaaattttcatttttaagtacaattcaaggaatttaacgctttttagataatcaaggataatgttgaggtacctcggaaagaaaacagtgagcgatgtgcaggatcagtgtaaaggacctgctatgcttgaattttgagcttttacgtttggatagatgcgtattgacactaatcagtaatcagagacacaccgtgatactgagaatcaaacacatttctaacaatatgagattatgataaccattattactgatatttccatttaatcaaaatgtgtatgaattaggtataaaagtatacagccatttacacccaaatctaaaactaataccttcatgactccttaattcatatcctccaatatatccatcagagtagatcatcaacccaaccaaggcagtgtgctaccaaacaatccaaactacgatctacaaacacaacacaaatcaagaacacattttgacctgacctgacacgattcacctcaagaacacgcagttcttgtgatctttcgtgtcattttcttgctgctgcttctgctcgttggccttccagccattgggcacccaccaaactcggatgctcttgtcgagccctccactgtacaccatgcagccattgctgaccctgcaccagctcgcctggatgcatttcacggggccctcatggcctctgatcacgcccaccctggcgagggcggcggcggcggcgccgtcgccgtcgccgctcgtctgccagcgccacagcccgatggtcttgtcggcggagcccgtgaagacaaggtcgccggcgacgcacaggcagagcacggccatgtcgtgcgccttcacgtcgcaggagaggctccagcggctgcccctgccgcctaccctgtcccacccgacgacgtgcccgtccgacccggcggcgtacacgcggcgagccccggcgtcggcgctcgccacgagggcgttccacgacacgccgtcccgggagatgaggatgccctggaggaagtgcgccgccttgcctttcccccacgccttgacgtggccgtcggcggaggcggagtagatggtgccgctgtcggcggcgacggcattgatggcgtcgtcgtgggcgtggatcgactcgaggcacttgaggtcggagatgcgccagaccttgagcgtcttgtcccaggagcccgagtagacgacgccgtcgtgcacggcgaggcaggagatgctgtcggcgtgctcgatccagaggcggcggtggttgcggcgtgtctgcacgtagctggcgtggcggaagatcttgcccaggtagtccctggtggtgggcagcgcggcgacgagcttgaacgcgttctccgaccgccgcgacacccgccagacgcggacgcggccgtcctggtgcgcggagaacaccctgccccccgcggcggcgagcgccttgacggacccctccccatgcccgaacctcgcgaagcggcggagatccggctgctgccacgcgacgatgtctgcgccggtggacgcgctgagcaagaactccccgcagagcgagagggacgacaccgagccctggtggtccctcagcacggcgagcgccttgaacgagtccctcgacatcggcaacgcctcgacgacatccgacgggacggccgggtcggagaacgacgacgaggtggaggagaacgaggcgacggacgaaaaggaggagaacgatgcggaggagacgaaggcggaacgcgggagcaacggcgcggacatagcagcgcggtctgttggatcccgcaatggcattgccatggccgcgtgcggggatgctttcttgaggcgagcggacgcggaggtggtggcgagaatagcagaggctgcgaggtgttcgtccgggacagagaggccgaggcgggtggtttgaggcgacgacgacgactcgaccgagctagcgcgnncngnnnnnntnttnnnccccccccccccccccccccccccctctttcgagaaaacgaaaaagttaatggcaggtggggcccatgaggcaggggcggttcaacggctactaggcgcgggctgctttgtcactacggttttacgttttctattcgtcaaaacggaaacagatttcgtttgtttattacggttaggtgagtaggtctgatcgtttcgagcgtttgccttcatttcgcacaagtttgctgatttcagtgtttttcttgctgtaaactacacggtgataattttgaatctgccatcttttctccaattcaatatattaagcggtgaatccatggaaaaatttgcgggactttacattatcaaaacaaaattaacgccgaccaactgattgcacatgctaccatgatggaaaatacgcatcatataatcagaaccatacaagcacaataggcagtaaagcaagaaattagaggtcacatgagcgcactaagcataacactttctgtttcttctccccttattcggacacttgtccatgtttaaacaggcttaatgatgttgatgcagtatccagcaatccagcatcatgaagcactctgaacagtaacaacctgctacaacaatgggattaatgaatcagatgcgcattataaaaaccaagacagaatcagacacgcgaattatcggtgagacgttgacagtctgaaactccgaaagaaaaaaaaaaggctggtgattcgggttgttctagaagcatttgacagggagcccaaaatgtttcagagctcattactgacgaacattttcaactcgtgtgtctgattgcattagaggttgaaccatttttctctcgttttttcttgtatatgatgcacttgaagcacaaggcaagtccatggtttaggtagagcaagctcttgtgtactgccatcgttttagttctctatggctggaggtgccttcaaggctagttcttgtgtactgaacaactactgctgaatatatatacagtctactaatactaacactactattaatccaccgaccaaagtcagcagacagcgttccatagtgctatattcatatactacagagtactccatctgtattttaatgtatgacgtcgttgactttttaataaacgtttgacctttcgtcttattcaaaaaatttatgtaattatcatttattttactgtgacttgatttatcatcaaatgttctttaagcatagcataagtatttttgtatttgcataaaaaattgaataagatgaatggtcaaacgttggttaaaaaatcaacggcgtcatacattaaaatacgaagggagtgttagatttaattgggtaattgatccatttaaatcaattaaaccaaataaattccaaggctcattatgctaggaattcatgtgaattcattcttttatgggatatcaatgggatgaagagttttgagaattaatctatttgattaaggaattggtaacttatatcaattagttctaattgatggatggttgatggttgtgtagtggaggatggttcatggctagttgatgacaattagttgctctattcctcttcctattccatgactcttactcttcatcttccattcctcttataaaatgagaatggatttgatctcccgcgagaagaggaagacacactttcatccattttccaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcattttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattatattcaccactatcactggatcaaattccattgtaaatatcatgtttattatcttgttattttagattaaaatatgccgaattatgaccaaattttcaacagggagtatatgttaagcttctgaagcttctggcttcttctaatacatgcagtggaattagtactggtttattcgtagcttggcttgaagagaagatgcatcatgcatgtaatgtaagatgtgtaagctggcaagtttcttgcaaatctgttcacgtcttagctcagtagttcctttcgttgggacttggttttgaacagaagaaacactcatgccatggtgtaaaatagccaatggtgtttcataaaaagacatgtgcaattacagaagttttatagaaaagtagccaattacttagtgcgttgacagtacggacgggcagtcagagagcacccaatgggggtctgctgctatgaatttctgatactccgacgcacgggatcaatgaagaaaaggagaacgcacaacgccgctgctattgcggtaggtctaattcaaaaagttttcaaacatttttatatgtttccaagcaaaagttgcagtacggtagtagtatttgttcttgaggatatgtggctcacgctcaaagcaactgccgccctttggtcggagagagagcatgcaccttttgatcaaaaaggttggtcatatgttccatgacatgagtatacactaatcaatcttcataggagtaatttatttttgcttccaatgagagactagttgatcttccaatggagtagctacaaatcttatttttcttttttttcttatgttcagctcgagtagttgagaaaaataattcttatagtgctcacctatagagcctgtatcacaacgaggtacagaaaagctctgaaagtctgaattgctatgctttaagcaggcattgcggccataattcttccaaatttcgatgggcctaaccaactacctctatgttctctcgtatagtgtgtgataatgcgtatgactagtgcttgtttattttattttttttcacacgactgaaactctgaaactaaacaggccaagtcgccaagagatggagcagaaccgtaggagtacagagtacagacactaccattaaaaagtcaaaacgggccttggcaacgagatagatgggctcaaagaaattgggccctcttctctagcgtaggcccaccagagaattttcagccgggccggaagcctggaattcccctgaatttgggcccagagttgaaacagacaattcacaggggtcctactgcaaatatgttactacttcgtatcatatcatttgcaagagagaggaaaagaaaaaactcttaaaacaagggaaaggagaaatccaagccaatttgcgacgaaccctaaccgcccaccaaatcctctcctccttccccaacggcgagcgtccccggcgaatccgccttgacggaggcaccccggcgagctcaccttcccggaggaatcccagctcagcctcatcgtcttcggtgaggtacgcatccctttgtcccatcacttttcacccgtcaattgcagtccccgacctggtagaggaggggagcacacagccgacgccatagcagcagcaaatctgacgtgccgtccgcctccgctctgctgcgggcgtcgattctggtgaccgtgccatgtcgcgctcgatgtgctggccttccggacggccggcgccgccatctcatcccgtagattccgaatcagcgagaaacgtgtgttactcgtgtagggaggggaacgtgaggaggacgaacccctacacctacaccttaggagttttgtgcctcctcccgatgtgaggggaataggggatcgtgtttcctgggcggagaaagctcttattgttttctgattatacacaattctgagtagtaacacgtgtctactgtgtctgtgtcccttccgcattttccgcttagtgcttacagcccagttgaacccaaatcagattttgtactgagcaaaatccttgaaccaaacatcccctggaaaaacttgctccttatcttagtgagaaatgaaacatttatcataattacattggattatttttttcttacatgtgcattttctgtatggccacgtgccattgaacatgggaagtagatctatttttctttcaccatttagtttacattgcatagcaggattttatttatgcagacatagtatttatgttgcatcctggatagtaaagtaatactagttctacgagtatgaatatgaatttaattttcttaccaaaccatataaaccatcataccctagtgtgcttacttgacttcatgcgcaagaaacttataagtgtggattctcttcatatatctgtagggaaatatcttggtgattcttgggaaccttcagaaagaccacttaatagttttccttggcccagaaaggcttgaggcttgagagctgaaaagttctgctggagctagtgctataatggccacaaaacttgtggtaagtggacaatctttctctttttaggattctataaacgaatgtgtcctttcatagtttaatcattcatgaagaatgatgacatgagatttatttacttaggttcttggaatcccatgggatgtggacactgaaggattaagagagtacatgggcaagtttggacccctagatgattgcgtcgtcatgaaggtttgtagcaatttcatattcagaataagatattagatgccatattctttgtgtttattacatgccattaagatttgaggagaatatgtttcttgtctttttaaagttatttgggaaaccacagcctcacatgttgtactgttggtaatctattcctttcaataatgagtttgccttggaacagatatggctatgtgcttgtatttcgctttcagtatctgatttctatttagtcttcctttttctggggttgtccgccaaaattgagtcctgaatttctggatgcacatcttaaataacttcttcagtactgtattcatcaatttattagcctgatttggtaatttgtgtactgactgaccactatctttcttgtacgttaaaattataggagcgttcgtctggtcgatctcgtgggtttggttatgtaacgttctcatcagctgatgatgccaaggtagtaatcctgttctcccagatttgctgacttgatattacattgcatgactagtgttgtattttaaatcttttgttagagtttatatatcaactgtgaaatatcaaccttcgaattttttaagaggtgcttagtaaagtggtttactaattaatgtggtataataaagtggtttagtaatatcttgtttactaattaatgtggtataataacatggtttagtaataccctatcttctaacatatttggtactgctgcaatttattcgttctgaatcattctgcaacatttttttcagaatgttcttgagtgtgagcatgttctcggaaaccgaactctagaagtgaagatagccactcctaaggtaaataaaatacaaacatatattatatatgctagcagtatgttgtacagttgattcacatcaagctgtagttgactatggtgtatcttgtcattgaataggaagaaatgaaatcacagggatcaaaaaaggctactagaatatttgttgctcgaattccgcagtccgtggatgagtccatgtttcgtaggtaagctatagcttcagtccttttgttcagcactcagttcacttatcagttgaatatccgagcttgcataaagactctaatcagaacattttattgataggcattttgaagcctatggagaaatcactgatctttacatgccaaaggtgagcaaatttggaattatttttaaattgctaaaaatatttatgtattctctgtgatatcacaattaagtaccaatacaagtagatacactctttctatatagttacctagatttgcttatcactagtttaactagatttccttccgataaggacaaatatctaaactaatcctaatgctaggattgtctggactcctgtggccttcgctaattaggcatgcatcttataagagactggatatagaaggtgctgattgaatttaagttagcacaggcgaagcatttaaaatagcattcttcttgtttgtcacaatcagcattaagctcataagtggattttttttggtacgagtatttgttttggtgctacaattgattattgaaattatatggtaatgaatggagctacaatgctaaatatgataagattttactgaaatgagtcttccaccctcctgttttgtgtgtaggaacatggttcaaagggtcatcgtggaattgggttcatcacttttcagagtgcaggtacgtttgcagaaatcctccatcatttattcaggcgttcattttaatttgttgttggggaagaataattttagcatagatgagtcttcatttatataaaatggcatcttgacctgaaacctttacttcatgtctgtgttctttagggatgattgcttttttccccagtttgatctttaagcttgatatgcattttgtaattaccttattcaatgcaactgtaatgttacagaatctgtggacagtatcatgcaagattcacatgaactggatggcacaacagtagttgttgaccgcgccactcctaaggtacctttgctccaaagcacttgccattggtggctgcatccaatagtatcttatctttgagtaggctctgtagtaggacattctatttactgaagtagttatgtacttgttaccacctgaaatccatctgaaccaggatgaagaagtcagatatcctccaagcaggggggcatctcagggtggctatggtgcatataatgcatacatttcagcagctaccagatatgcagctttgggtgcacctactctgtatgaccatccagggtcagcttatggaagtaagtcttctgctacgaagatcacaggtttgacacaaagcaactttgttaactggttaaatgttttctatttgacttacattgactaggaggaggatactatggatcctcccaaggaatgggcaacaaaaagatatttgttggcaggcttccacaagaggcaaacacggaggacctaaggcattactttggcaaatttggccgaattgtggatgcatatatcccaaaggtaaggttaagactttctcattgtttgtaactgtactatgttaatctcaaccttttctaattgtattgaaggaccctaaaagaagtggacatcgaggttttggttttgtcacctttgctgatgagggtgtggcagatcgggtagctcgcagaagtcatgaaattctaggacatgaggtaaggctgttggtgtctccttgtctctgcttcccatgcctccaaagccaaagtgacaatgtcaaccttagcttttctttggggaaaagaaaaacactaatcataccattccaatgtttcaggttgcaatagacactgctgcaccacttgagggtgactctggtggtggttacatggaacccatggatctttatggggcttatggttcaatgcgaacttatggcaggttctgcagtggtatcgactatgatgtaagtgcacaaatacattattatgcttatgatgcacagtaggcttatatataagttaattggtccgagtacatttgtgataacagagctgtaggcttaatgttggttcgttgtgattgtcaccaattatctgttgaatctcatgcaaatcatctaacaaaaacttgttgatgtcccagtacggttatggtcacagcggaagtagcagtagcagatcaagggctgattggcgataccgaccttactgagcctgctgtcttgttactgttaatgatgttttagtttacctccaagggaactgtggaaacggagaaaagaacaactccataaagaatgccaggttgtactatgttaatcttaagcgggacgggacatacgtggaatctgtatttcagttcatcctgtaaatttttctttgccattagaacgcattaatgcggtttctgtgccaggatgccatgagatcgaggcagcagtgtagttatcattattgtggaagtaccatatgtaataacaatctttcttctacacatgtaaacggtggttctggtttttgagcctctcgtgcctgatcctgctttcttgtctgaatccatctactactgtattggtttacaattgctattgtgagtacagttctctatctttgtgtttcccacttctacttcctctgatggccaccgtcgccgtgttcttcccgctgccggtggcgaaggaagccttctacaacacgccggtcggccggtggccgtacgtcggcttcttgcggttgcgcgtaaggatttgtccatgagccacgtgatatactctctgtgtgtgtgtttgctttcttgggctgtatcgactatcattgtctgacatttctatggcccggtcactgttccatgcagaaaaacttaccagcagactgcggtgaattgcaagaccaatgggatgactgcggtgaattgcaagaccaatgggatggcttcgataaatgtcgatagcaatataaatcataaagtcaaaaatggcaaagtgtttgtgctgcagccgtgcatgatttccactccctcccttgactagttgtacgccaaacagagactttgcttcttctaggaagcttatattctgtactgagcaacgccagtacgccaccgatcatacaagtagtaaatcgcagagatactatatactccgtactactgtagcaactagcaagtagtaagcagagatcgacagcgatgtctcgctccgtcggagtgacaatggacgccgccggcgccgatgcagaccaagcccggctgcaccagctgggctaccggcaggagctcaagcgtggcctctcgtatgtgattcttctttcgttttttatgtttcttttcccatgcatttcatattgcgatcattttaaatttcaccgtagcttgtgagtgtaaacttaccatattgaatcctttgttagcctggtttccaacttcgccttctccttctccatcatctccgtgctgaccggcgtcacgacgacgtacggcacggggctgcgctacggcgggccggtgtccatgacgttgggatggctggtggtggcggcgttcaacggctgcgtcgccctgtccatggccgagatctgctcggcgtacccgacttccggcgggctatactactggagcgccaagcttgccggaaaggaatgggctcccctagcttcctgggtcactggctggtgtgctcttcgctaacatgttaatttatctctcatggtttaatcgttatcatgttttaaattttggaatttaataatatttccttattatgttttacaggttcaatattatgggacaggtatgaatatgtttctcacgggttcacaccaagtctaaatcatatatctctactattttaaaagcgaaattgttctacttacatgctctcatccgaatatgcataacgttttacaggttcaatattgtgggacaagtatgaatatgtttctcactggtccacactaagtctaaatcgtatatctctactattttaaaagcgaaattattctactttcatgctctcatccgaatatgcataacgcgtctgttcacgaaaagtaaccaccatccctccctaattatatggtgctggcccattaacgtataggcggctcatatccctaattatatgggtctaattcattataacatacatgcatataactagtaaaaagaagagttaattttacactctcgaactgttttcagaaagtgcagaaatcttttgagggaaaaaagtgcagaaatctgacactccaattgctcgttaactgatcctccagtgggcttgcacgacgagcgtggatttctcgctggcgcagcttctccaggtgatcatcttgcttgccacgggaggcgccaacggcggcggctacatggcgtccaagtacgtcgtgttggccatctactctgccatcctcatcctgcacggcctcatcaacagccttcccatacgatggctctcctggtttggccaacttggagctttctggaacgttgcaggtgctgttcgtcccggccatttttcagatattcagtgttgaatcccatatatacatcatctcattcttcggtttgtctgtttgaacaaacaattccaggtgccttttcgctgacgatcttgattccagcggttgccaaggagagggtgagccctgagttcatctttacccatttcaacgcagaaaacggcgcgggcatccacgacaaggcatacattctcgcagcggggttgctgatgagccagtactcccttatcggctacgatacatctgcacacatcgtaattctgaactttctgatagctgaacaatccttagtttctcgttgcatacatacaattcatccactaatcttctcctcgcatataaatattcagatagaagagaccaagaacgcggattggagtgggccaattgggatcatcacgtccgttgcactgtcaaccatgttcggatggatctacctgattgccctgacatcgatcatgaccgacataccttacctcctgaaccccagcaacgacgccggcgggtacgccatcgcgcaggccctgtacaccagcttccaccggaggtacggcaccggcgccggagcgctcgcctgcctgggtgtcatcgccgtcgccatcttcctctgcggatccgcgtgcatcaccagcaactcgaggatggggtacgcgttctcgagggacggcgcgatgccgctgtcgcgcgtgtggcaccgcgtggacagccgcgaggtgcccctcaacgtcgtctggctctccgtcgccgtggccttcgtcatggctctcacggtgagttgcacacgcgttgctgctgctgctgctgcaaatttctcgtgcgcgcgtacgtacgtgctggtctcatatagtgtacgtttttttggcacagtcgctggggagtcaggtggctttccaggcgatggtgtcgatcgcgacgctgggtttgttgatcgcgtgcgcgctgccggtgtttttccgcgtgacgacggcgcggagatcgttcgtgcgcgggccgttccacctcggcaagtacggggtcatcgtcggctgggtgggtgtggtgtgggtggccaccgtcacggtgctcttctcgctgccggtggcgtacccggtggccaaggagacgttcaactacacgccggtggccgtcggtggcgtgctgctgctcagcctcgtcgcgtgggtgcttcacgctcgcttctggttccaagggcctgtcaccaacgttgacacgtacaacgtaccctgaatttgtatccctggattagctagcgagcacaggtggatcagtaacttaaattttgtgcaattttctcttgagagggaaaaaagatgtgcatcttgttggttgtaatggggacaaagaccaaaataagcccaacgaagggtgctgcacatgtggctcctccatcgaacccaccaaaaagagcaattttatattctttgagaagatacatgaggtaccactttttttaattgtaaatttggtacattttagtacctaggtactacgaggtactaaattttacactaaaattttagtacctcatgatacctagtcaaatactgtaaaattgctccaccaaaaaaagttggccgtctatttggcccatcaccaaattgggtctctaccaatagtaggcaggatagcagatatggtttttgagaagagtagcttactgtgtcatcgattgtcatcttttatagatgtggtattgatagttaggaaaactagcgagaacatcacgcattgcagcgaaacctatctatgataaaacagaaaacaatggataaaaatatgtatttgatcggttgtatatatatatatatatatatatatatatatatatatatatatatatatatatatatatgtatgtatgtatgtatgtatgtatgtgtgtgtgtacataacttcaactttaggtgtttgctccattagagccaagtcgttagaaagaaaggtagttgccattcgtaagccataacacccatccgttagtaagtaagatagttgacatttatcactcttatgctaataaatttatacccactatgaaaaatataaaaattaaattatagttagtactcaacaattaactgaacaatcatagatgagtgaagaattatcatgatgaaaaaacccgttatgtaaacacttcccgaactgctaaacaatgtatttatgaaaatataaaaaaagttactttcaaaattcatattagtcatttttttttaaatttaagtagttaataatcaattaattatacgctaatggtttagcttgttttgtgtatctttccaatcctctctttttctctcctagaatcaaacacaccccagataacttcttgatcccataaggccataactactatcttcatactaattcaatctaatgataaaatattgttgatgatgtggctctatgtatatgttactttgtaggaattaatattttaataggtataaactatataggaaaaagatagatgcgtgcttgatgaattgaatagacttgtcgccgacataactcggtagttttttttttttgggaaaattcactgcggggcaagttttttgagttacatattaagagagcggaggaagagaagagggtctttcaggctgaaattacaaaacgatcatcaagtttaatttgctcagcctaaagggacgcatcttctatacattgcacatgactcggtagttattggagagatcaacgaaccaagagaacatgggcatcacaggttggcaaaagccagtgcttaatcagacaatcagtggcaattactaaggcatcatgtagtacagtagtagtatagaaattatgttgaacttttctcaatgatcaacaatttgcgcgtgctctaaggtacgtaggaatatgcatatccatgtatatattatatattccaagatagtatggtaaactgattattaaagtatgcgcgtatccacatggattattcctaaccgatcgtatggtcaactgatcattatatagtatgcacgtccacctggactatttccaacggaccatgtattcatatcaactgataattacggccctatgcatatccacatgggtcctgtttggatccggaatcttactatttatgagtattaaacgtagattaatgataaaatccattccataatccctaggctattttgcgagacgaatctaacgaggtatattaatccacgatttgctacagtgatgctacaataatcatccactaatcatagattaatatacctcgttactcgttagattcgtctcgcaaaatagactaggggttatggaatgggttctgtcagtaatatatgtttaatattcctaaatagcaagatttcggagggctatttaatagcccggaggatccaaacaaggccatggattattattgttcccagctgatcgacatatatatcggtttccataatctataaggtagtagtgtttaaattaggtagtgtctgttatgtatattgtctcttaattaacttgaggatgccccacacgttgctgcgggacttggttaatatcaatttgttagataggaggtacaatctcaagaagaaaggaagaaacaaatgactttcttagagaaattctttttagcaaccctgtccaaaatttgtagataatttaagtagcgcattcaaagcataagctacaaagaagcaaaatggtctgacgtaagttaacaaattgtaatgttaactgaatgggcattcggccatgaagctcttttatacggattgatgggtcggatacatgtagatgagtgtggagatgggttaatgtgttcatgtgggctacatttggcactaaggaggcgaagagactcacccggtgcttgatgggttgggctctatgttgcgttccatccaacgtctaagaagcaatctaatgcattcatccaatggttcataattgatgatgacgtggaagcatgaggtttgagcttttggcattaactttatgaaagaagggacgagtagcttaatctataaggatgactcatattccttgtgagcgatattcgcgatatgtctttaaatttggacggtagtgttacttagatccgtgatcttgtaaattacatatttagattcataatcatggtttaatataccagagcagataaaaacgcgtttcaagtgcccacttggttgaccaaggtagttgaaacattacattcaagacctctaaaaaccattgtggaaaaacaattacatatagccactgcaccctatagtacacacctaaaatgtccattcacctcccctcctccctacgcatagtcgatagggacggtggcgattagggcaacactgatgagtgatgattgtcaatgagccgaggcgctttgggcggagcagcaccattgttgacatgaaggcgagcgatggaccttaactttcagggcagcggcacacgatatgcaatccttttgccaaggtggctttcagagatgggcgaatgcaaactttcagctagcatggacaactacgttggcgccaagaccagtcacacatgcttaatttgggtgcaccgtgcacctactctctatgaccatcaagggtactattactatccgagatctatatgacccgatcgtttgtttgtttaatgcagtgcagagaaatgcaaggccaacaagaaatttcttcatgtggatggcatcatcttcattattcttaagagtaaattgtactttgcactatgtaaattgcatcgtgtttcacttgtttttacatggactcaattgctatgtggcaccgctcctgcggtaggaatcactgacatgtaggcccttgagcaagtggcaccatcgacatgtcaaaagtaatattgcagggggttgcttatactttcactttacaccaagttattttaaaataaatttcacttaacatcgggatgcatcatcaagcctataaaatttcataaaatcaaagaaaaacatgttgtgaaatatggtctaaatttaagaagctcagtatgttttactcatattttacaatcctcgtgttcaataataatgtaatatgatgcaaacctagtaaaatgaaaccagctatattactgccgtctcccggttcaaagggcaaagggcaatttactctgttttaatgcacggagaaatgcaagaccaaagaaagggatggctacgataaacgtcgatagcaatcaatcatgcaagtaataaaaaatggcgaagcatgcgaaagcgaagacgccggagtgctgcatccgagcatgatttccagtccctcccttgactcgctgtacaccaaagactttcttcatctaggaagcttatatatattcaattactgagcagcgcaaccgcggagatatcatagagaaaagtagtgagcagacaccgacggcgatgtctcgctccggcgtggtggccatggacgccgccggcgccgatgcagaccaagcccggctgcaccagctgggctacaggcaagagctcaagcgtggcctctcgtatgtgcttcttcttcccttcttttaccacacttcattgcgatcatttttcaccaaattaagcttgtgagtgttaatttggcatatattgcaatcctttgttagccttgtttccaacttcgccttctccttctccatcatctccgtgctgacgggcgtcacgacgacgtacggcacggggctgcgctacggcgggccagtgtccatgacgctgggttggctggtggtgtccgccttcaacggctgcgtcgccctgtccatggccgagatctgctccgcctacccgacctccggtggcctctactactggagcgccaagctggccggcaaggaatgggctcccttggcttcttgggtcactggctggtgtgttcttcgcgtcctagcttaatttatctctcatgctttaatttaatcgttaacatgttttaaatatggaatccgcttaatccttttgtcttctgttttacaggttcaatattgtcggacaggtacgtgcattcaaactccatgagttatgtagaagtttataaaaaaatatagtagtattttcagtacaaaacaaatctattataaaatatattaaatggtacatttagtgagattaatttgatttgtagacgttgctaaaattcttataaatttaaaagtttaacttagaaaatagacaaaacgattaataatatgaaatggaggaagtaattaatgagccatgatttttgaaagtgctttcaaatatgaatataattttattcctttttttttctcaatatacctttggactaattgttgttcaaacttcacgatttcttaaaaataaataaaaaaagtacattttgcactctcgaattgtttccagaaagcgcagaaatctctgacgctccaatcgctcgttaactgctcctccactcatcccagtgggcttgcacgacgagcgtggatttctcgctggcgcagcttctccaggtgatcatcttgcttgccacaggaggcgccaacggcggcggctacatggcgtccaagtacgtcgtgttggccatctactctgtcatcctcatcctgcacggtctcatcaacagccttcccatacactggctctcctggtttggtcaacttggagctttctggaatgttgcaggtacagtcgactcaacgtcccgaccgtttcttcagatattcagtctgaacatttacatcatcagatcatctgatcgtgatttgatctttgttctgtttgtctgtatcaacacacgatccaggtgtgtttgcgctgacgatcttgatcccatcggttgccaaggaaagggcgagcccagagttcatctttacccatttcaacacagaaaacggcatgggcatccaccagaaggcctacattctagctgtggggttgctgatgagccagtactctgtaatcggctacgatacatctgcacacatggtaataaatctgattgttgaatgtcctgaacaatcctactttctcttcgtatgcattcaactgatcgacgaatcactgaatctttttgtctgcacattcagatagaggagacgaagaacgcggattggagtgggccgatggggatcatcacgtccgtaggcctatcaaccatgttcgggtggatctacctgattgccctgacatcgatcatgaccgacataccttacctcctgaaccccagcaacgacgccggcgggtacgccatcgcgcaggccctgtacaccagcttccaccggaggtacggcaccggcgccggagcgctcgcctgcctgggtgtcatcgccgtcgccatcttcctctgcggatccgcgtgcatcaccagcaactcgaggatggggtacgcgttctcgagggacggcgcgatgccgctgtcgcgcgtgtggcaccgcgtggacagccgcgaggtgcccctcaacgtcgtctggctctccgtcgccgtggccttcgtcatggctctcacggtgaattctaagtccattgctgctgctgctgctgtaaatttctcgagctgctctgatttggttgttttctcatggcagtcgctggggagccaggtggcgttccaggcgatggtgtcggtcaccacgctggggctgtacatcgcgtacgcgctgccggtgtttttccgcgtgacgacggctcggaagtcgtttgttccggggcagtttcacctcgggcgatatgggctcatggtcggctggatggccgtggtctgggtggccaccgtcacggtgctcttctcgctgccggtggcgtacccggtggccaaggagacgttcaactacacgccggtggccgtcggtggcgtgctgctgctcagcctcgtcgcgtgggtgttccatgcccgcttctggttccaagggcctgtcaccaacgttgacgcgtaaaacgtaccctgaatttttgtaaatttgaacgcgcgtaccctgatttgataaatttcaatttgaagcgtatttgggtttgaccacgaattggatccgtaccgatccgttaaactcaaaatttgtgttccttttggaccgatataagcccaacgaaaggggctgtgtaggtggctttcctaccaagcccaggtaaaaagtgggcttgcatttggcccgttacggaatatgagcggtcaacatgggccggattggtttaacagcttgactttgggccaccgtgaaatgagtcgctaatcctaggataaagtacactgaaggtccctcaacttgtcgtcgagttacagaaacgtcctctgacaagatatatcacatccctcaacttaacaaaaccgtttacttcggtggttggttttatgtgacgtgacggttgagtcagcagacccacgtgtcagatgccacctcatcacttctctcttatttcgcctcttctttctctcgctgtgctcatctggccaggcggcagggtggccgacgggtggggactggggaggaggcccccgcgggggcggggaggcagaggtccggcggccggcgtccttcttcttcgcttctttccgctaggcggagtcgccagcggcggctttctccaccgcgcgcagccgggagggaggtgagaggaggaggtccggcggccggcgtcgcgccctccgcccgcatcctcgttgccgccgctgtggcggccttcttcttctcctctttccgctgagcagagtcgccggcgacggcttcctccatcgcgcgccgctcgacggggggatgccgatggcggcggggccgcgtctcgccatgtagcagccgtcgatgatcctcgcgccgttgaggagcatggcgaccaggagccggcggcgaacggagtcgaccaggctgcggcggcgaacggaggcaaccaggctgtggcggcaaacggccagccgccgaggtcgcccgctgcagcgctggtgaagttaggatgatgccttccagttttgctctgatatgagggaacaatgatgcctggaaaataccagctactgacaagcacaagggaaagaagaatatgaagcatgtaaaatgaacatatctgcagccaaaccatttcaagttttcaaccaggctattttgttaatgctttgcaccattgctctgcccgtcaggatatccaattatccattattcacaggcccaaaggagtagggtcagtttctaaacctcgcctaaatagagcagagaaaaactacttattgttacaaggcataccttcaaaacaacagctcccccagtggagtgaccaagaagaaaacagaggacccctggattctcaagcacaattttaccaagaagtacatcttgtttgaagataataatatatttcataagtaactgaatgaaggaataattgcaagactgcttgcttatattcagacttactgtatcttctacaacataatctagtgaaggcacatcaccatgtagaccatcgctgccaccatggcctgacattgtatatgagttagagttagcctgttaatgttcaaaataaaagcagaaccaaacagatgttgttgataaaaaaacaatgcaaactgcatggataaaatcaatgaaattgcctactgtattttgttagtaagtgtgcactgcagagtcaatttgtgctatgagtgaacagaatgtggtaacattacaatcatgagctattctgaataaaatttcatgcttttgtccataacaaacggtaatactttgttattttgattgcaagcaggccgccgaggtggcctgctgcagcggcgtctgcacgacctcatcgccacggacgccttccaccgcgaccaccaggcaccagcgccattgctcccgccaccccatgccgctcttcttctaccgtctcgaccactgggcctaccccgaccgcgtcgcgtccacctccgcggcgtcgacatcgccgcccgcgagtcccacccggtcattcgcttcgcccacgccgacgccaacctccgccgtctgccgcacgcccggtcatctgctgcacgcccgcgccccgtctgctccgccggccggccgctccccgcaccgtcgcctggtcctccggcaggcccgtgctgcgggtgcatctgccgcagccgctccgcccgccgcccgcccactccgcccgccgcgcgctgctcctccccccgccgcccgcccgcagctcctcccgtcgcccgccgccgcccgctccgcccgcagctcctcccgtcgcccgccgccgccatcactgcagccgcgtcgcccgcgtcgccatcaaattggagagaagtgagagatgaggaagggagagaagagggggagagagatgacctggcattatgacatgtgggactcacgtgggttccacgctgactcaacagccacgtcagataaaatcggggtcaaaaccaccggaggatctatagtgaacggttattagttgagggacgtccgatatctggttttgtggttgggggacgattttataactcgatgacaagttgagggaccttcggtgtactttttccctaatcctatcatgggattcgcttgagccgtcggatgtaaactgcgtggtccagatcgatgcggatgcacctgtcttacgatgtttgcgacggggacccacgataggaaaaggtacacccaaggtccctcaacttgtcatcgagttacaaaatcatcccccaacggtaaaaccagatatccagtgtccctcaacttataaaatcgtttaatttaagtcattcggtgattttaaccccggttttatccgacgtggcggctaagtcagcgtgagccccacatatcagtatgccatgtcatcccctcctctatctaacttcctcctctctctctctctctcacacacatttctcctctgtgctggctgccgacgggtcggaggaggtcgctgggcgaagacgggcggcggcagggggagaccggtggcacacggccggccgagggtcgcctgccgctgtcatcgccgcggccgttggacgccgacgccgacgtggaagcggtccctgagctcactgtcgtggaccccgacggtggtgaggtgagcaaggatgtgcggggtggtgggggcagccgtgtatgcagaggcaacagagacggcgggcggcggtcgacgtcgaccatctggaggcggaggcgcgccggtgccgctcttggatctcggccactacgcgggagtagatgaggttgggagcggaggaggcccgcgggcaccgagcggtgtgtcgtcggcgcgtcgccgccctcaccgacgacgtggagagcgccattccagagagagacagatgtgggtgatggccaacgacgcggcgctccaaaaagttgctcgtaaggtcgaagcagccggggcggctgccctggatcgaggcgctgcagatccatcgtcggcggaacgaacgagcagcagtagagggagcagtcaatcagtcatcacttccctcccttgagtattaagagtggttctcactcgattcacttgcacactctttcactccactgctccagtccagtgtgttcacatgctctgccccaacgcaattcaagcaagcagatgagatcgatgatgcgtctcatgatttgctgcctcctagtctctgcgggggccgggggaattgcaggcgagggcaacttggacgtggcgctcctcctgcagtgcgtgaagccagcgctgcggagggaaggcgggaacacgcagctggccacctggaccgcctccaccccgctctgcctgtggcgcggcctccgttggtccaccgccgccacgctatctccaccgaatcctaggaggccgctgcacaacccttgtcgccgtccttgctgccgcatcctaggcgcctcggcttgaggatgcccttccccttcatcatgctacagagccggtggccggcagaggagaagagcgacggtggcgctcggtggcgtagacaccagagtccgccgctgccgccgccctccccttctcccacgtcaccggcgacctcctcccgaccctgcgagagcagaaaagtgagggggaggggggggggggggagatactgaattatataccacttttagatgtggaaactaactggatccatatgttatagacatatgtggacccatatgtcattgagatagacgtgacaaatagttaattgacaaatctaaaagtggcaaatagttaaatacccgggggggaggggaggaagggaaaggagaggaaagagatgatgacgtggcaccctgatatgtgggtcctacgctgactcagccgtcacgttggataaaaccagggttaaaaaccactgaagaacccaaaacgaacggttttgtaagttgagagacgttgtatatctggttttgtggtttggggatgtttttgtaacccgatgacaagttgagggaccttgggtgtactttttccccaagatattcttgtggtgtttattgggcctaataggccgaggactcatcaatttcatgggcttttcctcggagtttttcctccgcgcccgccacacaggtgtgaacaaacagatcgatcagagacagcgagggatccggtatacatcgaagagctgaagaccaattaatgcacaagctgaaacaatccaaaaatatcaaagcaatttgcattattgtccggaaatgaaaggcgacggttaaattttgctactatcctacccaatcaaataatatccccatccacatcttgattcttccatcgtagagaagctactgcctaaaccagacactagtaccatgcactgagcctgtaaagtttttgcaaatctactgcaaaggaagcacgatacagatggcgctctctcgctccgtcgaggtggccgtgcccgccgatccggccggcgatggcgatcgagataaaattcggctgcggcagctcggctacaagcaagagctgaagcgcggcctctcgtaaggagcagcttatcttatgaatttaccatgcgaagcctcgcaaactactactgttcattggcatctttggttaattgtttttggccttcgtgagctagtgttctctccaacttcgccttctccttctccatcatctccgtgatggccggtgtgacgacgacgtacagcacggggctccgctacggcgggccggtgtccatgacgctcgggtggctcgtcgtgtccgccttcaacggctgcatggccctgtccatggccgagatctgctccgcctacccgacctccggtggcctctactactggagtgccaagctcgccggcaacgactgggctccctttgcttcttggatcactggctggtgagtacgtgtatgtattgtgaattgtccgtctctcatgaacttctcgttccaagaaatgaggaaagccttgcaaaaatttcatactccagcatcttttaggcttcgtttaaaataggatatttttataggattttcgcggaaattgatcgatcgtatataaaaatcttgtaaaactcgcacattccaaaagagacctttattttctcaaaaagaaaaaaagagagaaagacctttatctcttgttctgtttttcattccttgtgttctgctttgcaggtttaacatcacgggacaggtaggtacattcggatttctgggcccgggcttctcgctaattgatgggcctttttattgggccatgagtacagaaaggaataagttcactttgggtccctttatttgttgcccagtccgattttcgtcccttaatcacaaaaccgggtacgacggatcccctaacttacgaaaccgtttaaattccctcggcagtatttgactctggttttggctgaggtggcaccgacgtggcttcttttgactagatttttgtccaacgtgttattgacgtggcgctgatggggcaattagatcccaaaaaaataataaaacttatggggcccacatgtcagttgcacacacaaattaataaaaaaggtgggcccatgtggacccacacgtcatcctcacaacctcttctctctgtcccctctctctccctcttgtctctctcccgctcatgggcggcggagcgacgaggaggccggctggaacggcgcacggcggccgagcgacgaggaggctggctggagcgggcgacggcgtggcggcgctgggggggcgggggtggacggagcgggtgccccggcgcatggcgtagaacacctcctgctcgaacgccgggtcgccgtcgggaggaggcggtggacgagcaccagcatcttgagcgtgacgcccaggcagcgtgacagcgacgcgacgcaggcgcgggagtggagcgtgagcgcaatcacctcccggacgtggtgctcatcggcggggaagccatggacggtgtgggagaggtcacgcttgacctcttgacacatggatactctcgtttaattatctcgttattacaaacatggttaattacaacttccaaataaagatcaaagcagacatattatgttaaacttgtgcctgcaaaagctgttttattcagttaggatagtactttccttttatgcacgttatgtgttttagccttttaggctagctaatattattacttgtagtactagaacacatgcaggaaatcttagccgattgcatgctactgagctactcgatcgctcatggattgactgagacgccagagctacaccttggtgtccgccttgccgctggtcgtcgagtcatcggcgctgccgccgtcggcgaccttgttgttcctcccctcggccatctccacgtcgtcgtcgccggcctgcttgccgcgattgccgcggcggcggcgaggaggaagacgaagatgctggcggcagcagcggcggcgaggaggaagacgaagatgccggcggtggcggcgcgctgggggtggtgtcggtgtgggggatgcgtcgccccgcctcgcctccttccccctgcgcacatgaagaagagaggacgatgaatatgagagagaagggagggggaagaagggaggagtagctgacatgtgggccaccattttaaaattattatttttagctgacatgcgggtcccatgttttttattattttttcgagatataattgccacgtaagcgccacgtcaatgccacgtgggacgaatatctagtcaaacaagccacgtagtcgccacatcagccaaaatcaccttcaaaaccgctgagggacctcgtctacacggtttttgtaagttgggggatgggtcatacccggttttgcggtcaagaacgaaaatcggactgagtgacaaatagagggactcaatgtgaacttattccgtacagaaaagcctaacagtgggctgacgctatatggatctcttgatgacatagtgggccgctaccacgagcgtggacttcgcgttggcgcagttggtccaggtgatcgtcttgctcagcaccggtggagccaacggcggtggctacatggcctccaactacgtcgtgctcgccatctacggcgccatgctcgtcatccacggcgctatcaacagcctcccgatccagtgcctctcttggttcggccagcttggagctttttggaatgcggcaggtaatgaaattatttttttttcctcctcttgcaatcgatctccttattaagtcaccatcgattccatcatcactctattgttcttcgtttgctaggtgtctttgtgctggtggccttgatcccggctgtcgccacggaaagggcgagcgttgagttcattttcactcacttcaacacagaaaacggcatggggatacgcgacaaggcttacattttactcatcgggttgttgatgagccagtacgcgatggccggctacgacacatctgctcatatggtacgttgcgatttcgcccctagacacagtagtccatatctaaactgcaaatactactgacactctgacagtatatcattctatgcatcagacagaggaaacgaagaatgcagattggagtggcccgatcgggatcgtaacctcggttgctctctcgaccgtgttcgggtggatctacatagtgtcactcacgtcggcggtgacggacattccctacctgttgagccccgacaacgacgccggcggcaacgcggttgctcaagctttctacaccactttccaccggagatacggcagcggcctgggagggatcctctgcttgggagtcgtcgctgtcgccgtcttcctctgcggcctcgcctgcatcactagcaactcgaggtcagatcgatcgatcagctgacgtgttcaggaatttagcttagcttaattagctacgtacatgttgataatttcctaggttaattagccactgcatgcaggatggcgtatgcgttctccagggacggagcaatgccgttctcgaaagtctggcaccgagtgaacaagcaagaggtgcctataaacgccgtatggctctctgtggtggtggcgttcatcatggctctgacagtgagttaattcgtaccactgctgattaattttcatgcttgattctcagttcagaataaccagaattatgctttatttttatgacagtcgctgggaagccaggtggcattccaagcaatggtgtccatcgcgacgatagggctctgcatctcctacgcgctgccgatcttcttccgggtgacgacggcgaggggatccttcgttccggggccgtttcaccttggcaagtacgggatcgtcgtcggctgggccgccgtgctctgggtggccgccgtcaccgtgctcttctcgctgccggtggcgtacccggtggcggaggagacgttcaactacacgccggtggccgtcggcggcgtgctgctgctcaccgtcggcgcgtgggctctccgtgcccgcttctggttccaagggcccattactaacactaatgacggcccgctgtgacggcccataactgtatgggccgatgcatgtgtgctacggcccatggagttctacggctgacaaggaagcccacgtacatgtagccttgttgggcggcccagtaagaggccgttctttattttgattcgtattcccatgtccttggatggaaattcaacggtctacgattcggctgattatgttagaaaaagacaggcatgaggtacagaactatactaaaaaagcagcatgcgtgcaataattcaagcatagtttaaacatgaaccaaaagtcctaaggtatacagttttttttttggaacgcataaggtatacagcgatatattgcatcttatccttcagttagtcaacggtagttggcaatactacaggaaaatcgtgacataagcgtatcaatcaatcatcagtggtatacaaaatttccaaccatttcgttgattatgaattatatataagagagaggtacgtacttggacatttcttttttgggaagttgactagtacagcgagcatgtaaactatactctgcaggattagtgagctatggaggtgatagcgtcaaaaatagctagcctcccaggaaacagcctacaggagatagagaactgatccacggccatgtctcgctccgtccaattagcgatggccgccggcgatcaggccgccgacgacccggacagcctccggcttctccagctcggctacaagcaggagctcaagcgtggcctctcgtatgcacacaacaagtttcagtttattcagacttagcatgcattcaccgtgctaattagttcattcttttcaaaactaagaccatcttgatcgattcatctggatatatatacacacaggaccctgtcgaatttcgccttctcgttcgccaacatctcggtgctgacgggcgtcacggcgacctacaacacggggctgcgctacggcgggccggtgtcgatgacgctggggtggctggtggtggcgctgttcaacggctgcgtcgccctgtccatggccgagatttgctcggcgtacccgacctccggtggcctctactactggagcgccaagctggccggcaaggaatgggcgtccctggcttcttgggtcactggctggtacgtgagacatgtatgagctagtctgcatcaatttcccctgtctttatgcactggaactaatccaaaatggttaggtgcaattgttttcttgatatccttgaaaaaaaattgttgtcttgagatggtgccttcttgaagattatgtttgatcattactattttgaatatttgttgctgtggattatgcatgtatgctgttgttcaacttaatttgcgagcctgaatttgttattgtgttgtgtgttcgacaggttcaatatcgttggacaggtatactaccattgtctggtggatctagatactgtttttagctccagcttataacttcatttttcgagaaaaaaatttgcattgttgccctgtccttgtcttcaactgttgtggcagtgggcagctattgcgagcgtagacttctcgctggcgcagctgctacaggtgatcatcttgcttagcacgggaggagccaatggcggcggctacatggcttcaaagtatgtcgtgttggtgatttgcgccgtcatcctaatccttcatggcgtcatcaacagcctccctatccagtggctatctctgtttggccaaatcggggccatctggaatgctgcaggtgcatggtacacatggaggcaataatcaccagtccttatgaattgtggttcttggcatctgaagtctgaatattgaaccctgaacgaaatttatctgtctgaacaatcaacaatgataggtgtctttgttctggtgatcctgatcccggcagtagcaaaggacaggccaagtgttgagttcgtgtttacccatctcaacacggacaacggcatggggatccatagcaaggcttacatcctagccgtgggattgctgatgagccagtactccgtgctcggctacgatacatccgctcacatggtaaacgagtcctctactcctgtcaggctgcagatatctgaatgagcataactgaatatggatagaacacagtgtcacagtgacgagctgatgatgcgtgtatgcaggttgaggagacaaagaatgcagatcggagcgggccaattgggatcatcacgtcggttgtttgcgcgacggtgttcgggtggatctacctgttggctctgacgactgccgtgacggacatcccgtacctgctcagccccggcaacgacgccggcggctacgccatcgcgcaagctctgtacaccgccttccaccggaggttcggcagcggcgctggcgggatcgcctgcctgggagctgtcgccgtcgccatcttcctctgcggcatcgcgtgcgtcaccagcaactcaaggtgacgggctcacatcgcgtcgatcgatctgatgattccacagctagctgttcatcgaatcatcgtgtcgagttggtgatttacatgtcgggtttctgtaggatggcgtatgctttctccagggatggcgcgatgccgttgtcgcgcgtgtggtacagggtgaacaagcacgaggtgcctctcaacgtcgtctggctcgccgtcgccgtggccttcttcatggctctcacggtgaattattatattccgagttgcacgcgttgctgcttctgttcctcctgcgtgcgctgctctgacacggtgcgctaattttgttgtttttttggcagtcgctggggagccaggtggcgttccaggcgttgggctcgatcgcgacgctggggatgtacatcgcgtacgcgctgcctgtgtttttccgcgtgacgacggcgcggagatcgttcgtgccagggccgttcaacctcggaaagtacggggttctcgtcggctgggtgggtgtggtgtgggtggccaccgtcacggtgctcttctcgctgccggtggcgtacccggtcgccaataaggagacgttcaactacactccggtggccgtcggcggcgtgttgctgctcagcgtcggcgcgtgggtgctccatgctcggttctggttccaagggcccattaccaacactagtgacggcccgatttgacggcctagaaaagtatgggcccgctgatgtgtagccttgcttggaggcccataagtgggcccaataagaggtcgttctttagggcttagtatttgttagagtctcaactcttaaatttaccattctgggtctaaagtatatctctaattcattttgtgagaatgttccaccagcttcactcacattttagatgaaattaaaacgttttggctgactctagctcttgccaaacataaccttcattggattcacatttttattggatgcaaatttgaaaacttcaacggtctaagatccggctgattttattagaaaaggacaggcgtggggacaaaaactgtactgaaaaaaaagcatgcatgcacccattcaagcatagtttaacatgaaccgtgattagaagtagtactaacgtgacgtatatatatcctatattttctgagtcaacattggcgtgtaatacgaaaggaaatcgtgacatgggcagatcagtgaatcagtggtacaaaatttccaaccattttgttgactcgcgaatcatacatgacagatacttggactattctctttcggaaacttgactagttacactgagctgtctgagcatgtaaactgcagcatagcgcgactagtgagcaacagaggtgaaagcttcttcccaaggtagaggatctagagatccaggccatgtctcgctccgtccaattggcggtggccgccggcgatcaagtcgatccggacagtctccggcttcaccagctcggctacaagcaggagctcaagcgtggcctctcgtatagacgcatatgcttgcttgtgtttaatttgttcagactagttcttgattagcaattaagcatgcattttggatcttccagtcacaagactcttttcacaactaatctgcgtacagggcactgtccaactttgccttctccttcgccaacatctccgtgatgatgggggtgacgacgacgtacaacaccgggctgcggtacggcgggccggtgtccatgacgttgggatggttggtggtggcggtgttcaactgctgcgtcgccctgtccatggccgagatctgctcggcgtacccgacttccggcgggctatactactggagcgccaagctggccggcaaacaatgggcttccttggcttcctgggtcactggctggtacgtgctaatgcaaaattgtcagatgcaattcttgccttgagatggtgcctacttgaattctgtcttttttttgtgttcgacaggttcaacgttgtgggacaggtacacttgccattgtcaacttggataatcttggggattgttttttttcagttgcagactataattgcatcgtcgttggccttgtacttgtcttcaattgttgtggcagtgggcagctattgcaagcgtagatttctcgttggcgcagctgctacaagtgatcatcttgcttagcacaggaggaggcaatggcggcggttacatggcttccaagtacaccgtgctggcgatttatgccttcatcctaatcttgcatggcatcatcaacagcctccctatcgagtggctatctctgtttggccatgtcggagccatctggaatgctgcaggtacacaatgaagtgagttctatcggttctaggcatctgaattctgaaccctgaatttatctgtctgaaacaatcaacaggtatctttgtgctgacgatcttgattccagcagtagcaaaggacaggccaaatattgagttcgtgtttacccatctcaacacggaaaacggcatggggatccatgacaaggcttacatcctagccgtgggcttgctgatgagccagtactctgttatcggctacgatacatctgctcacatggtaagttaatcctgctgtccctcaggttgcagatatctgaatgagcattgacagacggtagtgtggcagtgattaactgacgatgcatgcaggttgaggagacaaagaatgcagaccggagcggcccaattgggatcatcacctcggttcttttcgcgacggtgtttggttggatttacctgttggctctgacatctgtcgtgacggacatcccgtacctgctcagccccagcaacgacgccggcggctacgccatcgcgcaggctctgtacaccgccttccaccggagatacggcagcggagttggagggatcgtctgcttgggagccgtcgccgtcgccgtcttcctctgcggcatcgcgtgcgtcaccagcaattcgaggtgcgtgacagagctagcatcacgtcgccctgaatccctgatgatcgattgaattgctcaaagtgctatatacatactcgttgtttgtgcaggatggcgtacgccttctccagagacggggcgatgccgttgtcgcgcgtgtggtaccgggtgaacaagcacgaggtgcccctcaacgtcgtctggctcggcgtcgccgtggcgttcgtcatggctctcacggtgagttgcatttgcattcgcattgctgctccggtgattcacggtgagtgcgcgtgatgacgacgccttctctgccttttgccggtgcagtcgctggggagccaggtggcgttccaggcgatgggttcgatcgcgacgctggggatgtacatcgcgtacgcgctgcccgtgttcttccgcgtgacgacggctcggagatcgttcgtgccagggccgttccacctcgggcgatacggggtcgtcgtcggctgggcgggtgtggtgtgggtggccaccgtcacggtgctcttctcgctgccggtggcgtacccggtggccaacaaggagacattcaactacactccggtggccgtcggcggcgtgttattgctcagtgttggtgcgtgggtgctacgtgcccgcttctggttccaagggcccatcacgaatgttgacacgcattgttgacaagtatggtatcgtgttgttagtcagcgagtcagtggaaatatggaaccacacttttatattgtgtaatctatacgtgcaattgtagtcgttcagcagttatccaccattccggttttctttttttatcctttttattttgaaaaaaatgttttttttaaaaaaaacttttttgaacggttgaagagcgcagcaacgtgcgatgcgaggggcctgtctagggaaatttcagtagctgtagcttctgctataatcttcagctgccagaaactccatcaaacaatttagattttcacatatattttgaaaagttgtagttgtagaatctagaaaataaactcgaaatcagaaactgggtttgccagcttctctagattatcactaactgcttataagaagcttaggactctatcgtttctcttattgacggaataagcgaaatgacatatttgcaaacagaaaataatttgtaaataaaacttttatataagtgttcttagcaatataaacaaagtctgaaaaataaactttgatgaaaaaccccaaaatctatctattatattattaagatagctcgaaaagaaggcactacgttcgctgtggaggctagaaattcccatattaatcgaagaaaaagaaaaggagagtccaagtaaaaatacaatctaaaaaataactgaaattcggaattaaaaataagcaatattaaaagaggtgtccatataagaacccaatacgagattaataaaaccattgattacaattctaaattttaacggtctagatttgtaggagaaaagataagtccatagatctgtattgtgtacgttacatactaggagtctttgtcctttctgtttctttagcggtgtacacagtacacgtataatctaattcaattacaaacctacacgggcaagatttgtgctgccaaatatacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57416 - DNA, 2032 bp, Oryza sativa
agcatattcgtgtacagcttgtaatgtacagtcaatagtggcaccttttatagcatgtgtacatgccaacctacaaacagaaagatgaaaaggaacattcagcaacgcgcaaaaaaagatccattttttattcatacagtttgaaaacttttgaatttttacctagcataagaatctttttatatgggtcaagctttaaaccaccagtgttatagtactacctatagctaagatataggtatacttcaatagtcctaattaaacttaattcggtaaaaatctacatagaaaaggttgtgtgctaccatctacggaatgtggaaaatcatttagatttcgatacaatggagttctcaagctgctaaataaatgaataaatttgttcaacatatttttcctaaaaaaatgatgcatagagatgaagtgctgattaaattaccaaaaagttggattgtggtcatcactttaaatccaaaattcataatgacttgcttaaatatagttaaaaatcgaatgtcagtatataattaattgattttgttggaagcctttcatgttcctaggaataacgttaaacattatttagtagagtgtgaaaatcatcatttcagctctaatctgattcttgggagtagcatgtgcgtgagtccaaatttcttagtggcaagcacatggcatgttcatttgtatacatatccgcaccagaaaatacatataattgcccacaaattcaaactgtatgtaccatcgctagctgatgagctcacctcgttaacatgtcaatctgcatatcaggcaaataatctacgtcgttataagaaacaagaataaatttatattataagtgacagtaatgagtgcagcttggaaggaggacaggcaggccatagagctggacgcatacttcatcaaacatgtattaattgggcgtttagattttgtttaaagtccaaagctgaattcaccacgcacagcaaaatataaagatcccaaatgttagttctgttgagggtgttcaattcttcggttccacattgcagaagcttagagataataaaagtgaagattcaatcttagacatgatcaaccaaggataacacaatgaatatcaataaaaaatgtattattgtacaaatatgcatgtacaggctccggcctagagatgacaaccagggtttcatttaccgccggggccgcggttatcgcgccccggcggtaagcacggttaccgcacggtaaccgcggtaaccgtgacaaaccgcgacaaaccgtacaaaatttatcaaaaattcaaattatttttcaaatttatttgaatttgacgcggttaccgcggtttaccccttaccgtacccccgcggtaagcgcggtaaccgcggtaaccgcgcggtttaccgcggtaaatgcaaccctgatgacaacacacctgcttatgatccattcatgcagcaatatgcagtgatagaaaaatgtaattttcgaccatgaacatatatatttattactaaataactcttctctctgctacatgatgcctcatactgagcctagtgttggaatgtgcacacatatgggcattacttcgaacaagaggaggacatacggagaggcgagattgaattctcattcagtctgctccacctacttgcagttcctcttaattgtttgtggttctaggaaaattagggaaaagggggcaagaagaacatgagacacatggacaaaatataaatcaagcagcattttcttttttttttaaaaaaaagaaaagagagaagaaaagggagaaccttttacagggacaagagcaagaagccgacgtttgaggcaatggatggggtcaatctgttggcaccggattagtgagttgcatactcgcattaacgttcaaccgtagttgttgtacgatacgatgggccttcatccctgcagttgacacccttgtctctgactgccggcgccggcacgacgtacggcatgaatggtccatctggcttatgcttacctttccaaaagagaaaaaaaaaacaaa

SEQ ID NO: 57417 - DNA, 5603 bp, Oryza sativa
atttaaaaaataatttgaatttttgataaattttgtacggtttgtcgcggtttgtcacggttaccgcggttactgtgcggtaaccgtgcttaccgccggggcgcggtaaccgcggccccggcggtaaatgaaaccctggttgctagctagcctgttacattgctcctcgttgcaaattgcaaacaggcgatggctgatctgatgcgtatgatggcaacgggatcatatcactgtagatgatccgaaaaccaatagtttctctttgtggattttgttggcaactttttgtgacaagtcgacaagcacgatcgcaacacctaaacgccttgcggtgatatggagtcgccaaccacctcgatctagccaaagggccaaatcaagatgggttttgtagaaaagcaactaaaccggctagcagagccgatttagagatcaaaatcagcctctaggccgatttagatcgatatgaggataactacccgtctcgtgggcaaaatggaaggttttcaggacaaacctaaaaagaggtgtcgcactctcgcagcggcggcggacggtttacggcgcaaaccgacaaagatagactaaactagagtaaaatagaaaaacatagtaaaagaacgattcaagtagattgtatttggggggttttacaatgaaccggccttgtcgcttaaataggggttggtcttgccctctacaggcccttctccatgtccaactcgggatagaaaccaaaggaaacacgaaacatgccttcccgagcaaggaaacccgagacccgacgaaaacagactcggactcggaccctgccggtctgaccgcccacatacctgcggtcagaccggccctactagccggtcagaccgcccacacacctgtggtctgaccggccctgtgaaggaaacccgtcactttccaaactttggcaattttcccctatttcgtctataggtgtcaaatttgggtgtaaacagatttcagattcactagcatcaacttttgccctaatttcctcgctccttttgacttgaactgtcttcttaatttatcggagacgttcggttctcagctggatgagagtgaaactgatcaaattacatttgttctctgcacttctgctaggctgcttagctaccactagccttttactacccagctgcagataaactaaaacatgtatatatgaacatgaattccctaaccatataaactaaaacgcctccgatgatcgaaccatatcttggtccatcgatttaagtggaaaccaatgatcagttgttttattttatttattatatttatagaacaattactccctcggttctataatataatgtacaaccactttctttatatgttccataatataaggcatgcattcaattaattatgacatcttcttcattaaattattaattttttaaacaattcactctcacattctctaattctattggatgcatgcattatatttattaggatgatccaaactacaagatgataataactatttctttatctttgggttaatgttggttgtgccttatattttggaacggagggagtaatttattagagtcacgtgacaacttaggtgtattttgtcggaacactactactaatagtctcagtttacttgtagtcaactactgttggttgtagcttggtggcatactctacctacctatcagttgttgatgttactcgcggagtatcgttctttatctttggtgctagatgacatgcatgcatgctcattggatatcagctgattcttatattaggtacattgtgcatgaaatgtcttgtaagcaatatgacttattagcgatcggtggatagtggtttgtatgtagaactcgtatacgtggggattagtgaggacatacgattccacatgtggaggggagtatcgtggtgggtatacctgattttttttctttgagatggagatctaatgggtaaaattagtaggtccaccgatttttttttcctaatttattagaacaccatgtggcggtttacgagcgtttgtaggagaccacatggcggcttgggagtttttgtaggaagttaatttaatgaacttttagtatatgatagatagatatagatgtacgtttacaccaggtcacattttctctgctgtttcctaattggttttactttcatgcctagttaattaattatattagctatagggttaaaccaatctgcatgagcacacagacagtaaagtggaggaggggattagctaacagttgcttgcacaagcaggtggacagaaagacatgcattcgctttaatcacactgctctgaatgtgacatttctgtcatgccgctcatgcatgattagtggccggagtaggagtacacgttactagtggaaggagaaaatcttgttgtcggaggctgccgcgaacgggtcatgtgcacacttaattaccgtgtagtcacgtccaaattccaaaaacatagtaagacgttgaagaggatattgagcaaaattcgcatacattatattaattattatactcacgtcacatgggctggagcctatttatacggaggaggagcaaaggatcggatgaaatcgaccaagatgacgaagatagcaggtgttcttattttagttcttgttatctgtccaactattacttccgctaccgaaacccggggaggtaaatccatccatccatctcatgttttctcacaatctagctgagcttgattctctcttcctaattagtagtaattacttgtgcatgtttgtattgtgttagcgcttctattcctaattaattacttgtgcatgcatgcgctaattaattctgtttgtattgtgttaacaggccgggatgacgaccttagtgacgacaaaatctggacatctctgattgcattccactatcctggattggtggttccgccaatctgcatcgaggacattgcaaagaaatgcgggtggaataatctgacccctgcatgcgtgatggaagagatggacagctgccactaaggcgaccaccggccactctccatcagtctcaggctgacaggctctcagccataataattaataagctgtaataaggggcctaattaatatgtactacttcatgcctctgattttgattgcaagcaccactagccatgcatgcatgtcgtatattctaatagaattaattaatggtaataatataaagctagctagatgtgcctgtgggtttgatttttaatcactaggagtaatgatagaaaaaataattaagaattacttcaattttttaaataactagcaaaaatgcccgtgcgttgcaacgggtaaaaagaatccaatgacaatatacacttttcatgcataaccatattaatgataatgtttatatggatcgttgtagttaccacaattagaaaattggatttttccgccccttgtaccatataatggttttttattatatacggacgacggaaacttttttaactttttaagtttttaagtaaagttagggattagagactagatctgttcccttttgtgattaggaatttagattgtttatttacttttttagaaataaaaagaaaaaaaagagatcgggagatggggaggagatttttttccacctccgattcgcttttgtttttctgttgccgcgtttttcttttcaggatcgctcttttttttaagttagacggacgacaaaaacatcataaattttttaagtagtaacagaaacgaacggtcaaatatatttaaataaatcaacggcgtcaaatatttacctcgccaactgccccgaggcttcctccattgtcacggttcaaatcaatagcagccacaaccttccaatttagcgaatgacgagtgaaacgacggccaacaggcaatgtaacagagcggccaccggtcgactccaccacaccagcacacgctctcgtgaaaccctaggctcctctcccgcaggccgcagccatgtcacagcactctgttgtctccatgctcatggccacgagtggccttccctgagacatgccttcacacgacggtggaagagatgacctggccactacttaggggaggatgtgaggcgcatcatggtccggtgttattgctcggtgcgtggggatagcgcggcgcacatccgctcggctggatggggaatcggtgatttcactgtcgcattgttatcacaaagatatctacatccgtttctagccgttggatgaatagatcgaatggctgataaaagagataggaagttttgtgtaggttctcctaggtgcatctagcaaagagaataactcctcctttttatatatattagtaaagatgagtatgtaggtttattagactaacatcataccacttaatatcactgctagacaaatgatctttagtcccgagttgcaaaccgacaccacaaatctaggatatctttagtctccgttggtgttactaaccgagactaaatattatttttttttccttttttcattgttttttttgctgcttgcatattgatcacagatccagaaatcatcacaaaaacagatccacaaaaatcatcgctaatccacaaatcatcagtgatccagatccccaaaaatcatcacaaattatactaccatcacaaatcaaaacagatccgcggacttcgagcactacgactcccacctcagcctcctcctccaccacaacaactgctgccacacccaattccacccgtcaccacacctcggcagctggatcgtcgccgtcggcgctcctctcccgcgaggcagaggcggatcccagcgacgactgtccgcgcgcctaggtcgtcacgcaccgcgacggcgagtgccgccgcctaccccttgtgccaccaccaccccgctcttgccaccgccgctgcagcctcccccctcgtgccatcgtcaccgcctccccccttgtgctgccgccgccgcctccccctccgccggatccagtggaggggagggctctgccaacgcctatcggtcccggctacgatcggagaggaggtgtaggagatcggagagaggaggaaaaggagagatagaaagagagaaagagaaagggttagtggatgagggggagaaagaaataaggacgacgacgcgcgctctccccccccccccccccatgtggctcgtctgtttttttaatttttcgttccggttggtttagacaaccgggactaaagatagtgggaggcctaacaatttttgaaccaggacataaaaaatgatctctagttctggttgatgttaccaactggaactaaagaatcaaaaaattctattggtcttttgaaccgggactaaacacattcttatgtctctgttcctattcgaatcgagactaatgcgatttttatcatccggacaaatatcaattctccggtagtgtatattgatgtattaaaatggaaggggttggatattggctaccagaaattatttttctagcaaggagaaaaagagctgcgatatctaatccattttttcgaccagtaaagcatctagaaaccctgcttcactataccgaacaattcttatcaatgggaaagtctgtaatagttatccaaga

SEQ ID NO: 57418 - DNA, 3807 bp, Oryza sativa
tattggtaattgtcggtattggaaatataaacggtaatctcttccggaaatggtagcggaaatgagatgggttttttccgaccgttttgttggtaaccttttttgatcggtaatttccgtcaaatttccgacaaaattccgaagaaggaacttgggcggctgagcctggctaccaggagcagcccattaggccggaagaaaaaccctagggaatgggcgtcaaccagcgtgtcgcttctcatcctctccctgtctcgtgactctcgtatagctctccgccgcctctacctccgccgaccgccgaccgcccatcgtcgcaaccacttgtcctcgccgccacgccgccgcttgctagtcctagccgtcgcatcctcgcgcctcactgtgtcccttgccggagaagcatgatggcacctgccgaacaaaaatgccgcacccatctgctgtcgtctatcatatccatggcatgtggccgttattaaactatagtctcgtcaacttatcgatattgaagtatcgttgaactttgtttatattgtttgttgaccttattgtcaactcattaatcatcatataacagtgttatgtggcagcgtgatgatgcaagggtgaaattataaggtcatcttcatgcatagttaaatgtgggatgatgtcacagttcgctgtttacgacatgacttttcgacttccgactgatatcggtagattcccgttccggcggttctgtttccaatttacaatattgtgcaatgtcaatctggaatggatatcaaactgtcccaatttcaagaattacatagtagttttagacggtgcataatcacatcacacatatttttagagaaggtaaatctggacagtacatattatcaaaaaaattcgaacgattgttacaacaatctctaactcattcgcagtagtcggcaatgaaaataaacgacaaaccaaggttacaaatcagagcacggagacaagcaatttcttaccccacgactaactcatgccagttacaatctatcgattccaccttgttcctatctcatatcggggacgacggcatccggaggctgccctcggcgtcagcgagaaggggtgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacagtagcccctgagaccttcgcagtcgaaaagataatcttctctcgaaccatattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaaggaatttccaaagtattgggcatacgccatgcgcacactgctttaacagatgtgcttaagtccctagaagacacatggtttcaccacacctagaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactatttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcagcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctaaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcg

SEQ ID NO: 57419 - DNA, 709 bp, Oryza sativa
ataagtcttgcagcttagctaatggaaatagtaaaaaaaatcttcaatatatcacctcccaaccttgtccatgatttttatatcattgctaagttttgatggaatttgttcgtttgaaagcttgaagatagtggtgtttatgcttgcaattaaccttacctgatttcttttctgtgattttcgtgttaagaatccggctattagcattattgtttcagttgtaaaagaatatgttgattgttaggacaggctttcgaccaattaggctcctcatcttggcaatattgtaaggcaccgtgtctctccctattcaacatatagagaacagccatttatttttcttttagtagcaagagaaattacattggccagaatggccagttgtgaactgaattatcctgaacctgtgctgtgtgatttgatggtatatgcaggatgttttatttgtgggcattaccgtcttccctctttcatggacggtatgatgaggaactcccattgtgcaagctcttcagcatgcctaattgggtacgcatgtatgcaaaccactttcccaattaattaacactactgtttttacttccctataggtcaattgattggtgaagcattttatcccttttcgaacagaaccaatgaagcaacaacaagacagtgtggtcctattttgttttttgcaaatccaagccattagtacgacttactatat

SEQ ID NO: 57420 - DNA, 939 bp, Oryza sativa
cggctaagatgcccgtgccgatgtacattcctccagtggtctctgtagatgagctgttcacgtcgcctgcagggatgtcatcctcaagtgcgacgcagtcatcaacaacaacggtgagtggctacgcaacccacatctcgacttcttctgacacatccacttcagctggttcgaaggactcgtcttcgttgctcaaacatcagttctagtaatgttcagttcatttgagttgttcttgattttacagtagttgatgcttggatgggatgttcagctcgtcagcgcccgttgatttgatctttagacttttgcttaattgccggtgtgagtaatctggtatttacgccatgctttgaacttttacagtcattttaagtttgtctacaaatatgtatgtataaatgtataatgccacatttctattcattcagattgccgatatacctaacagctcgttctttcgatcgtccgcttgctagaagccagttaatgttctgggcctcaggcccattagtagagtaggcctccatcctccttattgccttcaccatcaggcccatagtacaaagttaggctgggccatagcctgcaggcaaagttgctttaatcaattcctagtgattttgctatatactgtatttattagcaaattttctcccaaaatattgacatgtaaatataatataattatagtgtaactacatcgttagatttgcttcaagattcgtactaacgagagaaaaaaatcacaccgcatacacatctggggattcggtcacatgacctccattttatagaaatagcatattactaagagatttttaaaagttacatacaagttaaattttagttttatgtaaattaaaatgtattgtactatttattttatctaccaaaatttttgaagaaaatttataaacgaatatataggtagtacca

SEQ ID NO: 57421 - DNA, 716 bp, Oryza sativa
ctcctgtcgttggggccagcgcttctggcggagccatgggccatggcagcctagctgcctccttgagctcacgctcagatggagcactgctgaatctcactcttctctgctgtggccaggacggtcagggcgcggaggcggccatggcggcgcgcggccatggcggcgcgcggccagggcggcgcgggtggcagcggtcgggtcgaagcaggcggtgcggcgtgagcgcgacgacgtgggtggccgatgcggcggctgttcgggcggtgcggccctacggccgtgcagcgccgtgcgggacgcggctgacggctattgtgcggcgacacacggcacatcgccgtacggggcgacagccgtgcgggggcgcatggggcgcatggggcgcccggggtgaggccgtgtggaggcggcacgagtgtggcatcctcggcgtgggcgcaagcgcgcagcggtggtgctgctcgggtgcggctgccgtgctcacagaagaggatgcttgtttacctccgttggatggcgatcgaacagtgtagcggcatcggacgtccctctgacgtagattagattgctctacgtcagaggatcatgttcccagccttactctgcacccaaaggatgtacatagccttagtggttgttggttacagtagtattgctttccttttgtcttgtctaatgttgaaatcgccttctttgacctgagataattgatt

SEQ ID NO: 57422 - DNA, 1150 bp, Oryza sativa
caccctgaccttgccgttcttcttgataataggaactatactagaaacccactcagcatatcggcaagaacaaataaaaccagcatcatataatcgtttaatttcagtcttgacaggttcaagcatatcggctttacatctcctcggaggttgctggtgtggcctaacccctggtttgataggtagccgatgttcaacaatcgatcggctgagtccaggcatctcataatactcctaagcgaagcaatatctgaattctttcaacagctctatcaacttggttctaaattctgcagataaattcttactaataaatgtcggccttggtcgatcacctagacctatatcaatttcttccaaatcatcggccgacgtaaaaccctgtccttgcttgtcattgagatcatctattgtgtccttgttgtagacatctgaaccctccaagacgccctcaaaataatagcttgggttctctatcttcaattggctatatatcagaatcggacacttttagaaaatctccatctcaaactattccagataaataatcaagaccatccatctcccaaagagctaaatcggcactggcaacattgactgacctgtcagctggcacgatttcaatcttgtcgccttgccactgaatcaagcattgatgcatggttgaaggaatacaacaattagcatgaatccaatcccttccaagcaacaattatgccgcgcagaaggggcgtgcgaggagcgacgccacgtcggattttgctatagtgctcgggtgtgtttttgaaaaaaagccctccggttttctttaattacgtataggcccctcacaaacagtgtttgtataggaaaaatcgtggacatgaatgtaaaaagtgaaaagaataggggctttttcgcaaaaaaacgcccacactacgtaaaagcatctccagcagtcttgctatctcactctccgagcaaaaatttagcaagtttggttcaaaattagacagactccaacagacttgctatttggatggccaagctatcagctggccaaaccggctccctgcctagccaaatttggccagtcaaaaccagcttgccatccgtgggacccacgcgtgcttccccctctctctctccgcacactctaaggcgcgcagca

SEQ ID NO: 57423 - DNA, 734 bp, Oryza sativa
ccggcgaggaggacgcgcagggctgggagctggagcactcgccggcggtgaagaaaccctaggagctggagcactcgccggcggcgaagaaaaccctaggcgctggagcacggcggcggcgaacagaagcagcgggaaagggttcgatggtcgagaagaaactaatctcgagctgctcacggtcacgggagggtagaagcggaagagatattggatatttggatccttgacacacgctagattggacggtgcagatggcatcgatcaactgttgagagaacagtagaacagtaatacagtacctgggggcaaaagttgtaggcaaaagcaataggttttatatgatttcatcagtttcactctcatccagctgagaaccaaacgtctccgataaattaaggagacagttcaagtcaaaaggagggaggaaattagggcaaaagttgatgctagtgaatctgaaatccacaaagagaaacgattggtttttggatcatctacagtgatctaatcccgttgccatcagatgcatcagatcagccatcgcctgtttgcaatttgcaacgaggagcaatgtagcaggctagcaactaaagcttgaagcctgaagcatgaagctagcttgctgctggttcagagtttctgctgctcccccgcggccgccgccgcagttagttccggttacccgtggcggcgaggtatctctggcccattgtatatatgggccacaagaa

SEQ ID NO: 57424 - DNA, 1376 bp, Oryza sativa
attctttattatttgcttgctcgatttaccattgtttctattcattctccttggaacctttaaaaattggatctaaaaactataggtttattgtcatgttgggcttcttttttataatttctagaagtcccatcaaacgctgccattatactcctctacgaccatccaccgcatcttctctttattgtcattgctattttagaagtcgtacataattattgtttaggttcattttttttactttctagaagttccaccaaaatatcagcgacttagtcaccatactcctctatggctcgctcgctgccgctcttctttattgtcattgagtttttaaaatcaaacatgattatcattggggtttattttttttattatttagaagcccgaacctttaaaaattagatcttatagtttttagagtttattgtctcgttgggtttcatctgttttataatttttagaaatcccgtcaaacattaccactatactcttctacgacccgtccgccgcatactctttattgccactgggattgtaaaaatcgatcataactatcattggaattcattttttactttctataagacccaccaaccatcaatggctctgccattgtactcctatacaggcccgctgcctctcgtttttattgtaattgagattttaaaaattaaatatgattatcaccaaggtttatttttttactttctaaaagtcaaagtcccgccaaccgccttgaccgattgcttcacgacctgcccgttgtttttccttttaatcgtcaagttatcagatgtcccatcaacagccaccactctgctcctgtataggcctgttacttaattaatctcgtcatgtgttttagatggtctttatttttcagttgtctttattttttatcaccaattttaattatttttaaattgtattcctagttgaaatcttatttttatttttctaatttcagtatttattttatttttcgtattgtgttcttttgatattttattttttattttcaatttcagttgtttcaaaattattttcctactttcactctctttttaatttgcctaatttcagattttattttatttttattctgaattttaattaatctactattaggttcttatatctactctcatatcaatattgcttatatttaattccgaattccaattaattttaaattgtattcctacttgaactattattttcttttcttttttctttttttattttttattctgaattttaattaatctcgtattggattcttgtatggactcttctttcaatattccttatttttaattccaaatttcagttatttttaaattgtattcctacttggacctcttctttttttt

SEQ ID NO: 57425 - DNA, 2797 bp, Oryza sativa
ataattgcatagttctcaaattgtatttgttatgtttgatcagcaaatatctctttaggataaagtaataatcgaaggctctttgattgattcgtgctctagttattttggggtgggggtgtcacttgaactgctagtaaatcaattaacatatgttaaatccccttaatcgacaaatagatcagatgctagaaatctagaaagaataaagtcataccactcgctgtagggctgtaggccgcagccaagaagggagttacgaattgcaagacataactggagactggagaagtagatcagcttcccgtctccaaggtcttgcctcctagcttgcccaacggcctgaaaacggtggccaggcccagcgctcgcaactcgcaagatcatggttcgcgcagtctccctggctcacccccaattcgtcgcgtatctccgtcacatatggcgtgacgcccattagggcatcgaggtcggggttctcgggctactggccgctgcctgctgcctcgcaccgccacaaatgcacatgctcggatctaccgtcgggtggatgaagaccgtatctgcctccaaaagcacccctgcacataaaactgcccgctttttattctaaatcctatataaagtaacaaacacacaggaaatacacacgtcctaatacagataaatagcatctcaccaagcttcaccctccaatgtccatatagtctgaatcaggctgcaaaccaatcccaaatccaagaaatctacgaatgccagttaaatccccagcttcgccgtggactgagaagaataaacaaattaaagtgtacaatgaacttaactataatgaaggtggatgagaaggtcagaactgcacatcccactactatgtagcagtgcatcctcatgcataaaaacatatattgatgaacaaagtctaaatgctaaaagtctaaacacaacacatgaaacaccaaaccgtataatcaaatgtgcttaatagaacggcataaatataattcaatagattgacattatacgtaaccaatgtcataagggaccaacgagaagctaaaattggaacatgtcatcttttgtaaataaaataacaaaacagctaacatcttcatgtaaaatctatgttcttataacatagatacaaaggcatgaattatgcatggccgtctgttatctacatggatatagtaagctagttctatataacgctcaggcaagacaaaaacacatcctgggttcgtgcatgtggattatatttatataaattagcacctaagttgttcttgtgaacaaaacctgtataaacctaaaattagtaaaaaaaggaactggaagaaaacgaaagatcttcccatggaactgataaaacacggtgaagacataaaagcagaggtaaacctatagctcatgcggggcagaaggaaaacaaacaagtgagccattcataactctctttttttattctaaagcagcgcattagcgaacacatatgtatagtgggacatatatttgaactgaggctattgcatcctgaaagctcagcagctgaaaaaaaaaaagaaagcatgcacaaagtgtagggcaggcgcaaagagaaccaaaaacaacaggaaatgtaattttcatgcacaacattcaggataattctggtcgtaatgcaactcaattccaaaatcgcatgtatctgatcatataaaccacactcttatgataaaaaggctttctggacatcagaatatcaatagatataaaaacatgtaatcaaatgtgcaaccatttagcagcaacttttaataataacatgcacagtttttcatggaaagcagcatgaaactcaaatttcaccttcctattaatgaacattaataggcaacaattttccccagatctcaacattcttccacagcattagtcatgtataaaattaacgataatctgtatgttttttcatcgacttaaatttatgaccattatcataggataaaacaaaacactaagttttaagaaccaatcttagcatggccgggtctatcatcatgtctcttacaataagtggcaagaagagtagcgcattaccttgttagttttctctgatgaacaagtacgcgaccatcacactggagacaataggaagctcatttattcgtttgcctcaaattgatccagtagaaaatacgataagaagcatcattttacaaacttaatcataaccagaataacaataccaaagtaatatttgtgatacacataatccccaaggcccaactacaaacttttaggtagagaatatacaaacgcaatatcaaaatctatatcacatcacatacagtttccaaccagccagaaatgaggaccagaatacataacgaaaaggtaacgccaaaatcataactgaaaaggtaacataataaacatggtttgctcatcttagataagcatcaaacacaaagactatgaggaaccacaccaaacagtttttttttaaccatggcctcaacatgtatccagttaaatagattgaccgaccataaagttaatcagaccatctaaatataattataatcctggcctatgcgactgatctaggtaggtccactcacccatccgctaatacgttttttccttccatcttttgctgccaccaaccatagagtgctgtggtatacacgctagctgtttggaacgaagcctgttgcaatcaaaccgagaaatacctttttagtctttaaaaaccagataaaccataaattaccctatcccaaacatcgccacataaccattaaaaaatgaatataaa

SEQ ID NO: 57426 - DNA, 704 bp, Oryza sativa
ctcctggaagacaactatccaccggcgacctagctatccatcgaccggcaacgagcatcaagatgtgatctcggcggccggcgacctcgtccacagcacccctgtgtccggcaagaggcgcacatgaggaggaacaacgacatcttccttgggcagatcaacgctgcaggagatcgtactcaaaccttcaggaggagagcaagtctctgtcgctttcttttctctcgtttcaggtgggagatgagcctgtacgcgacgccgccggggttatcgtggctgccatgactatttctgaaccatctccgctgccatcgagactcatccgcccgccgtcatccacattcatcaacatctccatctcatctcagatggactcatccattcatctacaaatcattcaagaagcgacaccaaagaaagtcttaatggccactacaggtaaagctaatttagattggttcctttcttttggttccagtgcctacgtgcatgcatggaggacggccgggtgtgctgccatcgccggagtcgtcgcgtagaccaatctgttgacgctgatcgcaagcctccgtcaagatcgatgccgctcgtcctcaagctctgatgttcgagctgccggtgacgatgaccctgctcattgctgcgatctcgcctagatgttggatgacgttgccttgccgaccgctgcctccactcggcgacgc

SEQ ID NO: 57427 - DNA, 1952 bp, Oryza sativa
cgttcttgccgatcaaacactgtcacactgcctgccggagcacgttggattacgccagagtgccattgctaggggcccgtacgccgtcatcaagactggccgtgattctttctcttcatcaagccgaggtcgttgtgccgtttgtccgcgacgctttcacttcatcatgctggagttgttcgtgatgtcacgtgaacatcacgtcggagcaccactgcttggtgcctataaaccatcgtcaagccggagtcgtcgtgccgtccgtccgtgacgtctccttctctctacaccgcatgatgagatgccatctgtctacgatgctttcacttcatcatgccaagatgagatattgtctgtccgtgatgctctccctcttcgtcgagatcaacgacgctgtattggagcgtcgctcgtccacatcaacataaagcaagaatggtgccgtttgtgatgtcagggaaccgttcatgccagatctacaccaataatttcctcgaccgttctgccgacaaggcatttacttctacaaaggtcgccgttgctaccggcaccctcatagagccccttttatgggctcgtcgtcatatcaactggatcaatagtagatccatcatccgaaggatgtgctatataagccacgttcgtccggctgctgtctgcactgacttcttcatcaacaccttcattacaaatccctgttgtataagggacatgacgggtcaggaggtgcccagccatgtttaatccggttgccgtctacacctactttcttcgtcaattcttcattactttgatcacatctagtcagaaggtgcccatccatgtttattcggctcttgtgtgcaccaactgacttcaccaactcatcttacctttaacaccattccgatgttgttgctatgacgtcgagccgtccaagctaggcgattccatgcgtgtcttcttcaaacaatctacaccgacacgtcgttcaagaccgacgaggctagacgacgagggtgcgcgaagccgacgctaaggctatgtcaccaacactggcgcacggaccgacgaggccgtggatgcgttgccggcgcccacatatatatcacacatcttcaccaacattcatcatccatggagaacgtgaagcaaagacgatgagacgaccacaagcagcttaatcgggggttctcctgcaggcctagacctgcggaggtaattaaccaggagcttctcgaggccctaggaaccagaagacaacatcgctgatgtcagatctgtccaacgacaggcaatggcacgtgtattttctattatacatggaaactgtatcttgataattcaattaataaagatcatgtgtttttgtgtctcttttatgtttattttacatttgtgtatttaggtacactggcacgtccgcacttattttctctctaaacatagagggacatattcgtatttttctaccctaaacaggttcttgttagatttgaatttgcttaagttttaggttttgttcagatttgctgaaattttgatagagctgattttcaagggtattttctcttaaaccgtttattagtttacaaatccctccggtggaattgttctttaggttgtttagtgtcaagtttgcaactcgatccaacggttggtttaagagaaatcgtgtttttaccgaagcgctgtcgtgttgttttcaggctgacggttagaccgcgagaggaccagcggtcagaccggtcaagcttcggtcagaccgaccctagtaggtcggatagaccgccaaacgtgtgttccattggcttttgtgggatgtgttttgatctattaagattcgattatttgacttccgttgacgtaatctaacattcacccctctctggtaggcttggttacttatgtttgattctaaaaaagcaatccgttggaccctatccttacaaaagaaagagcagatctggaaa

SEQ ID NO: 57428 - DNA, 1734 bp, Oryza sativa
  unsure (1)..(1734): unsure at all n locations
tatgtggcgtgtcacataggcaagagcacggtcaaacgcggctttggaccgagatgatactctaaaccaagtttagagatctcgatgtgcacttagcaagttcgtaaacctgagtaaaatttgacaatatgttcgccaattaagttgacactacaaagattaagacaaaattagcaagagttaataacctcattggccatgtgaggaaggtgccattgccgtggagatggatgtcgaggctacggttggggacgagctcgtaaacaagaaggagctcgtcgtggccatggcaccagccgatgagctgcacgagattgcggtggcgcagacggcttatgaccttgatctctgacttgtactccttcctgccttgcttggaggaatctttggtgaatctctttatggcgacggcgaggccctgctctctgaggtagccccgatacactgtgccgaaaccgccttgcccaagcttctcctccgccgcgaaactcttggtcgcctcgacaagttcgtagtatggaaatcgccttggccccgtccccatctcgatctctacgatggtctcgccgtcgtcgtcatcgtcgtcgtcgctgccatccatgcctccgttctttgcctcctctgtctccctcttcttgctctgacgttgtcgtacaaggactgctaccatggcgaagaggagtatgacgaacattaccgtgccaacggtggctcccgctacaactctgccacgcaccgcggcctttggttccaacgatgagctgaaataccatgaatgcagctgatgcanctcanaggatgtggtcgtggaggcggagaagccaacggagaccagctccggcagcacgctcttgaggtcaaccttgtagctaaggttgtaatccggccggtgacgggggccactaagcccatagccgaggtgcagcctcatggccaggatgctggagacgttgtcgtactcgacgacggcgtcatgttcccgacgagggtgaagctgggcaaggtcaaggtcttgttggacacgactgagttgacatcgatgccgaggtggtcgtaggtggcgtcggggtcgtgcaccatggtgttgttgaaggtgtcgaactccaccgcgacgaaccggctgtcgccagtcgccacggcgtccgggccttggtcggtgagaccgatgttgtagccgagctcatcgaccccgctcgggagcatggacgggtaggcggcgaggaagaaggccatgccggtgcccttgttgtcgatgccgccgtcctctttgggcggggtgatgttgaaggagaagcgcgtggtgaagctggcaacctcgccggtgtccctgctccagaggagcatcggccgggcgctgtacgatgcccggcctttgctgtgtcccctgtggccgtacctgttggcgctgatgtcgatccacccgtcgccgaaggaggcgtcgccttcgagtctgatggtgttcccgtcgtcctggctgaaggtggagtagttgaagtacaaggcggcgaccggtgccggatgcaggtagcaaacggagaagaagatgatgcccactgcgcaagtgatcgctgatgtgatcagcggaaagccagccatcgccgccgcggccggccggcgtcggtgcgcacggtgataccagcttgacttggagcaacgagtcagtgcgtagagtcttcctaattggggagtggattcactgaagtgtggaggccgtcgacttaagtgagacttggt

SEQ ID NO: 57429 - DNA, 1599 bp, Oryza sativa
tgaagtcgtagacgcccaacagcggcggcataataggccagccgtgtaggcagagacaccagtcggcggcggcggaggcaagccggtcggtgaagacgtagacgcccaacaacggcggcttgatatgccagctgtatgttgatctgctgaatcaactcatgcatgcatgaaatttctccgagcaagctataggcggctgctcccatgtgcccgtggtggcgtggtggccgcaacgcatccgtcggcgctgctcccgactgaagatttgagccatcgagattaatctcgccgtttcttctgtagtcgattccatcacacttttcgatgggtaattcgacgcagcccctacctggcgcgccaactgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacaaggggactgcagcagcggcggcggggggtggaacggcgatggcagcaccgccgtgagctatagctgggtgagggcgagagggggatcgcgacaggtggaatggcgatgctgacaagatcgatctagggcaccgccgtgagcaagagccggcgcatctcgatcccctttgtctcactgatctaaagaatgacccaggggcacattggtcacaacactcgcgattcggtgtgttaatccggtgaaattggaaaaacggcgaagcagcgtgttgtgcgagcgtgccgatagcatattagcgaaactacttggcggaatggcattacagcgaaacccatccttacatgtggctaaatgtcaattttctcggacaatgcaccatgaaaaaagaaaagaaaagccattggttcattcactcgctgtttgttgatgctttttctcttggccaacaaaaatcacctaacgatttgcggtgtaatcgacggtgttgtcaatatcgatagatcaaatttcaagattaattcactttcgtggaatcaaacgactaatttatgagcaaattagcaaataagagaaatatcgtacttacatgacgagaaatatcggaattacgttacgacaaacgagtagtttccgagcaaactagcaaaggataacctcctcgctttcgtggagaaacacaaccatttttcagtgcaaaacaacaaagattaaccaaatcctcttagccataaaaacaaaatagaaaatatcatatctctactacttaaaaaataagagatgcttccatcgtccgtcaaaa

SEQ ID NO: 57430 - DNA, 2352 bp, Oryza sativa
cggcggggtcctttctgccgacgccttgactaactttaaagcgccgcaggccgcatcaacgatctccttttttctgctccgtgggcccatccttccttcctatccggactggtataccgcatgcaatcaatcaggttgataatcctctataatctcgtaccgttccatgattccatctgatcatccctgttgcttcatccaaaattccaaatcatgtgcacgctattagtgctgctctccattctgcaccatctgcctgtgatgtgctacaatagaaacctgctcagcggcatccgcatagtccacatacatatatacatatatatattcctagctatttgtttttaatgtataatttaaccgttataatttcatttagcccgcatagtgtctcagccaatttaaaacattggttgctgctatagcatttgcacgttgcactttgctttctcatactaaattagtaataacacaaataggaccaagcagaaataggaaaaatgaaggtaaatctggataagtacgatatcttatggtgaaaaccatattgatatcctgtatttctgtaaaataaataataatcgggaaaaactaaataacaaatatgaagtgaaagattcgatgagaatttgtaatactaagaaccgttttttcaaatatgcactttagtctataactttttggttaatgaaatcgcaacaattttgacgaaacataactttaaattttataatagaatatctaaggaaaaagtatgaattacccccctaaactatcgcggtcgaccgaattaccccctaaatctgaaaaccagacatcactcacctcgaactttcaataccggacgaattacccccactggcacaatccaaagcggttttatcctacgtgacgtacacgtggcaatccagtcagcatttcctttttttttaaaaaaatggtggggcccacctgtcatctcacctcctccttctcctcttcccctctctctctctctctctccccccttctctcggcgagcacggcagctcgcggctctacgccggcctcagctacgcctgctacgcgtcatcggccacctccccgtccaccaacggccacgttcgtcttctcccgcgcggcgccgccggcgacgacctgtacgccacgggctgcttcacctactgcgccgagctcacgccgacggcgcgccgtgcaccgggacgggttgttgccaggtccccatctcgccggacatcccctacctcggcgcggtgttccacaccggcaactggacgaacaccgcgggcggttcacactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacacatgacatgtcatctgtgacgggtgtagtattatgaaccatcacaaaagagaccactcatctctgacgggtcttttaactaacacacgtcacagataacgttatctctgacgggtggtagttatgacccgtcagtgatgagtgaaaattcaaatttttaaattttgcaaaaaaacctcggattgaaacatgtcctatataaaagttgtagctcttaatgatatccacaactttataactaacaacatttctattagagatcatttacatccccgaacatgcattacaagtgatcagatctactttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggataaaaatattttctatgtaaaagttataaaccacaataaaacctatacctattaagttgataatattttcatttgaagtcatttagggtgttaaatatatgttaaatgattcagacaagcttaaccaaattattaccatggggtaagtagtcaatatgtgtaaattaggtaagtgggtaagggagctctatatggaggttgaggtcttgagttcgaatctcacttgtagcatccaagttatattgcgtgaaaaattgtgaatttgtaggtagtgatgtgtaaccattataggatggctagtaaaattcaaaatatttttttgaggttttttgttgcgtttaaaattcaaaaat

SEQ ID NO: 57431 - DNA, 1779 bp, Oryza sativa
tcgatttagggttgtaatttatccggttttgagagtttgggatgttaaatgtctagtattatggtttagggggtaaatcgtactaccgcaatagttcgaggggtaattcgtactttccaatatggaaatatctaactatttgccaaactattggtcatcattaattacaatcttaatttggttgttctcataattctttggaaacagaaaattaaattccattaatatattactctgtatgtttcaaaatattactggtcattctcacatttaaaattattaatttagatcgtggtcttctatcttcacattttatcaatgccatgtacaactgttaatcaaagttaatattgcttttgagaacgattataatgtagttaataagcatagcagtgtaatttgcacatctcctagtttgatgtgaaattttgctagaatgacaaataatataaaatgagatatatgcaaatttaatatatattttgcagatgagccatattacaggctaaattaggcggcacgtcaacagggcgtgcagatcttctagtatctactaatctaaagctagcacttcttgtgccaacgggacatttaactatttaccactatttggtttgacaattatcaaatacccttcttatatttgcacatgcattggtagtgcataaacttgttagatgggtacaatttagtacataatcttgtaaaatgctcgtttcggtacacgaacttgtctagttttgtgcaaacgagggccaaaatagcttggcaatattaatcttacgaagttgatattgattagggtgtgacatgcatatgtatagtgcgtttgcataagactgcaattatttataaatttgatctctactttatccttcatcaaggaagtgatgatatttcatatctttcccaccctagcttatatcattgctctttttttaatctttttctacaatcacaaaaacaataagattatccatgtagtgttcttttcgccttcctccgcacgcacctgacaagttcatgcactagaacaagcgttttataagttcgtacactagattgctaccacctaacaagttcatgtacggcgatgcaatttactcttttttttttcaatccccttctccaaatcgaaccaactctagaaaggggagaaggagctgtcgtttacatggaatgacagaagtggatatcgatctccgtggtgccatggtgtgctatccacacgtttgatccgttgcatgatagcccttctacacagaactcttggataactattacagactttcccattgataagaattgttcggtatagtgaagcagggtttctagatgctttagtggtcgaaaaaatggattagatatcgcagctctttttctcctagctagaaaaataatttctggtagccaatatccaaccccttccattttaatacatcaatatacactaccggagaattgatatttgtccggatgacaaaaatcacattagccccgattcgaataggaaccgagactaaagaatatgtttagtcccggttcaaaagcccaacagaattttttgatatttagttccagttggtaacatcaaacaggactagagatcattttttatgtcccggttcaaaaattgtcaagcctcccactatctttagtcccggttgtctaaaccaaccaggacgaaaaattaaaaaaacagtcgagccacatggggagggagagagcagcgcgcgtcgtcgtccttatttctttctccccctcatccactaacccttt

SEQ ID NO: 57432 - DNA, 1621 bp, Oryza sativa
ccggtggcggtgcgcccttgggttccagcgacgagctgaagtaccatgaacgcagctgatgcagctcgacggatgtggacgtcggggcggagaagccgacggcgacctgctccggcaacacgcttttgaggtcaaccttgtagctaaggttgtaatccggccggtgacgggggccactaagcccatagccgaggtgcagcctcatggccaggatgctggagacgttgtcgtactcgacgacggcggtcatgttcccgacgagggtgaagctgggcaaggtcaaggtcgtcttggacacgacggagttgacgtcgacgccgaggtggtcgtaggtggcgtcggggtcgtgcacgatggtgtcgttgaaggtgtcgaactccacggcgacgaaccggtcgtcgccggcggccacctggtcgcggtctggttggtgaggccgaggttgtaggggtaggagccggggagcctcgacgggaagccggcgaggaagaaggccatgccggcgcccttgttgtcgatgccgccgtcctgtttgggcgggttgatgacgaaggagaagccggtggtgaagctggcaacctcgccggtggcggcgtcccagagagggaccggaagggcgtacgacaccctgccacggctgtcttcgatgctgccgtgcctgttggcgctgatgtcgacccacccgccgccgtcgccgctgaaggagaagtcggcgctgaaggcggcgtcgccttccagcctgatgttcgtctgctcgtccgggccgaagttggtgtggttgaaggtcaaggccaaggcgactggagccggcgagtagagatcgtcgcagaagacggagaagaagaagatgaggccgacaatattgtacctcgtggtggtcgtcgacgatgtgatctgcaaaacgccggccatcgatggccgccgtgttgtgttccctccccgttgattgatcgagtcaatgcgtacactgtttgcagtggcagtagtgtggagacatgatgatgaattttagaagaaaggtaagggtggcccatcaggaaagcacatggatacttccttttccttcttcgttccacacgtgcgacagcctgtgaataactaacaactggacgaacgagtatgcgaaactgtataagggaacatggttaacgattcggttgcgcaggagaaaaaaaaaagaaaaaggagaaaagaattccatgtcatcgtccatgtggcgtgtcacataggcaagaccacggtcaaacgcggctttgaaccgagatgatacagtaaaccaagtttagagatctcgatgtgcacttagcaagttcgtaaacctgagtgaaacctcctaactagtttaagaactgctggtgtattttattttttttatggtgcgcccaaacttctcaaaattgtgactgaaaattaaccattgcctccatgaacattggtttgattaattttctagacttcgaggaatataatgagcctatgctgatgttgattttaagcacgtgcactggtttcgttctaacgacacaaagttataaaaatcctttgaataattgatagtataaattattgttgtcctctacctttaaaaaattatactaccgtataaagttaggcaccgata

SEQ ID NO: 57433 - DNA, 1086 bp, Oryza sativa
tgtcagatcgtcatctgacagtgctgaggaagatactgaagaagaactgagcttggaagcagagcaggacgatgatgagaagatgcaagctgaagctgaagatgcagagcagggaggagttatggaccatcaacccgtgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacatcttcttcttgtccgtcttctgcgacgatctctactcgccggctctagtcgtcgtggccttgaccttcaaccacaccaacttcggcccggacgagcagacgaacatcaggcttgaaggcgacgcggccttcagcgccgacgtctccttcagcggcgacggtggcgggtgggttgacatcagcgccaacaggctcgacggcaacatcgaccacagccgtggcagggtgtcgtacgcccttccggtacctctctgggacgccgccaccggcgaggttgccagcttcaccaccggcttctccttcgtcatcaacccgccaaaagaggacggcggcatcaacaacaagggcgccggcatggccttcttcctcgccggcttcccgtcgaggctcccgtccgccggctcctacgcctacaacctcggcctcaccaaccagactgccgactaggtggccgccggcgacgaccggttcgtcgccatggagttcgacaccttcaacgacaccatcgtgcacgaccccgacgccacctacgaccacctcggcgtcgacgtcaactccgtcgtgtccaagaggatcttgaccttgacaagcttcaccctcgtcgggaacatgaccgccgtcgtcgagtacgacaacgtctcc

SEQ ID NO: 57434 - DNA, 1135 bp, Oryza sativa
catgaggagtgggagcaatgtgttgtgcaccgtgacatcaagccaagcaatgtcatgctggatgaatccttcaatacgaagctaggtgacttcggcctcgcaaggctcattgaccatgctgatggggtacagacaatgacgcacccctctgggacgcccggctatattgaccccgaatgtgtgatcactggtaaagcaagtgccgaatctgatgtctacagttttggggttgttttattagaagtggtatgtgcaaggagaccaatgagtctactggatgatcaaaataatggtctcttccgactagtcgagtgggtctgggatctatacggccagggagccattcacaacgcagctgacaagcggctcaacaatgactatgatgtggttgagatggagcgtgtcattgctgtcgggctctggtgtgcgcatccagaccgatgccagcggccatcaatcagagctgctatgatggtcctccagtccagtggaccaatgccgatgctaccagccaagatgcccgtggcaacatatgcaccgccggtggcctcatcggaggggcagctctcgtcatcgacgggtatgtcatcatcaagtttgacacaaacagcaatcacacctcgttaggggcataagtttgcccacttgtggtacaaaaataatccatgccattagattataaatgcacttgccttctacttattctcatttcagattgataaactgtaaaccaaatgaattagcatgggtcagccggcggataccttgagcagggatccttttctcagggatgccgctctcggtgaaatctagctagagatttaaattgcaaacaatgtttgactggatttgaatcaatttgaacaaaattcaagaaggacatgctcattgttgatagatgtcatacgataatcggcaaaatggaggcggacaactgcatagaacattacctactaaacttaggttttatccaaatgcatccccatctctgactgacaccaaagtatgtaacctcgaacgatatagaacacatggaacatcatcacaaaaagcatatcagtaattttgtaccacaccactaaaattcagaacaagaggtcacaaaatatattttgatacatggttcgagttgctg

SEQ ID NO: 57435 - DNA, 1558 bp, Oryza sativa
cacttgctaaacttagcatacagttgatgctctcgtagcttctccaatgcaaggcgaagatgttcttcatgctcttctttggttcgagagtagataagaatgtcatctataaagaccactacgaacttgtctaggtattccataaacaccttattcatcaagttcatgaagaaagcaggggcattggtaagtccaaaagacataaccgtacattcgaacaatccatacctagtggtaaaagctgtcttaggtatatcttcctctttgattctcaactggtgataccctgatcgaagatctatcttggagaaaacggtagcacctttaagctgatcaaacaaatcatcaattctgggcagcggatacttattcttgatagtcacatcgtttaacgcacgatagtccacacacattctctgggtatggtctttcttttccacaaaaataaccggagctccccatggtgatgaactcggtctgatgtatcctttctgaagcaaatcgtccacttgcctcttgacttctgccaactcattggctgccattcgataaggtctcttatggattggagttgttcctggtaccagatctattctgaactctatatcccttttgggcggcataccaggtaaatcatctgggaacacatcgggatactcccggactataggaatctcttccaaagttatctggttcagtcttgaccttaaagactcagaagacaatgcatgaacagtcacaactcgaccatcattgctggtgagagttacttttctgttggcacagtctatcacacctctatgtctggctaaccagtccatccctaggatgacatcaaggtctttggattctaacaagataagattggccagaaatggtactcctttaatttctattctgaccgaggggctacgttgcaaagagagtgcttgattacttggggtactaaccatcaaaggatgtctaagatcttctacttccatcccatgatttcccgcaaaactcatagataagaatgaatgtgtagcacctgaatcgaaaagtactgttgcaggaactgagttaacagggaacgtacccaaaatcacatctggagaatcttgagcttctgcagcagcaacatgattgacacgggcctttgatgctggtacagcagagttactctgggcagggacaacctacacgcgacggggcttcggacacttgtcagcataatgtcctgggtctccacagttgaaacacaccacgggcttgctgccttgctccctcttggcaggctgttgctgtgttggagctgcaacaggacgtggagtttgattgcggatgttattgccagcattgttgttgaagaactgacgcggcggacgaacaacagacgaagaacctccctgtggcatagactggggtcctaaagtaagacgcggcttctgattactcccctgttgtgccttgaagtgagcaatccgacgtttcctctgttccatgcaattgtacttgtcctcctgacgtatagccttatccactaatttctggaaatcagaataatctccaaccatga

SEQ ID NO: 57436 - DNA, 2884 bp, Oryza sativa
aattgatagcgagggacaaatagagctctcttccttgcggtgagacgaatcctggccttctgcggcggtgcttctcccttcaatgcggcgagttccttctccaaacgatccaccttgtcctctaacttgcaaatcttaccacgattccggtcttcacgatcttgagccgctaacacagtctccgcacgactttcatccatagcccacaacatctcaaccaaatgccttgtggtagcatcattctcaattccttcagtctcaaggtaactgccacggtcacttccctggggttgacgaggatggtagcgatactcagtatcggccaactgatcactgtagcgatcacggagctctcctatggcgatccttgccacttcctgacatgcatggatgtagtttcttcctccagcttcgaacatcactgaggggacatcttcactattgctgtttaaggtgactttgactcggcacttctcttcatgacgatcatgaggaatctgggcataaaaaggggcagtcccaaatccaatggcaaaggacatcgtacgcaactcctggacaaaaccctcaacaccaaacaggtactcaggcttgtagcgcggcatctaaagacaagtgaaaggagagagttaagacatctatccaattaacagcacaagtttttggattaacttgaataaaatttgaaaatcaaagtaaaaggtaagtaaataaggtaaaccaaacttgcaagataatttgaaatagttgaaaacaaggttacaaattttgtgcttttgaataacaggtttcaaaagaaataaaaggaaagttataaaatcaacatgctaaatttattttattgcagcaagattaaataaaacaacattgtaaaacttttgctggtaaatgagccattagtacagtaatagatgtacagtaataataacactggaataaattttgaatgagaaccattaaaagagattatgaaattttgctgaaatgcatgtgccattattttggtttaattaaaagagaaagggaggagaacagttctactttttccaatatttttagagggcttctatgggtaaccatttggcataacctagggtcaaggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaatagagatctaagcagcggaaaataaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaattaaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaacgaaccatgctatacaaaagataaagccgttgcccatgctggcttgtggttggcacgattaatgtttcacaaccgaaactcgtgaaccggtccttaattgtcatgagcacgaccatcaaaaccatgtgctcacaacccactattatcaggttttagttggcacattaattaattaactaatcacgattgacctcgtgaactatcaataaaccatcatgaaataatagtgaatcataagttatcccataaatgtgctaaggtttctaagcagggctaagcaattatatctaatatttagttgaaccaatataaataaagctcaactagtcaaattatatcccaaggtatcaaggaataaagtaatcaagaacaaaagggctataacaaacaataggttaattccacccaatgacattcgaaaataaatgcaatagttgaaaagaaacaacagctttaaataggatcaacatgctcaaagggttgtttgggatctgtgtgacttgccttgctggccttggaactcttcaaactcttctccggcgaaaacggactcttcggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttgaagattaaatcggattaaaacacttaaatcggttaaaattgaattatgacgcaataatgaattatttttgaaaaggaaaaaagggattattgcgtcagcggctagggtttcggtggaccgggcg

SEQ ID NO: 57437 - DNA, 6193 bp, Oryza sativa
ttaaaaaatgtgggaccagatgtcatactctctctctcttctatctcttctatctctcacacacactctctcctcccggcaacggcggaggtagcgagtgcggcggcggaggcagcgagcgcggggaggagagcggaggcggcgaggcaaggcgaggcgacggcggaggcagggaacgcggggaggcaagcggcggggcagggcggcgcaggcgagcggctgcggccacccctcttcctcacttccccagggttgcttaggttgacggcgggcgcggctgggttgcttcggttgacggcgagcggcggcggccaccccccttctggcacaccgtcttccgtgacctgctcggcgacggcatcttcaactccgacggcgagacgtgggtcgcgtagcggaatacggcggcgctcgagttcaccacggcatcgactgcggcggcggctgcgggcgcggaccggacgctgtgctccggctgtgccgtcctctgcttgctgctctgccaggagcggttcagcgggctgcgcgtgccggtgtggctgctgctgccctgctcgactacctcgtcgccgttgttcgtcgagcgtccggtctgtggactccaccaaaactcaaatgatagaagaaaaccatcagatagattaacaggtagaagcacaaaacgacgatgaacgagatgcgacaagccaccgggaaatttacaggggaaaaatcgtgcttcccgtctctccgccaagcccccacctcgacgacgcctccgcccgccagcgcacccccgcgcgccgccgtccaccgtccgtccccatgccgccgtgtgccattgtgcccaagagtcgccgcgacgcctccgctcggccatcgccgcgacgccggtgtccgccgcccgccccgtgcgccgcgcccgcagctgccgccgtagtagcctccgctcagccgtagccgtgacgccgccgtttgccgctcgccctcgtgcacgcctgcagagggcagacagagagagattgagaggaagagggggaagagagagagagattgagagaaaagtggagaagagagaggtgggagagtatgacaagcgggtcccactatttttttttattaaaaaacgctaattgggatgccacgtgtacgtcacgtagaccaaaaccaccgcggattaggtcgaggggggtaattcgtccggtttgcatagttgggggtgaagaatgtccggttttatggttcagggggtaattcggacgactgcgatagttttagagggtaatttgtactttttccaatggtatatggaagttacttcttgcttcttccatatggcatacatcgtcctccgataagccgtagcttggatcgagatattatgggttgttcttggacgtttctttaccctgttgatccgcgcaacctgtagaccacgtctctgaagtgaatgtaaattttcgacggtgtgtccggtagagttttgaccgtgttcatgcctttcacggtggtgtcgtcgtgattggtaacaatgtgcgcataaaacaaaccaatcagtaaagaaattgttaaaggtaagttagacgataggcacgtcaggtatttggaggggttgtatataacatcctgaccaaactatgacttgacctgtgtggtttatgagaattgtgtacgcatgtttagtttaatcttgttagtttactaaggctgtgttcagaatcagccgttccaaacttgccagtgagcatagaaaacagagcgatccattagcacgtgattaattaagtattagctattttttaaaaaaatagattagtatgattttttaagcaactttcttatagaaactttttttttgtaaaaacacaccgtttagcagtttgaaaaacgtgcacgtggaatacgatggagagaggttgggaaccctaggttccaaacacagcctaagggttggaccaacttataggcctctttcctccaaccgtgccacttttgaattaacccttttacacgatgcgatgacgaaagtgtaagtgggtggtgtgtgtgagtgggcctgcctatcagatgggctgggctacgcggttctggaaggcgggttgttacacacaacccaaggggaggaacatggttcgtgcctcgccgttcgccgttgtcgccaccctagtccactatatctgtcgcctttctagttgttcgccgcagtcaccaccctagtccactgcatccgtcaccgctctcgtcctccatggcagtcgtcaccgtagtcgccaccctagtccactgtatccgtcaccgccctcatcctccatggcagtcatcgcctctcgccgtctgtcgcagtcgccaccctagtccactctaaccgtcaccgtcgtgagcaactgcctcatccgctgtaggatcaaggaggccgactagaggggggtgaatatgcggttttaaaacttaatggcacttcaacaaaactaacctaagttgctaggcaaggtgaggtgcaaggttaactaagcaactaagttaagttttgcaaacctaagtgatatgggctcaaatatgtctctatgaatgtaaattgcacaaatgtaaatgcaacaaataaatgagacaagagacaaggaatttttcaccgaggttcagaaacttgccggtttcctagtccccgttgaggcgagcccaactccaccgctcaaccacgaagccaccgcacgcccccttcatcaaggggtgggcaaggtgggagccggcccacggagaggactacccaagcctcgatcactagggtagttcttccttcacttcgaaggtggtgaactccaaaccactcacaaacggcgccgggcctcctccacaatctcctcagagaggtcaccgggcaacacctccacaagccgtctaggaggtggcaacctccaagagtaacaagtctaggatgcttgccgaggatgatcaagtgccacactagctataacaatgaagcaatgcacttggattggcttaactcactctctaacacctcactagataaactaagtgccaagagtgtgagagctcttgcaagggttcaagataatgcaatggagtgccaaaaccttacccttgttgctggggaaagggtatatatacccccaaccaccaaaaccagccgttggggtcgaaatccccaactctgtgctctgccggtccgaccgccatagagtggccggtcagaccggactactttgtaacggctagttggcagtcattgagcccactcaacctggccggtctgaccgcagtgtagtggccggtcagaccgtccacggctcggtcagacctccttcggctcggtctgaccggttgcggctctggcagctctgtatcaccaccataaaccagaccagtgcaacagaccattgaagccggtcagaccggccttatcacgccggtcagaccggctaacaggcccggtcagaccgtcctaaggcccacggtcagaccgcaggttaattttcagcacaaccaaccgttagtaaaatgcgatatctcttgactcgggtctcggaatttggcgctcttggactctatggaaagcttattcaaagggatatccaatccatgaacaatccatccaagaaacacaacttttctcagggagaaagggctcacactccaaaggatactccaccggacataaccacatgaggctacccaaacctataggatttgcccacatatctctttgtttaggacttgataatactcaccacacttggctagacaagcccaccaaatacacctacatgcatatgaactaatatggcgcaagatcatccacatgctcgcttcatagacccctcttaatagtacgacgtctatctagcaaatccggtctacaccaaacaccaagaccgggaaaagactaagaaaacattcgtagctccattatacctttgccttgcgccatccaacttggggtcaatgcttaagccaaaatcaacacttgtgaccatccggttgaaccatgtttatgccgaggtctttaccatcctttgtcaagactttattcccatcacaagtttgacttcattcttgccaacatgacgatgtccttggcttggtgaccattaacccatggtgtcattcaatagccttatcgtagtgggacctattccttttcacatctcaacaaatcggatgtagtataagatattttagataactgtgtgtccagattcatagcaaaaagttgctatattttgggacggatgtagtataagatattttagacggatgtgatacatcctagtattagtattaggatgtgtcgcatccacataaaattctaggatgagtagaatatttatattatagtaagcataaaatttctatattgtacccctccgtaaaaaaaattcaattctaacaacgaaccgttattttctttttacggaataggacatgttagctactactcactgtagaggacatgcatattagggggtgtttagatggggctaaaactttttagcccatgtcacatcggatgtttggacgctaatttggagtattaaacctagactagtaaaaaaactaatttaataaatgagagctaatccgcgagacgaattttttaagcctaattaatccataattatcaaaagtttactgtagcatcacattgtaaaaatcatggcgtaattagactcaaaagattcgtctcgcgaattagtccaaggttatggaatgggttttgtaattagtatatgtttaatacttaaaaaagtgtccaaacatccgatgtgacagggacttggaataagtctctataaaccaaacaggaccttaatccagcagccggctcttgtatagatctagcagttactccagttcttagtgtgacaggtctcccacttccacgtgaaaattgcctggatttgaacaaagtaatctttacagctatccttaggttctgacgatatctagtcctccacatcttcgcctgtcctctcacaaaagccactctcaccgtacttttaactccactcgggtgcttagctcgtccctcatctgtcccaaagtcttacccagccgccgcacccgagagcgagatgcgatccgatcaaaaacgaaacgggctgactcatcatcactcatccaattcccatcccggccgtccatcgcgccacatccaacggccaccatgcgacgaccctgcccccctttccagccaatgcatcataatacattaatactatagtatgcatataagataatcctaataccatcacaaataaactaagcacatgatgcataacaatcacaatagaaataaacggaaaaaggcaaaatcagtctaggggattccttccagctctcaaccaactcgtcacgccacgcctaccgcctccgaagtttataaacctctctctcttttcgagctctccgctgcgtgtccaccatttccgtttggttttactccactaataagctaaggattttttcttttggttgtggttactgcgccaatggctggtaatccggcggcggcggcgccgtcgtcgtctggctcttcgtcggtgttcctgccgcccccgtcgccgtccgacggggagctgctccggccgctgcaccgcctggcgcgcgacctgtccgccgtcgacacgcccgcgccgttcctgcgcgccgcgttcgcgtccatctcgaggcggtccaagctactggcggccgcgttcgacgacctgctgctgtgcggcgccgcgggggagctgccgcggtcggcgtcgctgtgcctgcgggaggtgctcctggtgctgcagcggttcaaggcgatcgtcgccgattgctcggcgcgcagccggatgcggctgctgctggagtccgacgagatggaggcggagctgcgggagctcaaccacgacctggccacgctgctcgacctgttgccggtcgtcgagctggggcttgccgacgacgtgctcgacgtcctcgccctcgcgtcgcgccagtgccggcggtgctcgccggcaccggagtcggaggaggcgctgaaggcgagcgtgctgtcgctgatacaagagatcgagcgggagatcgtgccggagcgggagaggctggaggagatcctggtggaggtcggcatcaacgacccggcgagctgcagcgaggagatcgagagcctggagcaggagatcggcgaccgtgcctcggagaaatggacggcctccatgatcgc

SEQ ID NO: 57438 - DNA, 3425 bp, Oryza sativa
cgcgcatgacggcgtcgttccttgtgaagaagctgtccgtctccttctccccagatgccgccaaccgcgtcgtgcacgagatccggctgctatccaagtccggctcggagaaccgagcgttcgtcggagaggccggagccgtgcctctgctcgtgcccctgctctactccgaggatgcagggctccagctcaacgccgtcacggcgctgcttaatctctccatcctcgaggccaacaagaagcgcatcatgcacgccgacggcgccgtcgaggcggtcgcccatatcatgagctccggcgcgacgtggcgcgccaaggagaacgccgccgccgccgtgctcagcttggcgtccgtgcattcctaccgccgcaggctcggcaggaaccaatccgtcgtggagaaattagtgcatctcgtgcgcaccggcccgacgagcacaaagaaggacgcattggccgcgctgctgacgctggccggcgagagggagaacgtcggcaagctcgttgacgcaggcgtcgccgaggtggcgctgtcagcgattagcaaggaggagaccgccgcggcggtgctcgccgcgctggccaagcgcggcggtgcggaggcgatcgtcaacatcgacggcgccgtggcgcgtctcgtggcggaaatgaggcgcggcacggactgggccagggagaacgccacggcggcgctcgtgctgctctgccggcgcctgggcgcgccggcggtgacccaggtcatggccgtgcccggcgtggaatgggcgatctgggagctgatgagcatcggcacggagcgcgcccggcggaaggccgcctcgctcggccggatatgccggcggtgggcagccgcctccgccgccgacggggagcgaggcggcggttgccccgttgccaccgtggtgccccctgccatgatggcttcgtgaaaaccaatcacaacttgcctcgtaggataagttcagaaacataatttttccccccttcttgctgtacagagtcttttttaggctgtcaagattctttgctccgagagataatggtgagtgtttgatcaactgtgcatacgagcttcagtccaatgtaatcccctccaattccaactcaaattgcgccctttcttttctcgaaagataaacgaagatagaaagtatttttcacatgcacatttctgtactgccattcgtaaggatacccggatttttccttcacctttatgacgtctgaaccactactcgtatttggtatgggaaggaaagcaacgcctttgttccgatttaacttaccgaatggacccccgtccatggtcgtctactactccatgatccaatgtaacagaagcaagcaactgggacgcgcagtttggcacttttgctatcatagggggtggttgatgggtcccggggcaggagcagccgccagcactggcccatgggcgccccccggagtgattgcgacgattgggaccagcggccagactcgccccccgctggcgaagcggacatgattcgcgacacggtgggttgcacgcacttgcacggcacgggaaggggacgccgcgagttgcaggccgcttgattggtgcgagaaagaggcgtaggaggagtagtagatgccacggccggttcaacgttctgcccgcgagggcacagacgtgcggcgccgccttttggttgggcggcaggaaggcgtcctcgtgccgccgcgcgcttgccgacgagctcccggttttttggcgtttggctgctcggcgcggcggcttctgggatcacgcgggtgttcttttctgcatgcgccggtgcgagcttttgtcatggtgcgcgttgctttgttgggaaaaaaagtattttgtttttttatttgcccccatcagagcgtgccgaattttgatctccaaatcttgatcaagctggcggttttgggtaagatacaaaaagagaaaaaaaaaagatgggtgttcgtgctcctatcgtgctcttcggaggctatcgatagaaaagagaaacagaggatggcgttcctgttccctgacagtgtcaaaatgctgcattcgaagcaaggaagggctcactattcttaattggtgcggcgccattgtgacaactgacaatgccgcgtgcattgcatctggtgatctggtcttccagtcgaaaccaaattgcttccctggcaatgaaggaagtcagccgatttaaaattgaaatgattcttgggttccagaacaaatcccgtcatttgaacttgtcagacaatccaattcatgccactgtttctcggtgacttgtgcatgaacagtcagcgaggcaattggctccctaattaattcgctgctgtcggcattaaggtcgtggctgtatagtgtatagagaggtcgaatagtcgacgaagcgaagatcaagcacgcacttggacaaaaacaagttgcatcagacgaacacaaaactgaaaatgaccgaaggagagttggaaatttagaaccactgttcctaatagcaagtttaataatatagtcaactactggctccaaatcatctatagctaatctaatagactattcatataatagtttactataaaatgtactacactatttatacccggtcccacctctcatacacacataacgtttcggagtctgtgttgtaactggctataaatatgtagcccgctttattctctctcttcacttttttttctcgatatgtggttatagctggtttatagctgctattgtaactgctctaatatctactgatatctatctatcccgtcgagtcaaacgaagagaagaaagcgggagaaggaattacgtgaaacttgtaagcatttactgggaccatttggccagtatcaccatcaatcgttgtagtgatgacaaccattcgtcgacccgcggttgcgacgactggtctcgaacagtgccgcgctgcggaaatccggtgcagaaacctgtcgatattgcagccgcaaagcgattggcagaatggatgggcgggtacgcctgcctggacggcggacgctttgcggcgtggcagaggccacccaaagctgggtgcgtccacagaaatggcgaagctcgatttaaacgccggttgatagcattccgtgggaaaagtgagaaatttcatccaactagttgtcgccatcgattcaatcactttcatcttcctggatggttatcaacctatcatcagtggtgagattttcacaattttagccattttccgtgagaaattttataaatacacccctagcaagtcatttcataaaaagggaacattccgaacacggatttttgcatgcattattgaaacatattgtttatttgattaacatgatgaattaataaattaagaaataaactttataaatagattagtataaagggtcaatacagtagaatatatattttttagaaattgtat

SEQ ID NO: 57439 - DNA, 6674 bp, Oryza sativa
ctatttgtcgcaaagcacaaacattccaaataagggcctataccacatatgaaaattactacattcataatttaattccgggtgtgtttggcgctacctttcccaacctcaacattaacagcttttcacacgcacgcttaccaaactattaaacggtatatttttataaaaaatatagaaaaaaatactttaaaatcattttaattatttttcaactttttagctaatacttaattaataatacgttaatgagctattttgttttcaatgcggggagaatgagttacaaaactgcactatcgagcatacccttagaaatcccactgctttagtaggaattgttggagaatttttaaagtttattgttacattcgttctcaataaatgatgtcctaaaatatgtgcgatcaaatcttgaaatcttatatcatttataaatagaaaaagcattagaattcaatatgcctagcaatgctaatagctaggggtgggcattcggtccgatagaaaatttcggtttcggttttcagtttttgggtcattggaaagtgtagaccgaatttcaacgcaaaaatttcaggaccaacaaattcggtctcggtcttggtcctgaccgaaatttaacaacattttcatatatgcaaagaaataatcgaaattttcaacacaaaatcaaaaaaaaattataagcacgtatgagtaaagactcttattaggttgcatgcctagaagaagtaggaatgtgaaaattagagtttaatattattgaacttagtggattataggttgcatttaattttttttttattaattcggtttttgcgatctattcgattaaccaaggagactaaccgaattgaccgaaaaaattcggtctttcactgccgaggaccgaatttctcggcctcggtcttttcagttcgattttttttctacccacccctagtaatagctatactcactcatgaaaaaagctttcgcatgattatatgttttaatattttttttataaatatattgtaaaacttaatgatagaatatgtgtatggatgtcaaaaacatcaaactaaaaaaaccaagggagtaataatttaatctggcacttgatcgtgccgagagtacataggggtttatgataagatcgatcaagcgggtccaggcttgaatgcgactttaccgtgacgagctattacgagtttgttttagatgattcttatcgatctattacctggttttgtcattatccgagagaagttatcctcaatccataaattaatcatatggattgttaaccctggataaagccgaatttctcaaatgatgactctttcaatgaaatctgagacacgaatgtcaccatcttatctcgcaagggatcaacactacgagaatatgcgggctagcttatgtttctcagtttctgcacttctgtacagttgcagacgatcgacgggtttgtaatctgaacattgctcctgacttgctactaatgaaataggtttgacttgaaacacatgccagcgtgtttgctcagcttgatgaatcagtgacctcctgtctgacccttctgttttttaggagatctcaggcttccaggttacacatcgcatgaagattttgacctatatatatatgagtgtaagaaatatattgtactatattcatggctgtgtgttgttcaaactagcatgtccgtcattcagacgccgccatccgattgacagcaaatcgaggaaatatgaatacgaaagtaaacagctacggattagtttttcagtgggctgtggggacgatgggttagttaggacttaatgaagtctacatgttgtaatcagccactggattgtgtactaaaaaaacatttatacgaatactagctggtgacaatagtattatgtagtgattgattctctactgttgcaccaatcatgattgcgcatcgctgaccgaatggtttatgtaatggtttcctggagctacagcgtcctgtttgtttgtgttggggcgtggcagtgtcgcgctcgttggtccgcagcgaaggcagcgactgcagaagcgacggatagaggtttgcgtgggcgaggcgaatgtgatgggctaagttttgtcgttggcaagatgggctgagagcgaagctttgtgaagcgataccgtgatgggctactttttgtcgctgactagaaacgtcgtgatctggtgggcttattgtgagcaacacaagatcgcgtcctgtcggcccatggttttactgatttagacatgtattttggtccggatactctaaacgaaaaaaggaccagagcgctaatgttattgtccatcggcctcttgttgcagacgggcttaagaagagtcaaagtaggtaggagtagagcttaatctccgttccaattttgtgcacgtacaaaaaaaagatctccggaagagaaacacaacatggaaacataaattttgatgttaccctgtgcaaccctgcaacgcggcgctcgacccaggccccccggtcgcacgcatccgcgccccgtgcgcgcggctctcacgccatcgcgccgacgatttcgttccgcgaggcaacgacgtcggcgcggcacaccgggcacgtcgtccccctctgcagccacaggccgatgcactccgcgtggtagacgtgcccacacggccgcagccgccggcacggctgtcccccgccgtccgcgaccgcgaccgcgagcctccccttgcagatcgcgcagagcgccacgtcgtcgcccctcgcctccgtggcggcggcgacgtcgatgatgacgacctcctccttgttcagcaacccttggcgctccccgttgggatcgccggtggcgacctcgaaccgccggccgattaagcatcgcacggtccaggagatggcacagatcgcggcgatgagcgcgacgacggcgaggaatatctcgaggcctgacagatcaaccatcggcgagagttcgttttcgtagctaggtacgtgttgctggctcgatcgtcttggcgagtggtggaaccctgcacgcacgcgtacgtattaacgtataccagtacgtgctccggctccaggtacgtttgttactcctacttgtttcctatactgatttgtatttcgaaaaggtttgtttttttcccagatattactgcggagataattaaacagttcgtatcagaggagaaaatcgttgtggctgatctccacgtctttgttactcccacaaaaatatgaacaaattatggctcgcatggatgctagtagtatttctgcttgctttttgctcatggaaattattaaaggactaggcaactgggcatttaaggagtggcaactgacaagtatgggctaactcaaaggcgcagacataatcaattggaagagtgcttaaccacgagcatcagttagttttacactgaggcattggggacatggcattacttatctccaatcgtgtggtgttcatcagaaagaaactttggttaaagctttgctcctagggggttgtttattgtgcaaacacacaagtaggctatttgatggtgcaaaatattgtaagtgtatgtggatgggcagagcaaattattccctccgagaaatctcagttatcattcaagattgaccctgaggaccactagatagcagtagaaacataaaatctgaacaacactgagcgccattcagcactgtactacctctcccaaattcaacttccaccaacccaaaaaattcttctttactgcatcgtgacacggcatgcaacaccgtcagaaaaaacgaaaaacgtggcgataccctctgaatattcccgctttctatccccatggtaaagatctggaatagaaggccagaagtcagatctgcagttacagtctttacagagcctaaaattaactaaaattaaatggcatagccgcatgggcagttacagtctttgcattgagtcagagataaatgagagattagggtttacctagccccgcttcctatggtcggccaagtccttagcatctggggattacaaaagaaaactgccccgagtgagtggctcccactcgccttcctcgatccacccttttttgttgttcgaatccattggagcccacgaggtctttgcctcccattctcccaaaaccacttggattctcgaagattcagagcagggacctcaccttcgctgcagcttttttctttcaggcttttggcttcttggatccgtgcaggcgcgagaattcaatggcggttattggagcttcttggggtggtcactgaaggtacactggttagtgattactgagtactcatgactgtgcgagaatatacggtgaagttgtttgtttgtttgcaatttttgatgtttttcttcttcttggcaatcggctaaaacccaaaaccttcagaagaaaggcagagactttatcgtgttcttggctttgatccggttggaatcaatctcttcgaagacccgcaaactctcgccttggaatccgcgcatgttttacttcctgtctcaaccatcttgaatcgttcttggagcctgatgctgctctgcctcgcctttgcagtagaccagtagtacgcagtcttgcgatggagtcggcgacggagaaggtgaggaggacgccctcctcctgcctgctgctgcgcatctccgacatctgcaaggtgcgctccgtcggcgtcgcgccgaccgtccgcgaaaagcccaaggccgacggcagcgccaccggagagagcagcgaagacggcggcgcgcacctgaaagtccacccgcatcatgtgtccgaccatgagagcgtctctgaatgctcctctgctcgctgcgaggaagcgtttgttgagaggcttctcgacgcgatttctggcctcaaattgagttacgtgaaccttcagcaagctcttgtgccatatgatcctgaagagattacgatcgctgatgagcgattcacatcggagcttcaagagactgccgggttgaaggatctgtatgtcaacatgaacaaatggagaaatccaatgtaccagtgctatgtgggctctagaattcaggagcaacaaaagttggccgtggagttgcaagctggcatgtgcaagagagactctgagattgtgtgtttgcgagcggagttggatgaactggaaaggaagaacatggaactggaggagaagatcggtcaaagtgcgttacagaaagaaggaagttttgcaattgggatgggagtatcaacggatatgtttatggaattattcgagctttcgacaaagtctatccatgattttgcaaaactcgtcgtccgttggatgaaactttctcggtggaatcttggcaacttaacatccccaatagacaattctgttgtctatgataaaaggtctcacaagaattacgccgttgaggcctactttgcttgtatgatgttgatggggcacaaagaggagtacctttcgctggatgtcttcgattatgtaatgagtttcagtgatccttttgatgctcttatgaaggccccagactcttgttttgggagattctgtcgagaaaagtatctggccattttgcctcctagtatggaggattcattcttcggaaatttggatcatagatcatttgttgagaatggcggccatccaagaacaccattttatcaggcatttgtgacaatgtcaagatatgtatgggcgtccctaaccgtagcacgttctctgaatccaagagcagagatgttctatgtcaagggtggtactgaatttaggagtaaacacatggaatgtgttccatccaagataaccaaagaaggagacaaggtcagtgttgggtttacagtaatgccggggtttaagattggatgcactgtcatcagatgcagggtgtatctgtccatggtcaacgaaagaaacttctgaacacgtcatatagctacagaattaggtaagcagcatcagataaccagttagctctatatagcatttcttttgacttgagtttctgttgagctcctcttatattagaccaggggcataagctaatagatagattagtgtattaacttgctctgtaatacttgatgtaatatttaacattttcagtcgttcaggtctgttaagtcattgctttgttcgtgagtaaatggatcaattgaagaaggaaaatgtgtgacatgctccctgtataccattttatatggcaaaactgaacacataatattgttcaaattcttggggctacaacaccatctatgtatctaagcatgagtaaaaatatgtctttgattgtacaattgaagttcatctggcgaacaatttggcgaagatgttggtcggttttgggttctccaagcatgcgacatgtgcatatcttcctagcttgtcgacctgcctgggttcccctctagtgtccttcttgcaaactttgcaggtcttatccacccaaccttcctctacgtattccccgtcaactgcaagcagaattcagaaacagttaggactgtgcgatactcctactagtataatctttttggatcagaagtaattttaggattctgcaagtaaagcatatatgaggtagtaccatccacatatgacttgaagaaatccttgtaggtgccaccgatcttcctccgaagtgctccatacttcattgcaaatcaaattaacttgtcagaccatagaaaatccatgc

SEQ ID NO: 57440 - DNA, 1325 bp, Oryza sativa
ctgctgaaacgagaggactgcgacgccggggtgtgtttcaggcgcgagaggacggcgttgagcgttgcgtcgcgcgcttgcacgcttgtgtctggtcaggagcgatttgggcaacgtggctggttgcctgctggctggttcagatgatgtgtacaggaggtgatatttgtggatgaatgttctcctcgtgagagttggaaatactagtcagaaatttttggttgggcccagcctctcagatttgcataatcctccgaatttttatagggatttttatatgggctattgggctatctagctgcccaagtactacttgattctgataggaactcaattgtccggtacaagaaactgaattacaggttgagctttgcccacggctcacactcggcccatcgtccaagccgtgtgcaaaatacagtaattagacgtggttctttattactagtactctatcgttcaacaacatgatttccgctaagtacaacacatagagccccgagcagaccaggattttactctgactggagtgaattaagctctagggatcaaagcctatcatcaatagcacaatgcttagaatctgggtgttattagcgaccaagtcggaactaagtaatgatatgctcattaaggtggtctgtttcattagattatgaaaacctactgtgttaggtcgctgacactattccacgttgtagctgaacgtatggcgactatgcaagtagaggtagtagcatgaacaatgctggagtattgtcggttgactttgatgttcagattgagccatcgaagttggagtactccgtattttagaacattgattatttgaagctttggaagtgtggaaataaattgggccgaccgctgaacgtgctctcacattgccattataaatacaaagccttcgaaaaacaaacataaaaaaaaaaagccgagcaaaatggatggatcgatccacaacaatgcaacaaccatgtggacctcaggtgccgcaatctccatgatggcctggtagcaacgttgcctccccatcaccatggatgcagctttatttccccatcagattgcggtatcgacgcggagataatcatcatcatggtgccatgacacgtaccttttgtaggggggactcctgttttttcaaaccaaagtcccaagatgcaacaatgtccaatccttttctatcgtcgtcagggcataggtgcatttgtgcaaaaatggagtacgcaccagtgagagccgagccggccagtaggtcgagattctttccaaggacctcgcttaatgaacctactacggcaactgcaaatcttgttggatta

SEQ ID NO: 57441 - DNA, 2238 bp, Oryza sativa
ttttctagcaatattctcttcccactcaatcacaacccttcaccattcacttttcccacctatcttcactactcattcaatcacaaccctccaccattcacttctatctacttttttaataaccgtgtctaactctaaaatttcttatattctgggatggaggaagcaactaaaaatgtagagcgttgttctcatgtaataacaatctacatttgctccgtgatacatacattttaaatctattaacttattaaaggaacagaaaaaggagcatccatgttcgctctcacggcctagaaattatcatattaattgaagaaatagaaaaacagagtccatgtagaaatacaatttttaaatagttgaaattcggaattaaaaaataaggaatattgaaagaggagactagactccatatagaaatacaatttataaataactgaaattcggaattaaaaaataaagaatattagaagaagggtatagagtccatatagaaatacaattaagaaataatagaaatttggaattaaaaataagaaatacttatagaaatacaattaaaaaataatataaattcggaattaaaaataaggaatattagaaatagagtatagagtccatataggaatttaaaactaactaaaattcgaaataaacataataaaattaaaagtagagaatccatataagaataccatttagatgtaactgtaattcgaaattaaaaattaaagaatattgaaagatgagtttagagtccacatagaaatacaattagaaataataaaaattcagaattaaaaataaataatataggaagaagagcctagagtctatatagtaatacaatttacaaacaatgaaatttccgaattaaaaataagaaatattggaagacgagtctagaatccatataggaatacaatttagaaataactaaaatttgatattaaaaataattaataactatcacgtatatacaatacggtatgaatattacacaatggtagtttggtaaagttagtaaaaaatttaaaattatgtcatcattttaatatattttaataataaattgagaaaacatatatgctattatataatagaaaatataatcatgccagccgcgtaatctatgtgggccaccatgctagttcatgcatagtaagaaaaagagggttggctgacctcagggtgtccgtgtcgctcccaccctagggcgacactgacagggggcgacatggacggcgaccaaagatccgccgccacccatccttcctcctccttcggccttgcagccgcccgaaaggccaccggcaaagccgactggctccaaggactacgacgacggggcttcgtatttcccccgagggtgccattctggcaggtggttctgaggcgacccaagtggaagaggtggtgccgtcgcccagatccatgctctcctcggccggatccggtgaggagcagtgacacgatttggagcagcggcagaggtggccgctcatgctgctggatccggcgacaatagtttgcgtgggtcgacgcgatggtggagggtgctggcggcggggaagagggagcgaagtggaggcggctcctttggccgggtcaggagaggagccatggcagggaagagggtgtggaggcgacaagcccggatatcggcatgaaggggcacgactggcggtgggaggctggcgaggtgcatggagaacgtgacacaaaggctcatggctggcaagcgcgacgtggaagcgacgaggtcggcgtggaggaggcgatgaggtcggcatggaggctggagtggtgtggagcgtgctaaggtgggagcaccgcaaggctgggacagtgtggcggcgaggcttccacggtgggaggacgaaggcgacggcggtgcgaccaggcggcccgttgaagagacacgggtagcttggttgaggcggtgacgatggtagcaccatgaggtaggcgttgaatgctgttacgagctcctttccaggcgtcagtcttgttgtggcgatggctagccacattggacgggctagtgggaggagagaggatccatttttctctctcaccctctccctctataacccacccacaaggatggatctggagcacgccggaggttgagatgctactttgatggccaaccggcggcgaggcatcggcgcggtggcaagttgaaagggattagctggtggtgactgttgaatttgacagatacttaatcaa

SEQ ID NO: 57442 - DNA, 1725 bp, Oryza sativa
ttctcctcgcgccgcctctactcactttggctcaccgcccccctggatctggttctcagaaggcagacgagagagcagacgagaggggggagagttgcggagcagcggaaaggggtcgccaatcacgaccctatcttcgatccgtacggcgacggtcatcgcgacccccgcgaattgctccgtcgcggcgtcatcccgtgaaccaggtgacactgaggtgaacttcccttctctctcttcctcccccgttgtccctctccctcccctcctgtctgccaacaacagaatcattggggttctgatccagggcattatcccgatatcaaggtgcatacctaggaaggatcatgatctaagtgggtttgttttacgcgtacttgatcagttcatatgatcgattgttattactagtagttcatgacttcacgagatcagatattctcgacatatcaactaattttataaacggcacacatattactgtattgttagggggactgctttatacatacagattattcattactttactggtctggtctagtctggtctggtctggtatatcatggtgctactgtttctgagcggggtctggtctggaaatgtgctagtacccgggactgataaattatgtcctagaacattaccagttgctgcaactgcatgaataactgccaatttgtagtgctcgtatattggcaaacaatgaacagaacgccgttaaactcgccagacaagagcgcaatacaatttgaatccatccaaaagtcagtctcacccaaactcctgggcatctcttgttagttgtttcttccattctgtttagccaagcttacttagtttctttcaattgtgcagatacatgctggtggggttgtgttgattgggtggattgcagtaaacatatcaccttagtatgtcagaaaagcaggagtccatggcaaagcttctgcctgacgatgtgcttacaatcatcctccgttgtcttgcgccacatgaccttgccatgtctcgctgtgtctgcaaactctggtgcaccatcatcgacactcatcgcatgctgcgtgtggacctcctcccacactcagtaggcggcatattcatcaactttcatgatctaggcttgtcagaattcttcgcccgcccctcgacaggccccacaatatctggcaacatcaactatttgcctctcacatccatagttaggggccactgcaatgggctcctcttgctttacagccatatcagtcgtcccggcatgaagcagttttatgtggttaacccggctacaagacagtgggtgcaattgcctccacctccaaggcctgatattgggatcatgcacttagacaatttgtaccttgcctttgaccccaccttgtcgtcacactttgaggtatttcaaatcccctatgttgatgtcttccgccatcgctctgagttgaatcctgcaatagagggaatagaatggccaccgtcaacatgcgttctgcatgttttctcaacaaggacaaggcaatgggaggagagatcatttgttcgagaaggggaggctgcaggatctttggctatcatacgacgagatttccaaattttctgcacaatgctgtctactgtcggggagtactttatgtacgctgtcaaaccaactttgtaatgaggtagtctcactgataagtattataatttatttctttattaacaaatagtatcactcaattttat

SEQ ID NO: 57443 - DNA, 5900 bp, Oryza sativa
tagtagttgactaagctcggcaggaccatcatatattaagtcttatacggaattatatctcgtatatagaaggagttctggataaggaatgacgaatacagttctatatgaaaacgagaaggactactcgaattgtatccatattggtctccctagttctacttggacaaaggggtatctatgggtataaatacaagaccccttaataggaggggagacacaacaacagatagacacacaatatacaagccaacatatgccgtcagacatcaacattagggttaagcctagaaagaccaacaagagggatttagcgtcaaatctgatctcaagagctcatactcgaggaggaagactaccatgtcgtcaactatgtgttggttatccatgccgccaagttgacgacagctcgataggttatcccaattattgtacttgtgtgatccagatgaataaagagtaacaccggcttcggccgacaggagtagggctattacctgtcaaataaggggtccgaacctgtataaaaatccttgtttccatctcttttacctcaatctcgcataccctggtaccaactatccctatttcatgcaaatactgtagtcgagacctcaaacgtcgacagtttagttagggtgaaatttactctggaaatccgctcgattttttttagaaaatcatgagctacaattaggagtccgactttcgtctcaagttaacatacaagtttttttaaaagatatttcttatacggctccttttgtattttcaaaagcgaacaaacataaaaactaacttaaacacgaatctatatttctaaaaatgaacgaaattaaaaaccgactcaaacaaggataacgtaccttgtattggcaaaaacattttcaacttttataatagtcgagattaataaacagataggcgtgaacttagaaagggtctcatcttttcgcttatatttatacttatcagccaaaatttgaatttttgacgttaaatttggagttgattttaggggtttttcatcaaagtttatttttcagactttgtttttagatcgctaagaatgcatatataaaatttttattcataaattattcttcaaatgcaaatatgccgtaaaacgatgggtccacaaggtttggattgatgaatactactccctccatcttcttttgatagtcatatttctaaatctaaaaaaattatttttgataggcatatttcaatccaacaacctatcctcttaatgactttctcggatttaatgcgtgactctacattcttccacacaagattggctacatgggcatcgagaaatgtaaatattaatgaatcgcttgtttacaaggaataactggtagcatatttaaatggatgataagtagaattactttggtctgtgtgccaagatgaaatatgactatagtttaagtatgcaatgcggtagtacgtacattgcatcggtaccacactaagcgcgcattcaataagcatcaatcaaactgtcaaaaaaaaagcatcaatcaaagactccaaattaggtgcttgtcaaattacggtttgattaatgattaatccatgcaccacaatgtctcggatgctcaactaacttgacacgtcgtcatatacttgtactgaagtcttcaactctacatcacgtacaacagtagtggtgtagtaccattggacactactacatcctacagataagaggcagagccaatagcgaagaaatactactgtttgactccattagatttgtcattaatattatcatttatcaacaccactatttagtctttaccatagttgatttctacagtactagtagtaccctgttttgcctggattagcctctcacatttcatactagctactgtagtatagtaccataaatgtaaagagacagaagaacagcatagtatcccaggtctggataacactatttatcatacccaattttaggatcattaacaggctagagcaaaccaagattctcaagacgacagctcttggcacgatgggactcattggattcaccatgcaagacaagagttgcattgcattgcactagcacgagtgagcttgagactgagctcttccgctacatcttgatgtccgcgaggttggcccagatatgctcgaacacgtcgacgatgaggtcgtggtactcggcggcgttgagcgacaggtagcacgccaggaggtcctccaggtcggcggcggtgcggatgccgttctcggcgatcatctcctccatggactcccggaagtccctcctcgggtcccgcgacgacttcaccaccgcgaagctctccgccaggggcggcttcgtcgtcggcgccggcgagcgcgccgccgcgggtggtggtggtggtggtggctttgacttcttggccacgatacgcggggtgttggcgcgcgtcttgaggcggcgcgcggatgacaccgaccgcctcggcttgctctgttcgaggagggtagtgggttttttagccgacgcgcgtctcacgacgtcgatgtgtttctcctccagatcgcagccgtcgagctctctcctcgccggcttggtcacgataggcgggagcaccttgtcgggcctcttctcggtccgcaggtcgatgatgatgtccgtggcggaggtgatcaccttgccgtcgagctcgtcacacgcggcgacggcgaccgtcggcttcttgaattccacctcttcctcttcctcgtcatcgtcgtcgtcattgtagccgacgaacttgtcgcggcggcacggtggggtgtcgggcgcctcgaccacgacgagctccggcttgcgcccgcaccggcagccggtggacaccggcgaggacaggacgctgctgccgctgacggacggcgccagcttgacggaccgccgcctgtgcctgcgcctggacttcctcggcggcgacagctgaagaggagggaattgcgtgtcggagcacttgggatggagcggcgaccccacgagcaggtcgccggcccgcggcgtgtagtagtaggacgccctgtgcgggagcgacaacgcgccgtgcctgggcgtgttcggcagcggccggcacgccctccccgcccgcgacacggccaccgaagactgcgtgaccaccccaccgtggctggccccgccgccgccagcgcccgcacctccccgggcggcgcgcatgtcgcggagcttgaagaaccacgcgttcgggatcatgtcggacagcctgaacttgtgcctccccatggcgccgcgctgcgctctgagctccacagaatgcgcggctgctcgagtataagaagagcaagaagaacaaagctttgtgtgggctgcgtttggttgcttgctgctgctgctgcgcagcttgctctgtacgaggaggagcagaggcgagcagaggaggagatgcgcggagcagaaaagggcgggtaatagagtgggggatcggcgaggcggagaggaggggacgtgaggcgccttttgtcctcgctcctctctatgcggcgtgggcccccacctcgcatggcttcactctctcagctctcatcagtgagacaacgccacggtgaggcctcctcttccattacagattatttcaacagtactgtacttactgctgctgcctgtatttttatctgaaaatccctgtaaatctctcgaagttttggttgacatgagaggctaaaaaatgtttcaagggaggtcggggataggatgataggatggaaagcgcaggtattgttggtcggagaagaatgggcctacgctgcactgcacgtaggatatactactacagtagacaggatatgatatgaaatctgaagaaatttcgcttcgctcgcttgtggattgtggttacgtcctttgcctggctgccttcaattcttttctttctttctcatctcatcaggcctttaattacgcgtcgaaaagcatccttgtccgggacctcttgtttaatccttttatttccatcacccctgggcgagacaagcaacagtactactactggtggtggtcgctggctcggagcttgagcggtcagtctgcgagatttgccttcgccgcttgcgttcacaacaaaaactccgagactccgagagggtgtgtttagttcacacaaaaaattagaattttgattgaaattagaacgatgtgatgaaaaagttaaaagtttatgtgtgtaaaaaaaattttatttgataaaaaagtctaaaagtttgaaaaaaaagttgagaattaaaccacgccagaggctctaaatttaagatgccacgcgcagcttttcgggccaaggccaatggtcaaatcttgcgctgcaatgcaaagcaccgaaacgcaatgcagcgagcctgatcggccgcacgcatggcggcttatcgcgaaagccacacacacgcaaaaccaaaccgtaatcctgtcatgacgcagtactaaacttgtacttgcatgttagattagtgtggttgtgtggcacttgtaaagagtcaactggcaagtggcaacccaaaagagggacgtgggtgaaggtaccggagcttttgatcgtaaaaaccgagtcctcgatcggcatgcttaacacgggagatggatccagcaccggcaccaaacggtgtcgataggattgatggctgcgtgcttagtgctcggcgatctcagaaaggtgctcgttattgtagactagagtgtggtcctaactccggccctgaggcgggtactcgcttcgcgcgcgcgtgcatcatgctgcagagggcagagcccctctgccccgtggacgagacaaacacaaggatgcaaaaacgttgatcaaaaccatattattattttttttagtttttcacacgcctgcttaattaacccatatgcattgcgagtgcgacacacagcgacagtcttagccaacaagtgcaatataaatacttgaactaactcattctagcgccggcaatataatactgcaaccggtagatgagatgagatgaggatggcccgcgttttgcccagcacggaatcgcgcttgcgcgcacggccggagggcgagagggcaccagcgatgacgcctcatttagcgcgcacggagcgcataatataggtacttaagccgcacggttcgtcgtcgccgtggccccgcgcgcgcgcttaattttttcgcggcctgtcgggcgttgcgcccgccgggcgagcggcatcgccgactccgtctccacctactcggctacacgtccttcccgatcgatttgttaaccgcgcggaaacaaaagcgcgccagcatcttggttcccttgggccatgcgtggtgacactatttgcttgccttcttttccgggctcctagttacctaaactgcttattatcaaatgttaagagtgtctctctcactagccatgcaggcaaatggagtgcgtatcagctggctggcttcctttgacttggaggcatttccgtgctagttgcagttagccaacaatggatgggctcagctcaaagaaaaaaaaaactacgaaagggctaacccttcacaagttgtgtctgtatcgtggatggaatgatgatacgttgatcttgtttgaaactgaagcagataaagattttttagagaaaaggccgaaaggcccagcttactatcaagcataagagtgcagatacaagggtaaacgctggggaagccagcttgaaatgatgtgctgaaaactcaacttcacttctattaaggtgctgctggcacagcgctaacaagccaggaaggaactcacaaagaaccacacagcaaaaattaacgcactagtttggtcctgacgcccgaatactggcaagcaatgagtccttcagcccatccacttcgaccttcagcttctccggcagcagccctctctactggatcaaaaacgaaacagct

SEQ ID NO: 57444 - DNA, 4774 bp, Oryza sativa
aggcaaaaactcaaactacctgtcatcaccgccacccgtgcggtgctctcccccacgattaatgaagaagtacaggaagctaagtccaagaaaagctgtaaaaataagccttctaggacacttgacctcacggcttcgttgccttgacaaaggagggcatgattaatgagcaaacctgggtacaattatctccagaagaggtagaagaaaacgagcagaaccagagcaaccaaaatctggtccctgaaagaaacagtcttgggatggtcaatgcatcttgcgtgtcgaccaacatcaggaagacgcaggtgacccggtgagtacaagagttccagggaaatgaacgggtttggttcatcagtcagctcaaatagtatctcaccaacagcattcttgaactccccattggaccattcctgagttcgcacatagcaaaactgtgtcacattccacacatggaaggatcaaactgtgcatacagcaagcaccactgcccattgctcatattacagtcttgaaagatggatagaaaattagaatttagcctacaaaggctacatggattggattgatcccatatatggcaccgaatacttacgaaaatgtactgacaaggcagacctggggtaaggattcaaggaccaccatgtcaatgaaagtatgagacggtgatagtatataaaggatgatgcaaatgttcagtgcgtataagaaaatttcaattcattggttaagagttcatttagcaagttctgagtagaaaaaaaaaggactcttagtaagtttccgttagaattacaataagtaatatggtaataagcaatggttctgttgatacctgaatctgcttgccgattgtaacaagcatagagcctgccggcaaactgaagaaagttgacccgctctgattccgcagacaaatttcctggtctcgtccagagaggtggatgctcaaagcgtacgagtttggaggattggtgctgccaaactcactccaatgagttttcaacttgttacagttatatagtgtcagacatagtattgacgcggcccctgtagacagagcagagtcttcaggattcctggcgttatcagatagaactctcataacgcattgtgcaagatcctccattttggatgcaacaatctccatcttttccctaggaagtgaaggatctgatgtaagtacacaaaaattccattatgaaagtcccaatggggttattgtagaacaggcccgttcgcatatccattgaattttcgacattcatggctatatttatttggtgtattttgagtttttgacaactgcgctaagaatcagcggaaatcccactcaggctaaagaaacagaatattatggttattattgttccactgatattttcttccgaaacatcaaaattggaacaaaataagtgatggaacggcatgttgtatagagtttgacaatgactccacaagacagcatccacgccttcaaaagaaaaccacacaacatttcttgtcgcatacttgcatgggctgtgcctgtacccctgcaacatttcaggtgccagcctttttctctagctcgctctctacatctaaatgggccttccattccttgcaagttgcaacggttaccggaggctctggggtactcaaaacagatgtacacagttccgtaccctctacagactacagctcattccaattgacatcgacgagagaacggtagcaagtgagatattcttcagtccagtccagtggagagtagttcaatagagctaacaaaaacgcaagtatgaccaaactgatccttttgcataattttaagtgcgcacgtattttatccgatcaaaatcggcttctaaaaccgctcaaattctgaaactctcttcaagtatgcacctacgtttgatgtggacgaggcgagaaaaggacaaaacttactacatatagcggcataaaaagcgcaggcggaatgtggcgtacgtgtatacctcaacacctggtacgtcgagccgggcagcgccgcgtcgagcacccggtcgtcatccgagctcgccgtcgccggccggaaccagtagaactcctcaccggccacccgatccctcctccggaaccacctcccgagctcccgcttcacctcctcgggcgcccggaacaccgcctccgccgcctccacggccgcgcgcacctcgccggcatcgaccgcgccgcccacgcggaacgcgccggactccgcggcggcgccgacagccgtccgcgcggcgtccgggtcggggcccgacaggagggcccccgcgaggacgtccggggtcgggggcggcgcggggtagcggaacgagcgcctgctgctcatcttgggcggcagggcgaggtccgggacgcggagggaggcctcgaggaactcggcgaggacgagctcgtcggccgccgcggagcgcgcgccgcgcgccgtccggatcggggtcggcggcggcgcgcgcgcgggggcgcggacgcggggccgccgcggcgccctggacgtcgccgtcatgccgccggccgatcggcagatcaactcggctgcgagcccgcgacgcgacgtgctctcttgaggttgggtggtggttgcgtgggtgtaaagaaaaacgtggggacgggaggtgaccgtgggatgcgctggtggacggtccagatggagtccgtggtttggaatcgtgttaaattggtgggaaagtggaggcacgacggggcaggctggctggctgacgacttgacaagagagatgggaggcagtatggcgcaaaggtggcggtggccgactgaccggtggggtcacaggctcacagcctgaggcaatgtttggctaaattggaaatggaaatgatttcccacccacaaaaaggcatcttatatggtgtctgattcaagttggacggccggatcagattcacaatccatcgctatcgtcggattccgcgagataaactgacataagccagacaaatctggacaaaaaatgtaaaattcagttacagttttttaaaaagcttgaaccaaaagccaagcggtttggcccgatcagcagagtttcgtgcacaaagatggcctttagagttctggattttggtcaggaacgtacattgagcatccattgtgtttcacttggctgaatataaagaaaaagtaacatactcgggatttaggagaacatacgatgttgctctcacaagcatgagcaggaacagaaaaactcacacggcacataacgtctgacacggcgtgagtaggaacagaacgaatcgaataaatggtaaaccacatttagtaaagatgaaaccagtaacagcagatccgatatttgaaaaagaacaggttggtcctagataaagttcaacaccctggtatcatgctagatttagggaaacgactgaaaaaaggtttatcactccggagacaatcaggtgcgagcaacgttgggggcaggagcagcagctccaccaggagcgggagcgccaccacctggacgagggccttggggcctatcctcctgcaaaatagcggcaactagtttagaaacatataatctcacgattaagatcgctccaaaataaatagacttgagaacaaaaaaatatggatcaaaataacaaacaatagagcccatcaataacagcagcctaaacacatcaatcgcaactacaccatgcgctcctcttaatcactttctaggatgagtggacatatttgcagatatcttaatgtggttttgatacataggccagccactttgatactactatactatcacaaacgcatctgaattctggatgcaacaaagagggacacaaacccactagcaagaagctagatactgtaagcattggcacaaaacaatcagcattccataattagaacaggttaacacaaattaaggttgtcttaaagaacaacagactagctagcttacaatctactgaattcgatgaaaattgattacttgatgttagggccattttggattgaggccctaacaaaattttggtagctggcttttttgtaggatatcatacatatcccaacataaatgttacacataaaccatcagccaattgtgaaaatgatgctgtgaatctcaaggacctgtttatcccacaggcaacatgtagtatttgccatcagggaagacatgcagttccaaaaaagaacagtggatttcagattatagaagctggctgaatgagtatacttccttaagtatgccggtacatttgactaaaagctaaatggtaaacttcatagaatcagcacactaaagaattttaatttttcagcgtgcttgaaagatattagaccatatgtgcagataagagatatctacaaatactgtgcaaaatcattacgtctattagtatatcagactttgtttcttaaatctgcagtaacagataaaggaaatcgttccgatcatgatatactaattacactatcaattaagcactagatataatagttaagaggcggggatcaggtaccctgcggcggaagcgttccggaggcctgcggtccctccggttctcacgggagcggacacggacgatgtgagcatggattgcacaggacacacagtgatgcaccttggcgtaaagcttggggagaacgtatcctgcaacgagatagttgtattgtatgccatcaattcaacaatatcaagatagaataaaaatttccagcagtatgcaaatcgccagtgtgttatcggcgatcacaaatccaacctctactacgatttcgcatcacatgg

SEQ ID NO: 57445 - DNA, 1704 bp, Oryza sativa
tattttgaaacaaattaaacttgagtggtagaaatatgttcattttgagactttgggcacctttgtatacatttatacgcctcaccataaaccattcatggctgggaatggtttatgaaccgatctcctgtagacgctaatgttatcagatctccgcatggatcatgaactactcgcacttataattaattttttttgcggggaattaattaattcgttcttgcccccgtcttctgtgtcaagaaatcaagatggtgaccatgacgggccctttaatttgccatgtgagcccgcgactgtgaccatctgattctgaatcaatttttgttggtctaatgccagtcgtatcccgtatccgtttgtaaatcactttcgacggaaatacaaatactactcaaaattcttcgacatttatattgcatttctagctggtatctaataggaaattagagaaaaaatcttacaaattttgaaccatcgatttaacttatgattcatacactaggccggctcctttaattaactcagacaactcgaccaactcacgtgaccctccgatagtaaagacaaagcgacgactctggttagggatttagatcaggctagggagggaggtagtgggtttagaaaagccaagtgatggaggctataggagagccgagagtggtgacatgttgatggcaccaccaaagccataaaatgaaagagggtggtggatagtaaaggtagtggggtagtcaagaaggcaatagtaggccacgagtacaaacggtacagccagtgacatccttgaggtcacatgctcgtgtgctgctagccgctactgcaagcaccaccacgacgtccctccagcatcgagctcaccagatccaggatgagcaacgatagagctaaggaggtggctacgagctcaaggaaggaggagcagtgagtgtcgccgatagtgtgggctctgaagaggacgacagtctcctcggtgaagaagccattggcgacgaagtggcggagcatgtcatcgagggaggagaagcgtgcgaaaaggtcaacctcccatgcgttggactagagtcgcggcagccaagcacaacatcataagcggcgcaacaagggacaacaacagagtcctacaccatgagcgacagcatgtcggtgcaggagatgacggcggggtaggcagtcttgacggcaccatgaatccctaataggcgccagggccaggatgaatcgactcggcatgagggccgtgacatcaccatcaaccccggccaccaaaactatggacacacctctacctccccaacctcgacagctgcggctgcaagaggaagttgatccccatcatcctgtacctccataacggtaggctcgtcattggctcggttgaggatgcgctcgagcacgagctcgccaaccgcctctacaccctggcacgcgtcctcgtgttgtccttcaattactgcctcgcgctagagcaccccatccctgcctgctacgatgacgcgtggtctacaccgcagtcgccgtttgccatcagagccacgagcgccgacccgaggtggtgggccttcgtcctcggtacaatgctgttgagaaagatggaaaagaggagtgaggagggggaagataaagagtctctgattatgtgggtcccaccagtcatgtcagcaaataatgcttcccacaccatcaaaaaagttgattttt

SEQ ID NO: 57446 - DNA, 3089 bp, Oryza sativa
aatgaatttgtatatatggttttgaaaacctctagaaataagaacgtgcatgtacgctcacctgaaaattttgtgcgctcacaccatgtgctacatttgtcttttctttcaagttatttattccacccatatatactgcaatactctctccgtacaaaaatataaacttattattaaataagatattttctagtacagtaaatctgaatagatactgggaaatattccatttaatattatgttgggttatttcggaagggagggagtacttgtcatcccgaaattggcagccaaactggtgagaaaatagcctggaattggacaaacattgctgtatgtctttcatccatccaaaaattacgtacgtgtgtaaagaaccattaagcactagctggcatcctgggtggcactgaaaaccgaagacgctagctgtaattttgtactccaggttgcgtagcagtaaggtagtcacacacaagagttaaaaatgcattggtccagtggttgcggcaggcttcgttttcaacagcatttcattcccttgacatgagcagaaacacccgcaggaacacgaggggagggctacagggcgccgagggccaggccaaccgatcgagtcaacctttcaacactcgccaacatttcttcccctcctgcccatttactcgctaccaattgtacaagctgcccatccccctcattactcccttgccttttaagcactctttccttccttacaattccaaactttacacttctataccctcttctctcctccggccctatctacaactctacatctcctcctcctttctttttgttcttgttgtccatctccatctcgtcatacacctcccaagcacgggagtatgcctcaatgtccacagagaggtaagtggccacctagaaatgatttcagttgaattctttaccttttgtcccctttttgtctcttggttctttttgaaattatgcttctctctttctgtttcttgatttttttctctaaagaatcggagaggttttctgttccttttgcttggaaggatagcatgtaccttttgtagttcgtggttaaaacttgaaatcttgcattgtggtttgcatctggtccctctcctgaatccatgcaagaaaccctaaaaaccttcttcggccctttccaatttccgccagggaaagactcgatgagatcggcaagaagatcaagcgagagccggacaccgccggcgtcgtagtcgccgccgtcgcaggcaccggcaccggtacagccacgccgatcgagcaccgcgtcccccatcgcctcggcctcggcggcgccgtgaacaccgtgaccccgtgcgccgcgtgcaagctcctccgccggcgctgcgcgcaggagtgccccttcgccccctacttctcgccgcacgagccccacaagttcgccgccgtccacaaggtcttcggcgccagcaacgtctccaagatgctcctggtacgataccattacaggtcaaagcattccttaaattgtacctttcgctagcttgtgcattaatggcttcgtcggtgcaatgcggtttcaggaggtcggcgaggcggagagagccgacgcggcgagcagcctggtgtacgaggcgaatctgcggctgcgcgaccccgtgtacggctgcatgggcgccatctcgatgctgcagcagcaggtgaacgcgctggaggccgagctggaagcggtcagggccgagatcttcaagcgcaggtaccggcaggccggcgccgccaccggcctcatggacgacgtccaagtccatatcaccgccggcttcgccgctcctcctcctcctccatcgatgcacgcgagggacgtggtgtcagtggcggacgccggcgggcaagggcaagagttggccggagcgccggtgatctcgtcggcgtctccgccggtgtatcctgccgggcagccatcaacaagtactactgactacagctccctcaacacaagtgagcatgctgcatactttggttgacttgcatggatttatctaacattttggtgtgatcacaattaagccggggaaaataagatctgtgtgcgagattagttatatatatgttctctagaaatagatatagttgtggataccttgggtgaagaaaagaatttgtccaatggatgtatcaatccttaattttattgtattgtccattgtgattgggcggttgatttaattaattgagtgcgtgctaaatgatcgaattagctcaaggaagttttcttcggttccggaatgaagtagtggttgtagtaagtgaaattgaactaaaaaacacatctgcgtgtatatatgtacatatatagtccaagtgcaggttaatttcagagttagttatgcgtgtactgaataagatagatcgttttcgtcctacgtattttttcacgaattttacaatgattgatatgaatttgcgtgcaggctagaatgatctggtaccagagtacctgcagagcatgcgtgatccttgaactgattattactactagattggtgacgagacctaaaagaataggtcattcgctgatgtacacgtatatatagtgacatctccttggatattatttgcttgaatgcatcaactaattgattggttcttactattcgaaaaataagtcagcttgatacttacatagtcacgtcattgtcatttctcaacgttctagccttgttcacataatttggcaattgatcattgttctgaaataggttacactgtacaaatacatgcacagaacttatatgaaggaaacaggacaatgaaactactgtaggtcgatcatatatgcatgtccacattatataactgttactctcgcttgtgcaatgtagtatatcattcgatgtgctctgcacaatatccttttgtgtaagttcgtgtattttttttaaccagcagatcgtcgaaagatttctttttacatatccgtctcgtttaaacgaagcatttctttggtgcaaaccccctctctctctctctctctctctctctctctctctctctaagatgatgttgattggtgcattttttttaaatctggaaaagtgtttttt

SEQ ID NO: 57447 - DNA, 2363 bp, Oryza sativa
ccagatcgctgccacgtagtcaatccgaactcctccacgctgcactcccttgcacgatccgcgtgctcctgctccaggccagtaacacgccgccacgtcgcgcctcagcacgcgagagcgcgcgctccaccgcgtgaatcccgcgctcatctgcacgcatccagtccgaagcctccacgcgtcccaccgagccgctcccacgcgcgctcgctaaatcgcacgtgggtcccacgcgtacggctcctgcctccgagccgtgcaaaacagcgtggaccccgtgcctgcgcgcgccgaattgcttgtcgccgcgtgtccgcgcatggtgccgatgccgtgggccgtcgtcttctcttgggcctgctcggcctggcctccctgccagccaagcactcgggcctagagctagggatgaaaacggagcggatacggatggataatgctcataccatattcgttttcatatttttttaccggatacgaaaacgaatacggatagctcgaatacggaaacaaatacggattatctcgaatacgaataagaatcgaatatgatcggacatgaatacggaaacaattttttctcagaacacgaaaaccaactcaacttctaatagaaacaaatatcaacatatataattagctcattttatataaaatgaggtataatttataaatattttttaaaatttaaataatattaatagtatggactagtgttaagagataaactactattaaaatctataaagatatattgaaggttatagagttagaaagatatggggtatgtctcatgggtcctgcggatatccgaatagcactgttcaccggatatccgaattattatccgtatccgatggaaaccctggtaccatattcgtattcatatccgggagaaaatatccgtattcgtatccatatccgaactatccgagaattatctgatccgaaaggtatccgtatccgtttttgtccagaacggacggaaactatccgcttagttttcatccctacctggagccaatcaggcgttggcttggcttccgtcccaacagagcccatgtgcaagctagctagccaatcagctagctgcacttgccatctcatgcacacgccagcgcatgcctgcatgctacagtacttagtactgtagctcctcttctattctccattttcttcgtgaacccggcacttgcacacttgaccttgtgaagcccgttgtgaagtcttcccgacacggtgttcgtccaccgtgcgtcaccttgatctcaaccttgtcacacggattcgtcgatcgttctggacctcaactccccctgagtctagtcccaatccgccgtctacccaggctgaccatcagggatcatgacgtcagtcccaccttgtcacatggcctcttgaccgtgctagacctctgctcctccctgagtatagtcccggtcctcgccattgaccgcggttgacttcgatcacctgcacacacgtaaatcaaatatccgattctgggcacagatatcgtaacctgacctacgttagtcataagcattgtcgcctaaaatcgccaacaatccaaaccaaatttcttactcaaaccaactcatggttaaatatttcgttgccaattttccatcacgaataaaccaaaatcacacttggttttacatagatcatgcatacgtcattagtccatgatacgtggttttgtcaggcttaaacgggcattatcaggttcgtgcgaacagaactaattccatcatgtaccataatccatttcgttatcttctgatggtaggtgattgctactagtagtactattttctagtactcctgctcgagatatcaatcaatagaaattaggtgcaagcctttagtgcaagactagtacatctctgaattctaatgcaccgataatagccatgcataggtgcagaccataccgtcctcttctcccaacccaaccgattgatctgacagtgctcttgcaacaaactcaaaatgttcagggtagttaacaacatgatctcctggctgtcagtatgcaggggatggtcctttttgctgacatgctctccatatgaccaaatcaacaagtataattcaagtctgcatattactagccagtaacttttgctgatggagtagtttatatgtagttatgtatagtactgatcagtattcagtactagtacagtagtaaagtttctatgatccgcctgtaagacacatcaaagagatcagaaaagagtacagattgaacaacctgctactctgctagtagtgctgcactctgctctgcaccgtcgccgacgtcgttctccagtccgctgttcactggatccaaaatgacgagtttcgctattgca

SEQ ID NO: 57448 - DNA, 5571 bp, Oryza sativa
tcctgcagcccatcatagcctttcctgctaagaacttcaggagcaacataagctggagttccacatgtagtatgcaggagaccatcttgcctcttggactcagccagggcacttaaaccaaaatctgagactttaaggttttcattctcatccaggagcagattttcaggctttaagtcacgatgataaacacctcgactatggcaatagtcaactgcattgatcaattggtggaaatatctcctcgcagaatcctcactgagctttccctccttagcaattttgttgaaaagctcaccacctttagcatactccagaacaaaataaatcttgctcttgctagccataacctcaaataactgaagaacatttggatgtttcaccaatctcataattgaaatctccctctttatttgctccattagcccaactttcatgaccttatccttgttgatcatctttatggcaacagcttggccggtagtaagatttcgtgcataatacacctttgcaaatgttccttgtcctaattgcttcccaacctcataacggcccatcaagattgacctcccatccatcatatcaagttattggaacacaacaaaatgagcaaacaccaccacaccacttctatagaagtatctacaaagtataggtaatgaatgcagcagatgttatccgtcgtcgtcaatgtgatgatcaacaaacttggagtccttcaatctactatgcttcaaaacacggaaaagcagcacggtatcactatgcagcacattcacatgaaggtccagcaacatcggcttgatccaagctgggatcttgtttgcacgaaatattaacttcctgtcgtgcaagcacatctttctgcattcccaagtcctctgcctgttaagagctgtcattagaaagaacaaactgaattttagtacacctacacaggaaatgtaatccaaatccaaatggatgttaaaatctcaaatgctacacggtaatttagtactgttataagagccaccggcaaacatcacaggtatgtcacccccaatttcattatatgacttcagcaccaacccagacagactatcggacggatgccctaatgctgtcaatcaacctaaaaatgcgggaagcacatatcggcgatcaaagtacacgttgaacgattggattgcgacgaaatgtccccatttggattctgaaaaataaaagtagtggcgaattcctacttgatgttaacagagactacgttctgacagatcatcagttgcctacactcaataggaaacactaaatcgcacaaattccacccagtcgcagtggaatcgaaatctgacgacaagcagatctcttcgggggggagaaggaccatacctgatcaggaactggacgaagacgggcagcgaaccgcagacgaacccatctgaaccgatcaggcacgacctcgcggacagcaaatggacgccgcttcctctccgccgcgggagcttcctccgttctagtttatgctgctccgcctgcccggcgctctcagatttcttcctcacggttggcgccgaacttttgtggcttgacccctcgggatcttccgattccgctccgctctcagcgcgaggttatacgacggcgcgccgcgcgctcccccactactaggaggcaggcaggtagtgcgcggccgtctagctgtcgcggtgaggaaacgggtggcttttctcacgtttttgcccctaatctcgactgattccacgggattctgggggtggttgtgctgcggatgcgtaggctttggacaggtaaatatcgctggctgcctggcccatggcccaattgtgagattttcgctgggcttctcccagaacggaaacggagtacgaggaagcaaaaaagatgagaggttttggccaatgactgttgctgtatgctgttcaaactatcaattcttgccgttggggtccgggtattactccaatcaggtcgcaaaaagagcgatggcagcaaggtaaatcatccggaatacaagggtcgaggccgaggtcgttaacggctggttcgtcggaatgcgtgagtaaacgaaagcgcgaccctcgacgctgacgaggaacggacgacgatggggggagaagagcgcgagctgtcgcgcgttccaccgttcgtggcttccacgccacctcaacggacgaccgcgagaggcccgcgggcgctttcacgtaactcgcgagagggcagagggcggtgtcgcgctgggcggacaagagggcgccgcgtgccgggtcgctaatacgagcgtcacgtctgccccgccgccggttagtgcgtcatccgtgctctttcagtggcggaacggctcctagcctcctacgctttcgttggttggcttgtttgttgttttttttttccctcgtcgtatctaatgtatcatctcccaccaaggccagaaaaaaaaaaagcaggcaacggctctgccatctattggcgttgcttgttgccatctcttgttgtatagctgtgacgttttgtcgtgtgcctctctatagccactaccttgatgcgtcgtgtgtactcgtatagtatgctaccacgaaccatcgtcacaattcgtctgtggccatccgacctatttgtggtaggaaaacagggttcgtcggatcgtggccatggggagagaaaggccatcaaggcatcaacctcttctagatagtaaatgggctgaaaatgcaaggacatcagatccgtgtatcgcacgcgataggatttagcccatcaaagtaatccttatccgcaggaataagttcaacagccgtccctcaacttcgcgtcgggttatctatagccctcaactatcacaaaccgtgcaaaaaaaaaaaagtcccgagcagtatcgatccaattcttcttcggtttcgctaacgtggaatatatgggccccatatgtaagtgagaaggaaatatgtggggtccgcatctcttttctcttcttttttctttcttctcctttcttctcttcttgggcgaggctggagactggtgcatagcggtcaggggcggcgagcgagctgccaccgtgggatggcgtcgggggagctatcgctgccaccgccatcctctgtgacaacagctctaccgaccttcgcgagctctctcacaaagatgtcgaggtctacgttgacatcgtccgcagccacagcagcgccgcctcggcttgcgttgggatgggacggaggaggtcgacgaagaacccgccgccgaggccgagggcgtgccgatgttgcggcctgctcctctgcagcgatagggagcggcccctcggcgaccatgagttctccaccgtcgtgagctaactcgcatccgttgtctacctcagcgtcttcgcgcaccctgacgtccccgcaaccaccaccaacgacgatgaccagcgcggctcccgctaccgccaaggccaaggctacgctgatgcatggtgttgggatgatggaggctaaggccgtgccgttgcatggaatgatgcgaatcgcaacaaagtgccacccgccgccgctctgccctcagccagcggcggcctcccagccttccagctcgctgagaaagagaagagaaagagaagagaaaaaaggatatgcggaccccatattttttccttctcacttacatgtggggtccatgtataccacgtcagcaaaacaggagaaaaattaggtcaatactgctcgggaccttttttatttttttggcacggtttgtgatagtttagatgtagtgatttccagtgaacttattcctatcatcaatagttgggctgggtggtaccagcaacattgatgggccttcaaatgtgagggtctcgtacaagtacacaccaaacagcaacactcatttcttcgttctccaaacgtaaaacactaacatgattgaacgtcgagcacttcacaatcataccctaaacaaacacttccaactgttccatgctgctagaagaaaccaacacatgtcatgtactcatgtatgctgttgaagcccggtaagaataatgctgaaatttaacataaatggcctataacgactatcatttctcacaaagatacaaatgggatttcgaagatccaaatccaaatggacaaggaggaagaaccaaaacatatcaacagattgcctggacacgtgcagcgagcaactgcctcgtgctccccttctcgcttccctttgcagcacgcgccgtacaaccccatgccaccgctcctcgtggtagggccgcgcaaattccagagcccagcagcccagtaggccatcatcacgcgcgcctccacccgattcgcgcgcgggcgcggcaacagtccacactgccactgtgctcccggcccgcatcgcaataatgaaacggccccatgcgcgacggccgcttcgatcgggcagcagtgcactgctgtactgtgctagtacctcggcccggcacgcccaccggccaccgcgcgccaccctcgcgcaaatcgcttcgccaccggagcgtcaccccgccgtgcacgctctgcccgtcatggcatgtagagccggttgccgcacttgcaccgccacgcctccgggtagtactcggtggtgaccgggacgccgggcggcacggcgacgtgcaccgggtagcacgggacgcaggcgccgcacttggccgtgcaccgcggcgggtacgaccccgggccctccgccagcagccgccgccatcgacgcccgctcgagctgtgatcctgctacaacacaaaacacaatggatttacgtatcaccgtccttcaacctttcaccgttttcacgtatcgctgtgacgcgcggcgtgccggcgtgctacgtttggatgtactactacgcatcgatcggcagagacgtatggtcaaaaggcgatgggaccgccggcgttgaacggctgtcggagaaggacgccagctttcatggccgtgactgtgcgcgctaatggggactgccattgcggaccctgtgaggttgcctagtgttctgtgttgatttcgacttgtcatcgatcgcgaatcaacaactgatgaaagatgattgagggccagataaacaacaataaatcgcgtcgtttcatcattttgcagtttgaagttgaactgcattgatcgatgcgaacttatggtagcgggcatgtagagtggatagcaagggggaggagatgcaaaactcacctgattagcgccaaaatatgctgttgctcgtgtccggaaatctgcagaaaacacgataacacggattattacagagtgatttgaacatttcaaccgatatactatatggtaccgatataggagtaatacagtgaaacaaaaacattatagcagtattttcaacttaaagcctgcaatgaacttatccagattgaatttcagaaacgaagaactcgcatcagcatgagcagtgaacatatgaaccacgacgacaaacatacagaaccaaacgaaatgaaacacccaacaagcaggttgtggccagaattagccagtgaactggagaataccaaaatggagtaaacaagtgcgcagaaggatgcagctcgctgaatttcattacctaaacgg

SEQ ID NO: 57449 - DNA, 2822 bp, Oryza sativa
  unsure (1)..(2822): unsure at all n locations
tttagcatggaactgccgntccgcctccacctcccccccgagctcgccattggcgcctcccccaaaaaccagctccttttcaagccgcacgccgcggcagcagctgtagagcggaggctgatcagccggccagatttaggaagctggaaggcagggtcagtcgaagccggccggtgccgcgacgcgaagggacggttcggcttcacagctgtcttgtagccctcccactggccactgtagcggcgtcagatctctctccgaatccaggcaaaggccaccactgcatgcatcgatcgatcgggtttaatacatcagcgagaaagaacagtggcactagcaacgtactccctctatttaccatatctttgcatcctcgcctgagtcctcccttcgtcacttcacttcactcgtgtgtgaattgtgattgctcagtgggaagcggggaactactacgtgactagtactagtacgtcagttggtccagcgccaaaacctcctgagggcctcttcggatggaaggattttttaaggattttcaagggaatactatatataggaaatatttcctttcctgacattcagtccataggaatcaacccaaaggaaaataagaggaaaaattcctttcatgtggaatcaatagagaaacaaaggaaaatttccatccactcgtatcttattttttccatttcctatgtttttcctctgcctatccgaacacatatttaccaatcctatctacagaatttttgtgtttttcaatcctctgttttacacatatatttctatcatattcttacgattttctactcctacgtttttgcagtaccgtgatcctaataagccctaaagttattcctgcccatggagaagtagggatagtcgtaaaggctcgcatgtgcaaccccgaaaaggctgtgatacttgccagaagttactccctccgtcctaaaaaaagacaaaccgtgggttttcgtgccaatgtttgattgtccgtcttatatgaaaattttttataattagtatttttattgttgttatatgataaaacatgattaatactttatgcgtgacttatttttttaatttttttcataatttttttaaataagacggacggtcaaacattggatacggaaagtaggatttgtctttttttttttttttttgacggagtgagtacacagcaccgaggggtccaaccaaggggagctagtacatggtccaagagggagacgcagacatgccttgggcagtgactagtagtactgtatctagctggtctttctcgggtcaagtgtgagactaacgagcacatgtgcagtcatataggagtagattcgaccgaagatttgtgtgaagcatgacgtacgggaggtttagcctgtctaggagtgctgcaatgcgtccataggtagcactgatctgttttcttgcaagatgctactccctccatctatttttgattgttatattttatcctgacacacagatgaaggataagtaattctactcctcgtaaacaaacgattcattaatatttacatgtctcgatgcccatgtagctaatcttgtatggaagaatggagagtcacgtattaaatccgagaaagttattaagatgataagttcttgaattgaaatatacctatcaaaaataaaattttcagatttggaaatatgacaattaaaagtagatgaagggagtactaggtactccctctaggtactccactcactctgtcctataaaaaagagtaaattttataatggactagtttttattacctttgttgcatgatgaactgggtggtagcacaacttttcattttgggctaggtattattaccaaaaattcacttaacactagtggcccacatgtcagtcagtgtcagtatcccttatctctctcgaacactggtggccaacaattaacggatactcccttcgtcccaaaaaaaaaactcaatttctgggttctagtatttaacatttgaccgttcgtcttatttgaagaaatttaaataggtaggtcatgcataaattattattcatattttatcatctaacaataatgaaaatactaatcataaaaaaagttcatataagacggacggtcaaacattgaacacggaaacccaagaattgagtctttttgggacggatatctacgaaggagctcaggcaacgcttactcaacctaatcgtagctactcaccatcaacttctcccttgcaacagcttgttggatggaggtttagcttgagagattgcaggaccaggagggttgagcttgatgcagggatgggtgcgagcgagatcgaccgagtggccagagctgacgaaggtcgagctcaaacttgagctccagtgcgcaggcagggatcggaggaggtcaagctagattggtggcgcgatctggatggtctgctcaccgccaatagtgagctcgagtacgaggcaacgctcaatgtagctccagtgcaaggtcgagcttgatgcagcgtagggcaggggcttgatcgccagccggcagcagctcactcaaggtcctggtctcccagagccttgctcatttgtggtagcgaccttgagctagatgacaggtatggagactttacaaattgggtacaattcaactcaacggagaagagagttggagaagaataccggttcaatatataactattgtagatttagcaggcccaatgtgaaaagatagatttacctctagtccaatgtgcaaccaaggtaaatattagtggtccaatatacaattaactctaaaaaaaatcaacctaataatatatgtaatatatatt

SEQ ID NO: 57450 - DNA, 5077 bp, Oryza sativa
ctttttgtaagtgcaacagtccgtcaaacaagttgctaaaacaatataatgtatgcttagataatcatgtatcatcatagaagaaaatgagccgggcaacctctgtaacatgttacagtatgatatttgtgaattttcaaccaaattctgaaagttttcatcttaggggtatttttgtcattagaacaaaattgtatggtactaacggaggctaacttgacggcgatggtaaattatagaagttaaacaaaaagcgatggcatagtatggaactgaacaaagtcagtggcagattgtggttccagggcaaagtcagtgatacaggatagattttctcattgttttaagacaattcaacaggaatacagagtatctcgactacttaggtactgttaatacaatataaaagcatgtatacaaaccagaaatatttagggcctgtttagatctcctggcaaaagtttcatcctgccacatcgaatgtgtagacacatgcatggagtattaaatataaataaaaaataactaattacacaaattacgtgtaaattacgagacgaatcatttaagcctaattgctacatgatttgacaatgtggtgctacaataaacaattgttaatgacagattaattggacttaataaattcatctcgtagtttacaggtggaatctgtaatttgttatattattagtctacgtttaatactttaaatgtgtatctgtatatccctggatattattaatctgttatattattagtctacgtttaatacaggcggtctatatcctatgtgacacgtcgaaacttttcatccctggataaacagggccttactatatttgttaaatagtactataaggtgtcatatttctatcctatgttggcaccatatcgacaccaggccatcagctaatgcctgttggtaccggatcttatactgattaaattacgaaattgctagaattgtatcgacacattttctcctccatcacagtcggcgttttgaagcgtccgatttcctttatcccgtgtcaatgcgatcctgtccgtgcatattgctatggcaggctaacgttgaggctgtcaacatgattaattgattaattaaagcttaacgtcttcattagttcaaggttttacacgcatgcatactatactttatacaaatttacaccccacttaaatcccacttacacaccacttacacatataattactgtgtaatttttagacttacatatgtaattttgaaacttacattataaatacactaaatttacatatgtaatttagggacttacaatgtaaatacatgctaattattttttgatgaaaaatatgacgtcacaaatatagctactcccttaaattaagaaaaactaaaacaccttactcgtggtcaggcaccaaaaggactcacacgagttggtgcacaagcacaactgcgcactgctgtaaggttcaggcatccgaagacattttgtgtctcctcagctaccgtaccgtgggtactttacttccccgtcacttgctaatttttacagctcgctcaacgctctttaaagtttacactccgactgttcaacggcggggagtgcaagtgtgcggcgggcgcgtacacggtccatatccatattcagttgttccgaaaataaggtagtgtttggttctaaaactagataggatgggatgaaaccatccattattttgaggttgggatgattctacttacgtgtttggtttatagaataggacgatcgcagttttttatttggttgaagggatgagggagggatttgatggacgccgtttgccaccactgaagacgccgttggcaacaactatggccgccgccgcctctgccctcacctccatctccgccaccgagctgcggtcgcgaagggacgcgatgcggcgggtgatggcgtcgaccttcgggccgacgaagggacgtgaagctatgggacgatgacgccaagagcttcggggacgatgacggacggtcgggccgccgccggatccgtcggcgcagccctccctatcgtcggatccgccgccgccgccttccccaccacaggatccggtgccgccgagcccctcaacgccgccgctgccgagcttgtctccaccgtcgccgccgagcctgccgccgtcgcccgagccgtcttccgtcggcgcagccctccccatcgttggatccgccgccgtggagccttccgccgtcgcccgagccatcttccgccgcccgagccctccccatcgttagatccagcgccgccgatttccccaccacaagatccggtgttgccgagcctgtggcttaccgccgccgtggagcctgccgctgtcacctgagcctgtcgccaccgctgctgccgagcctgttgccgccgccgtcgatgagcccgccgccgtctcctgagggcgagcagggcaagtgcgcgagcagcgtcgtcacgccgttcgctcgtcccagtccgccagttttggccggatgagttggtcccggatctgagagaaatattcctctctagggaccaacccatcccacctcatcccagcaaccaaacactacctaaaattggtctcaatcgttcggatagcgcgtgctctccaggtaagtcaggcgatctctttgttatcccggctgggtttcgttcgaacgctgcaatgctgcgtacctgtcgtccactcgtcccgtgccggtcgccgtggcgtcacgctcggcgcgcatgcggacgcagtcccgatcgtgtcaagcaacagagcgcggcgacgcctggtcggcccgtgcacgcgcgcgtcgcgcgtcgcgagatctctggcacggaccgacggacggtgacagaaactccgcccgtacgcgtaccacccagtaccgttacatcagcatgcggcaagaaccgatctgtcgcgcccaggtgatcgaaacgtgaggctggccaccggccggtcgtcggccaagaccaacccaccgcgggaacatcagcttcgccgtgaatggaactactcgtggaagtgacggatcgagcccttctggtcgcgtcacatcggggctatacccgtcgccaaatgggaagactcgtcgcgtttcgagtagctctgccccatgccatgtgtcgcaacagttgcacagcgcagcgcggagcagtgcagatcagcgtacggggttaagtactgaacggtaactgcgtgtactcctacgtaccacgaggtccacgacgctggacgggtggagtagtagtaacacggagtaaacaaggattctccatcggttaacacaagtaaagtacgccgcatgtgatccagtctcacgatttcatggtgagttaaattatttacacgatgacgggcagattttgttgttcatcgtaggggggaaattaaatattttttaaaaataatctacatagaacaattgatccaaacagtacaatagacgataaataaaatccaattgatccaagcagtacaatagacgataaataaaatcttgagaaaacatactgtgtttgtattaaaaaggataaacatccaacgctccacaatgaaagataccacttaaaaagtatttgagtattgttataacttatagttatttaggtaggaagggtaaaaatattttttttttgaaatggagaagggtataattgtctaaatattagctctagttacataggtaccgcattggtattttatcttctatgatcctttattgtgtcatttacgtgttttttgtgatatatatttggtatctaataacatgggagtccttgggagttggttggacccaaccgagaagaaacagtgccctaacactgttcatcttcttcttctcgtccaagcttgggcaaatgggaggaggaggctaagggcgttgaggttctggtggtggttgtatgatgatggtgatggcggtaagacatgtcccgtggcacaacgcacccccgggaagtgaaggcaggcacaaaggacaacctaagggcatgagtcagggaaagaaagaatggcatgtagcaagcttcagttggtatttgcgggcacctaagcgcatcaccacgcgtcccaactgatagggattccgttttcctgaacttattgacgaaagtggtgcgggagtggttggaagcattggagcttgatggcaggatggaagcatgaccatggacaagaacgaagcggtggaggagaacaaatgatacatcaatcttgttttttttccccatgcagatcaattcaatccactaaatttgcggaaaatttactttatttctatcaaacaatacaatccactaaatctttgaagatttagtttgcttcctaatgaacgatactaatcacatggagctaactattctcgactcacagaaaataccatatttgactagttatttccccactgctatcgtttacgataattttattttatatcttgcatctctcttaatcaacggtatacattatcctatctcttagtatttcgaagtaccttataaacaccgtaaaagctcggagccattaatcggccgctgcaataatccaatgaaatggaaaagagtccggctgcacgttgcgatatgtacggactccagaaaaaaaaaaaggacaatacaacagaccatctgcccatctgcaaattaaaatatccgctgtttcgaccaatcgatctcttcgtagtaaatctttcgtaaatgcatttgttgagatctatcgccagactaaaagtactaattttgtgcagtgggttgcagtcgcatacagtagtcgtgggcacggtgcacgtgcactgaggttaatgtggaatgtcacgaagcgaggatggagactggtagccggccggtgtagttctcaattggacttttttttttttttttacaactcatggttggagttcagagcagcatattttccatacgaaagagacttgaaagaccgggaaatgaaaaggttaggggactaccaattgagggcgccaaacgtggtcgcgttcactgctgctgcgaaacataccaatcaccagcttgggttagctagtatacctcagctccaaacacgtcaaaattgatcgacggaa

SEQ ID NO: 57451 - DNA, 2848 bp, Oryza sativa
attcctgcagccctggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaattttttttatattgaaaattatacaagattaaaatctccaagactggtaaaatacaattttattattttttagggtctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatcttaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatccggcacccacactttggacgctcggaccatttatgtaaccctaatggattgttcctccagtctaagcttgcaatttccacccgacgttcgtactccatccaagtatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtgatgtgcaccgtgcaagtcgtcgtcgtagaactggctagtaggaccagtcctaccggcgtgagacgaagaggccccagtaccgaagatcccggctgcaaatcctactggacaaggaccatcagtttcatacatgtatttaatagtattaataaaaagtaaagtaccttgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaaccgaggtaaattatatggctcgatgaagtaagtatcataaaaatttagaaatgaacaatccgaactcacg

SEQ ID NO: 57452 - DNA, 1542 bp, Oryza sativa
  unsure (1)..(1542): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactagctagcttaatttgatggtactaatgacattttattctcctctcgtacgggaggcgcgggcacacacgtacgcatcaggccggccgccctagtttatcctgcacaaagaaagaaattaaatttgtctgtaaaaattttctacttcgtttaatgagagtatgagagtgtttatgcgtgcacgtacgcgttgcagttgacgctggtgctgatcttgtaagggagggagacgttgcacttggaggggagcgcggcggcgcgggtgatgtaggggcccccggaggcgccgttggcgacgttcttgaggcagccgcagatggtgcggcgatcgggggtgttgttggcggcggcgagcaggctctgaatgccgccgcagcacgccctgggcaccgtgccccccgcctgcacgtacggcaggcacggcatcagcgtgttgtacaccgccgagcacgagatagccgcgcgcaccgccgtcggcggcgccaccacggccgccaccagcaccaccaccaccgccagcgtcgcgcaccttggagccatgtcagctaagctagctagtctcagtctttgctgctgtgtacgtacgttgttgtgctctctacaacctacgtgaacactgaaagacagctgaaacgtgtggatggaatggggcttcctgggggtgtttatatagcggaggaagcttagcttggatttactaaggttgttgagtgcatttaggggaggagttaagaacgcgagctggtagcagatggccgtgtgtgtggtcagaatttgactgaaataggaggagggttttttgggggatgcatttttaccagacgtttgatcgttctgataattctggactctgtgatggtgtagtctgcaagatgcacttgctgtttgagctttttaacgtatgccatgctcgatttgacaattcggtaggattaaccatacaacttttgacggtgaagcgatgattaattcattttttttatgaatgtgacaaggaattacacgtcattctattagaataagcaaaagcaagtttttacacgacacggcagccggacaaccatcgcccgggattcgggaacaggaaaagaaagagaaactagaaacgctggctaagaaaccaataagctccagcaaaaggaagagaagcaaaaacagcaagcgagaactcactatatgtaagattaaatcacaagaactaaaccaaccagagaggagtgaatggttggtatacccaaaaacaaaaaaaatttagcgaaaataaaag

SEQ ID NO: 57453 - DNA, 3899 bp, Oryza sativa
gagatcaatcgccagctcctgtcgccgccgccggtctgaccgcctcgccttagccggtctgaccgccagtaggtcgccggtctgaccgccggtgagatgccggttagaccgccgaaacctggtgaaacacaaatcgaagaactctcaaagtagatgacaactttattgcttctctctgtgtttacaaagtgcaacaacagcattccttacaaaaatcttgactaaactcgaaaccctaactaaactatcaactccacgctttgaaaagcgataaaaaagcgataccggaaagcctcacgctccccctctatttatacatgaggtaggcagcctaaagccacgaaccaaactcatactaagagtcctaaacaccttacgaaaccctctagtacaagaaagaaactcaacataaccaatcgtaccaaatttggactccttccaaattcgactccgcatcccatacgcacacaatacctccatcgtatgccatatggaatcttcaccaaccacgtgcatcaactctagtcttagtatctcgtatgatatctaaccaccacggatatcgtcttaccactaagccgactcccggtccatcaccgcaaatactctcccgaggcatcgagtcacctatacatgaaacaaacaaagaaaccatatttcgagaccaagctatctccaactcaactcattcgtagcaaacaacagtattatatacgtatagtatccatctataagccataaccatgaaacaatcacggatatccaaagaaacaacccgaaaccgaaaccgacacagcgtcggccggtcagaccgcgggcaagccggtctgaccgctcacatagctcctgtctgaccggcaacaaccgcccggtctgaccggtcccgacaaatcagtaaaccctattcatctcctgaaaattgattatctccaaaaccacttcgacgataatctccaaatatcaaaaccgataatcacatatgtcaattgttcatcacagaataagaatcaaaacacacattgatcttacactataatcatgttttgttagatcaatatggttagtgcagatactaattgagatccgacgtgttgcaagagactatgggtgtcgatgtatatcctaatcctatcgtgtgtctagctcggttttttgctacaataatcagatcgacgaacaaattctgcatggaccgacgtatagtcctgcagactccagattgttcggccaataattcgagaccgtccaatatgacgcagaattgcacaggttcgttcaccgacaggcgacagcgagtccgtaacgcgtgactgttgcatggagccatggagtacctctgatttaatgacttgccccggacgtggcctgcctaaagccattgcacctctgcgatcgagcgtaaatggcggagctagatgagctagatgctggtcgatcgggttcatcagatgctgcttccttacagatttagatctgccaacacttctgacgacggggttgctggctctgcttgtgtaggtggcaaggacgaatttatgaagctatacgagcagcggccatgtgagagccatctgattacatttacagccgctgctgccccggtctgtgaggccagcagcaggaggcgtcaatgcgatagccggctagctagctagctctcgccttttatttactgcgtacgtctcgatcgtatgcatgcaacattgcaacatcgcgtctcgtacatgcgctgtatgaagcaagttcttgttgcgatcaacaggggaaagaaaatggccaatagtgtgtgcatgcctgtatggtgcgtgccgactgttgttgattacgtggtagctgttcatggcagtggatagaagaagtttgttggcaggtgaaaattaagtgcacgcgaactactcgctacattttccactgatgtctctgcaccgtcattcatttcagaatagcgcgcggctattcggggacctgctgtaaatttttcctctcctttttttgctcaccagatttctccggtggtcaacagggtttcccaaaccgttggggctagggttaccgtgccccggcggtaagcacggttaccgcgcggtaaccgcaaaaaaccgtacaaaactgtgtaaaatttatcaaaaattcaaattattttttaaatttatttgaatttaaagaggttaccgcggtatttatattaccgtacccccgcggtaagcccgataaccatgataaccgcgcggttaccgacggtaagtcgaaccgactggtcaccacaagatcaatgcagtttaatcagtgcacttccttaccattctcagcccttccaaatttcgatgataccaccacgataacacaaccttaccattttttataattctaaaactttatgagtctacaaatttttttaacaaattagactttctcaaaacttatttcaaaacttgaccgtgtaaaaaaatttcaaccaaaaaaagaccatcagttcaacgccgggacactggccctaaggttgtacataccaacgccagctacgttggcgttgatccgttgcccacatgggcccgaggacaaggcgctggccggcggggcagggtctcaacgccaacctatcaaaaaaaaaaagggacaaaactagtctcaacatttaataaggtattaaactaaatactacatatcttcaccttaccttatcaaaatttaacattgccaaagtttagtaggtttttatttatagtaaagtgaagaagccctataattcaataaacatgtatgcgaactgccaaacgtagcaacaagcagctgttatgaacttatgccatggtgccgtggaccggtggtgatgaaggtaaaagcatgtacaccaacatgtacatgaagttaccgacatggaaatggaatgaactttcacatgcacaatttcacaggttgatgctacagctgttaacttttgaggaaagaactagacgagcccggagataaaactataaaagggctctgtgagcaatttcgatgtagcacagatccatgccatggactcatgaaagaataagttcactccaggtccttcaacttgacgtcgagtctcttaaaccacaatctacttctacttctacttctacttatatatatatctctacttaaaaagtaaaacttgtttccgtcgtccgtatgaccgtaaagaaaaacacgtagaaaaaaaacagcgagaaaaagacttctgtcgaaaaaaaaattctgactcctattataaaaaaaacttccgactcccttgaaaaaaaggacttctcgtccgtaataaaaaaaattcaaaagaagtccgactcaggcttaagttcgatcggtagttttaaaaacagatttttaaggcaagtaacgataaacctcattagcactcattagcacatacatgagtactacttaaaaaattaaagatttttccatcgttcgtgataaaacatataaaaaggcgaaaaaacatataaaaagaaaaagaaaggaaagtctgagtcatcaatgacgcggagaaaaaaacctccgttcgtgataaaaaaaagggcgaattttttgttcttcacggagaatctaaaataatcatccaatcggacaattacacaaatcgagaaacctaaaaaaaggggaaaaagagaggaaaaaaatcacacagatgagcaagcttgccgtcaaatccggttgttccgagctcgtcgccatcgccgccgacccgctcctgtcgtggccttgcccgctgggcatggccacactcggcacatcccaacccgcgctggcaccccctccctctacccggtgccccgccctccgacgctctcctcttgcttggagacagaggagagaaagagaggtggatggccatcgccgaggtctccgcgccgtaggctcgtagccccgcc

SEQ ID NO: 57454 - DNA, 7416 bp, Oryza sativa
ctgccgacgttttatatatgttcggatcaatcgggaccgtcgatcagataggacggctacggcttctcccactcgggctgctaacgccacacaattgggccatatgtacgctccgcatggataagttcagttttggtccctccagttgtcccaaatacttactaaaccaaggccaaaatcagattcaagccatttaaaattgctgggaaattatgatcaattatttaatcagttagtagattatttttagataaatgaaaccaacaaaatgtttatctagaaagtattaattatatgatattgtatttgaccaacgttaatatggttttatgtcaaaataataattatttccttaaatattaaattatttatagaattcaaacatattccactaaagattttatttcgatactataaagtgtgtgtttctttcccattgcagacgctttgtagcactgaaaaaactgaaaacatactatagtagagtgcaacaaagcaacgaaacgtttaacctcttttactaaatcccgttgcaacacacggacatatttactagtaccaaatataatatgtatctaaactcgtaaaaccgatgtaccagagatcccagggcagtataaagctcggctttggttgaacgagttagctacgtatggcccacctaggcacccggctaactcagtgtggccccgcgtgtcagttgccaatatttcttcctcctctctctccgtctcacccatctctcatcaggttgggtcactggaaggcaggagacggccgacaggaacaaggcgagccgccggcgggaggtgagttgcgggaggccgagccaccgatcgaggcagcacagacttcatcggtaggcgatctctgcattgttagcatgcatgtgtatgtcgtggactccaaggtaggaatgtggaatacttccaccgttttaggttataagagcaaagtcaataatagagtaagcagcaagctttaatttttttccaactcatcaaagttatcagtatagcctctgtatacaatagctagctatactgctgggtccatctatttcactttgcattagaataatctacccctctctcgtaatgttctctctttctccgttgattggctagctatccatcatcaatgcttcttatctcgatagatgtgtgcagctcggcgatagatttgtcgtcggctcacgttctctctctcccctctctcctccagctaatcacgacagttgatgtggcattcctatcgtcagtccacggtggattattgtactcgctctaagacgttttgagtttgatcaaagtcaaactacttcaaatttgactaagtttatagacaaatatagtaatatttataataccaaattagtttcattaaatcaataattaaatatattttcataaaaaaatgttttgggttgaaaatgttattattttttctacaaacttagtcaaatttgaaacagtttgactttaaccaaagttaaaacttcttataacctgaaacagaggtagtaggagacagagaccgaagagcatgtgaaggctacaagttgtgttagacttcagggtggcggtggtggatggcctcaagctgtccaagcgcctcgtcctcccaagcagcaagccctattgtgtcccgttgttgcgatggactgggtggccgcattagacgtcaccttgctgctactaccggcgtcgatgacctacaccgtggtgatggacccaggtgccatccacagccccagtgtgcctagctaccagccacacgtttgtgactgcctggacccgccatacatgaagaaggaggcggtgaacatgaggctgacggcgaccatgacaacccacctctccaccaagcaaccaaacaccttaaacccaaatcccccttccctgaattcgccctaaattcatcgctccccgctagagatcgacccatcggacgccgatccagctagtcgacgaggtcaccaagtaatgcgacgtgactcggtgcttccgcgcagagtgcggtgagctcaaggcgcgggcggacaagcttggcatcggcagcagggcagggtcgttgacggcaaccgtcttcaccctgagctcatcgctgccgcctttccgccgatgagtgagcaagctcaagctcgttgcccagctcctctccatcggtgctaatgccaccctactcctctccaccaatgttcttgtcgcctatctcctctccgccgctcttctccctgccggccactggccgcgtcgccttttcccgtcgatcgtgtgctcctggaaagagatagggggaagtggagattggagaagctgtggtttcacactttaactgacatgtgtggcccatatgttttttgctttttttttttgtctttagtgccacatcagagccatgtcaattaaaactgcttacaatattttcttgtcctcttggaactatatttgtactggttttacaagttaagagatgtgttatatttggtattacatattgaggatgtaattcgaactcgacgctaagttgaggtactataagtgaacttattccactcctgaattcccaagccctgcagagtttcagtcttgcacttgcacttgcagcaaaggaagctaggcctagctgtgtgggttggtcagaacgtggtgcggcccacaaaagttggttagaaccggattcggaaaaagtacatcgaaggtccctgaacttgtcatcgagttataaaaacgtccccaatctgcaaaaccatatatcacacgtctcttaactaatcaaaaccggtcacaataaatcccttggcggttttgatcccggtcttgtcctacgtggcggctgaatcagcgtagaacctatgtgagccccacatgttagcatgccacgtcagcctcttctctatttcccctcttctctccattcctcctctctctctctcactcctctgtggggctctggacggccggcggtggggaggaggtcgtcggggcatggaggtccgacggccggccggcgatgaggcggcggcgacccagaagggaaggccggcggcggcggcgggagcacggagagcaacaccagcgtcttgtgccgcgtccaccgcggcgtgccagcgccggcggccggcgaggtcgtgttggcggcgccggacattgctgctgctgctgctgcctcccggaactcgatcgagacacatcaagggatccaccagctgggatttatctacggccatcgcagccattaaatcgggaatcaaagcttgcaattttggcatccagcagaaacatgcaagaaattaatctcgtgctacaaatgccatctcatcatactcatctcttcttatctcatccaactaagaggccatagaaaatcagtgtcattctactggcaaatcacaattaggcaaaaaaaatgcaagaagttaatctagtacaactaccgcagctcgcagaagggcaccggcgaggagctcgccggagcgccactgccgccgctttgcctcagggcccttatcaagggcttggtcgccgaccacggcgaggccgcgccggccgtgcacgcacacgcggccaagctcggcctcgaccaccgcctcgtcgtccgcgatgggctcgtcgagctctacctcgcgcgcgtcgagctcgcctccgcgtgggcgctcttcgacggattccacgccggctggccgagacgtcgtttcttgtacggccatggcggatgatagcggcgtgtgcatcgacaccgtcgccgccgtcgcggcgttctcggcgtgcgtgcaaatcggggaccttgcgctgggtcgggagctttaggaggatgcccgtgaagaagaacgtcctcgtcccggccgccgccgccacgtcgcggccggccgtcggacctcctcgccccggcaacgacctccccaccaccggccggcttgcccaatccagagagaagagtgggagagagagaagggaggaaaggagaggaagggagaggctggttgttgacgtggcatcctgccgtacggggctcacatgtgtcctacgactcagccgccacgtcagataaatcggggtcaaaaccgctgagggacctagtttgcaaagttgagggacgcgttgtatccggttttacggttggaacgattttgtaactcgaggacaagttgagggaccttcggtgtactttttccatcggattctgacgaacggcccatattagttttgtcggaacgggatcgtgagttcgtgacggacatatgggctgaaaagtttggcccggaaggggcgtgtaccgtgagcccatattgttgggctggaacgaacgggctacataggttaggccggaacggtatcgcgacgagcgtgaagcccatataagttgttgggccagagcatgattctcgttcgatctccatcttgacctttcacgtcgctaactccggaaaatttgtcgatgggcggacggtcgctctcgcaccatcacacaggcaccggctgtctcccatagtcccatgttccagtgaattcacaaggtacaccatgacacctactaaaaaacaaactttagcacatgaaggacttgtggctgccgttaatgaagccatcggaagttcacaaaaaagaggccgtcgtcaaatcttgtgccaaacatcctgtttcgttacagagagagggggaggacatttcaacgtgcaggcgttgccggtgatagaatttggttcctcgtgagcaggcgtccttgcggatatccagccgtcggtccaaccagccacaagcgtactaccctgtctgccgaaccggtcgagttgaagatcccgtccaatgtagcgcgcagtacacaaacatcttatcccgtcgatcggcacacatcggcagtacagtcggatcctgttcctccatcgccgtgaacagcgagcggtcgatcgatcgatcgcgacctagcttcctcgccgcacgctcgatcgaatggcctcctgcatgcctctaggccgacggaccacgagaacagcccgcgggcagcgactcctgagccgacggatgacggatcgacgagactcgacggaaatgccgctttgccgtgcgggggcgcaagcacatggcacatggcaggcagcagcaacaggacgcgcaaccgcgacccgcgcgccgctggtgcatcgcgtgcggccatccgtctcatcctccgggatcgcgcgcgtgcgtgcggggtgacgtacgcgcggtgcggtgcgggctccatccaaccacccgccgcgcgacgcagggcagttttcgccggagagagcgacgcgggatggatggatgagtaggcgggggggcgtgcacggcgccatcggttcggttgggccgggcgctatcgagccaataatgaacggaacggtccgaactgggaagaacgcaagcctctcccaccgtcgttacgcgcccggcccacaccgcgccatgataggatcccacttgacatgcacttgccgtttcgtgtctaggtaagacaggagtagttagctaccgttaagtactactagctccctttctttggaaatgagagcgaaccgcttgcaaattgcttttttctcgtatgattgagcgtgccctagctaacgcaattgatgagatgtttaagcgagcgaagagcacgattctcctcgacaatcatggacaaccaccgaccggggcaaagaaaaccttccttccaaccgtcattaaccagtgctgtaacaaccacgaaatgcatgatggtgtctctgatgatcgaggcggttggatggatgaagaagattttgcagcgccctactgctacgagagattctcttcagacgagtaggcgtggtgttccattcgtgcatgatgaatctctttttgtttgggtgcgacctgcagatgagttccctgggcttcagtcgccatcacggcaagattttgtggtccgttttggtgtactcaccacatgcttgctcctcgctctctctccatcttccaaacagtcatggcctcttcagcgcatggcgtgaatagttcaatgccttcaatgtgagacctggttctattatactccctctatctacaaataattaaattatttgatgtttaaattttgcctataatataacggatcctacattattacttttccaattcatccaaccattacatttgttgctcaattttatttgcatagttggcgttatctttactaatctggtaaacctataggacaatttcaccccagctcaatactatactactgttaaataacctagaacccctaatatttacggacaaaagaaacacttcgcatgttaataccatcatttatagacgaagggagtactgtacatgctaatgtcggtggtaaaaattttgacgagcaaaaattggatttaaaatttatattatatggtatttttaacttatttatgatggaagtggttcacataatccgcctctaccaaaaaccacacaaccaaggtaaattcgcatattgtatgaaatgcttatgatcaactgtaattagatttagtatgtgtttggttgaaagaacggaatagattgagatgaggcgaatccatttttcaagttgtttgatttaagaataagtgacatcggatcatgggatggttcgtaatcccataagatttgggtcagttttacacctcagaaactaacggactaatcaatcctacccacctcctctctcttattgacaaatgagccacaccctccgtaaagaaaatataacgattctatctgtcatgacaaacatatgactaaaccattccattcataaaaaatatagattatctcacctcattctcaaaccaatcacgcacttagattatactccctccattacataatataagggattttaaatggacatgagacattctaatactacgaaactggacaaagagtatgtccaaaattgtaagactataatgtgtcacattctttcaaaatcctttttattacgggacggatagagtacaatcctgccgcagttagcagtagaagttgccataaaagagtctttgttgtactattgtctggagtgaaaataagccccttttcaaattagaagtgccttagaatttaagactcgtgtacgctctacgcggttcctacatactttatcgaacgtgagtgatggcagattgcagagcttgctcaatgctcggctagctcaaatatccgtcggtacagcccaagtaaccaacgtaaacagggaaaggaaattgtggcgtgaaccttatgatgctcggagctgaaagctcgggacgcttgcaaaataaggcgaatcaacgcatggtagctagtaggagattgcccgtgatgtccgggcggcccatgcccatgtgcagataacatggcgtgggggcacgaaatggatggttaattagtcacttgatagactacttctttttgaaag

SEQ ID NO: 57455 - DNA, 4897 bp, Oryza sativa
gttccgaattcatcacgctatcatttccgcctgctaggagcgatcagctgctgccctgtgctgctagtataaaacttctcctgttgcatggtagtgataatttactaaaattacgatgacatagaagtaatttgtactgttaaactaacaatgacgcatctccgaaagaaaattttcaaaagggctttatgaagttggttgggggaatccattaaaacttcgtgtttgacctctgttgtgtaccagcaaaggaagcaggaatcacgatacgcgacactgtcgaaagaaaaggtgctacactaaaagcaactgaagaaatgcactgcaagttcgcaacgtgcagatcatgaatatactcccaagcaaaccggtggaagagcgcaccaatagtcccattccttgagccactaaccaacatttcctgcaggccgatccttacagaggcacgaggttacatcgataaaatcaggatcagagtaggtttggagcgagtcagcgagagacgtgttattgcagccacctgtcactctgccacatgtcacaggaaaaagaacagtactatatgcagaggagatgaacgaagaatgcccattcaggtttgtcagagcaaaaaacgtgaacttggacaaacatgcctgcagtttgtctgaagatttcgatttttatacacctttttttgatcgcctacgtacgtggccatgtttatgccatattgccatgtgaaggtgtgaacccttgcaagcacccatgggcgtcaggctatatcctagtcctaaatcctaatagtatctgagcttatcattgggagttcgcactggtaattttggcatcaagcatgtatgcactagattaattgctgcactaatctatattacctagtcctaccaagtaaagttactcgcggctagtcctactattgattcttgtatactcctagtcctacatgatttacatagccgacagaaaaatctggggatagtcactttgcctgatggtgcaatagtggcttcaatcttcagcctactctgctggcgcattacaatttacaattgtgagaacggttatgccttttagagcaagtttaatagtatagtccactgctaactccaaatcatctatagctaacgtaatagctaattcatataatagttgcttactatactattaatacatggtcccacctgtcatacacacattacatcttggagtccgtgctgcagctggctacagatctgtattatagttagtttatagcctgctattgtacctgctcttacaacatcgaccggctccgatttttcggagattatccaatgaacgagaggttcttaaccgaagaatgcaaccttcgaatcttgcgctacgtcggaaaggtgcgagaggcatccacgaacatggttcacactttagaacgattggttgtcattcggtctctttttcgtttctcgcattaatctaccatgcatgcaacttgatcaacagttcaagaacataaacaaagtggtttactttagagcatttgagcaaactgtatcgcgtagtccgtgcatttgaccatgtctatcctggcacgtaaaaaaaacataaacctgcacgccaagtcatgtcatgcatgtacacttcgtgcatgaatcacacgagagacagcccacgacgcgcagccacgaagcatggccatccacgataacgtaccggcgtgtaatcgaattcgtgaagcatatgtctacatgatcacatggtcggtatggtcccttcacacctgcgaaattcgtggcccatatagcttctgcgagccatgtggcaagtatcaaagttcgccgatttctcgtttaaaaaaatgctcggtgatttttattgtttttttttcttttgctgcgattaactggacttgttcctgcagacacacgggcagttggtgtctccttgtgcgtgacgcgcgggtccgacgaggcgatgcgacgagcacttgcatgtgcggggctgatcgccctgatttgtatgtgttaaccgccgtcgtggctcgtggccggttatggtgggctcaccttcctctcgccgccttttgtctccttttccggttctctcctctgtcgttgggcaaaagctatcaacgattctaactgccaaggaggagtcgcctataagtacctgagcccgggagcaccgctctcttcacaaccaagcaaccatcgattcgatcctagcttaagccgagtgaagtagctagcaggacattgttggtagtgtgatcttctccctgttttgcaacaatggcctcacgcagtagtgccctgctcctcctcttctcggccttctgcttcctcgcccggcgagccgccgccgactacggctcctggcagagcgcccacgccacgttctacggcggcggcgatgcgtccggcacgatgggtacgtgtgcactgctcctcgtaacactttgtttttttttcttttggacgcattgacaaaaccgggagtaatctgactcgtgtcgtgttgtttgtgtacatgaaaaggcggggcgtgtgggtatgggaacctgtacagcaccgggtacggcaccaacacggcggcgctgagcacggtgctgttcaacgacggcgcggcgtgcgggtcgtgctacgagctgcggtgcgacaacgatgggcagtggtgcctgccgggcagcgtcaccgtcaccgccaccaacctgtgcccgccgaactacgcgctccccaacgacgacggcggctggtgcaacccgccgcgcccccacttcgacatggccgagccggccttcctccagatcggcgtgtaccgcgccggcatcgtgcccgtctcctacagaaggtgagctctacttgggtcaatgggtcacgagtgagtggcaaactgtttgcaacttgaagccatgggccccccgtgcggtgtgtcggcttcgatgggccgatccccaatcggctgatcaggccatgtgtaggtgggccacccggcagatttggtttgtccacgatctgtccgtgtcggctgtaggcaaagccatgcacgcacgacttgacaccgacgtggacttgacttcgctgtcccggaattactttacgcatcccatttcacatccatatgattaatcgttgcaacaaatagtaacaaattacagttaattctactgtttcactgaactttgctttttttttttgctggtgtgttgcagggtgccgtgcgtgaagaagggcgggatcaggttcaccatcaacgggcactcctacttcaacctggttcttgtgaccaacgtggccggcccaggcgacgtgcagtccgtgtcgatcaaggggtccagcaccgggtggcagcccatgtcccgcaactggggccagaactggcagagcaactcctacctcgacggccagagcctctccttccaggtcgccgtcagcgacggccgcaccgtcaccagcaacaacgtcgtgccggccggctggcagttcggccagaccttcgagggcggccagttctgatcgagtactcggctaattccgtttttcagttcacttttctgcagaaatgtcagtgtgagattgagattgaggtggaggaggagggaggcctctttgctatagtaaaagagaagaggctttggctattctgaggctgcttattaattagcacccgcttaggcctttgctttctcccataggtccagtagacataaataagttatcatggagttgggcattttttttttctgcattgttgtagccttggtttaaaatttggcaaggcaatttaaggattatattgtagaacagcagggaggtggtgtcttgtaacttttgttgttacattgtaaccccccgaatcaggccacatgggccggaggagtttgtgggggagcaccggagcactcttgtgcttttgggaccatgaactatgctagtttatgggtctatgtatatgatatgtttgtgatttgattatactttcttttgtcgccttatcaagtaccaatcattattaagtactgtacgtagtctctgagtgataattttgaaatctttgtgagcgcatattttaatcgaagttgaaggctatttttgttcgccattttttgttggattgtcaggatgatttgtaggcaaaagttcacaagagaatttatatgttgcttcttcaaagttcaaaacgattcatgagtgagaagaaaatgatttgtgacaaagctttgtgcctttgtctgttttcagttcgacgtacgaaacaaataaaacgggcccatatctattccaccgcagaattccagcttgaactatcaggccattacaaattcggcccactagagcatgtattctcaaaagcaaaagctggccatatctatgctaccgcaaaattccggcctggactttcaacccattaggaatccggaatactaaagtagtagtacgaagtagtattcttcaaaaaaaaaatttctttgatatgaagtttgttttgtattgcaaaatgtggcttgactatccagtataagtgtataactattctgttcacgtatgctgataaaacaccaggtagactgttcaactgattggtctcacacccgacctaacggctaacgcaagaactttatgcagactggaatactggattcatgagtactaaatgagtatgtaattaagggcaacaaagttttttttatctgttacaaacatctattaattttttaggtatgatgggttcatcattgactgtttcaagagtaggctaaagagctgccaaagtgacaaattgtcgttgcagttcggccgttgtgatgacaacgatggcgatatccgctaaattggcctgtgcacggcgcgggaatctgcatgtctggtaggtcgtcaccgtcatcagaaatcgttaacttgtctctccttatgccaaa

SEQ ID NO: 57456 - DNA, 2199 bp, Oryza sativa
ctttttgatggatcgatgatcgaccaacagactgacgtagctctgttcactccaccaaactccttcgattgatcaaatgactgtttgattatggagtagaaactgtatatgcgtagcatccgacaataagcaagccagtgaagtccatgaatctgcagtgcggatttggccgcattctgaagaactggacgagaaatgctgacaccgcctgagaccgagaggcatctgtgtctggccagagttggttgagcccgaacaaatccaccaacattttaagcaagacaacgagcaaccacccaccaccgcacggagggaggaggatttctgcctctcgtcgcattcgtcctctctccctctctcggttctcgcggtggtggccacgggcgcaggtgaggggatggtggacggcaggatggccggcacggcggcggcgctgggcctgtcggtggtgtcgtcggtgtcgatcgtcgtctgcaacaaggcgctcatgagcacactcggcttcgtgttcggtgagccctgaacttatccgagttatctcgcgtacagtctgtttctgttggacgccattgttcgagatgccaggaacatcttagcggtttatactgcctttaatcgatgcgtagcagagtccccgttgttcccgtcttgtgcatcgcctgcgataatgatttctgattaagctcagtgacggagaatgctttggcctgcgtagaagacaggaggcggcggtgtacggcttgcaaacgaggagtaatttgtgaaaaaaaaacttttatatacatgttcttagcgaactaaaagcaaatgctgaaaaataaagttcgataaaaatacaccaaaatcagcttcaaatttaaagttgaaaatttaaattttggctgataaatataagcataagcgaaaagatgaaacaaatagtttacgcaagtacctcctacaagtacactgcagtttatgtgtcactcgaatggttataaaaaaataaaaaaatattaagaatatataaataatatgtgatatattatttcacaaatatatatgtttaaatttaaattcaaaattaaatggacgggaagtgtccatccatttttttgcaaaacactgcctgctgttaggattggtgagtggcgattgggagttttgcgcgaaaaaaaaaaactcctatgatgaccgttttattgatagcggtctttttgtgtagtccgcttccccttctgtcttcgctagtacggtaggagtaggaccctgtcaaaaccacgccgccggcggcggcggcggcggccggagagcaacatggccgcgtgttcgctgcagagcatcccgcccggatggcgttccggggaccggggatatcattacgctcctcagcctccggtctcctctgcgccgtgctcctcagccgccggtggcgccgactggtcgccttcgccccagccctcggtcctcgttccaccggagatctccccgcctcgcgctcgcctacctcggttctatcgatcaccctcttgaacctacctcgctcgcctactttgcgcttaaaattccgcgcacatatctggtctgtttgctctttgcagagatcttggtaagtagatttcgagtctacgaacatcttattcaattcccgcaaaaaaatcctttaaattcctccattccaagggaggcctaatactattgttctatttaatgctagcatctagcactctgtccgcatacattggactgcggcaatacgagcttagagcaacgcaaatgactagataagtatgcactctaggtgttctttgaattgcctcagtgcagacttgatgaccattttctgaacatctctgctctgctgcatatgtgagtcaaattcatggctccatgggacaattggaaattgcacaacgttactgctatcctattcatgtatttgttgaacaaaaatgacatccttcgaaaattcaggaaacacaagttgcctgatggacacggttcattaataaggcacacaaattctatactactttatgagtacaatatgacgaacaataccacctgagaaaactaactgtttcctaagctatataaccatgcaaaaatcacagcactctcctaatttctttcagctactacgctgacaagctggcatctcctggtgacattttgttcccttcatgtggctcttcagatgaagcttttggggtgcaggaa

SEQ ID NO: 57457 - DNA, 1948 bp, Oryza sativa
atatatgatgattgttggtatccttgtgaatacaagcatggtacttgaatatttgaattcctcaatacctgtgggtcttgcaatcctaatgtcatactcccataaaacaataacttgtagtactatcataaattgaatagactataacaatattttcacttcatgcagccggagaatccaaatggcactggcagttcttttgtttggtgtaggtgttgcaacagtgacagacctgcaactgaatagactgggatcgctgctgtctctatttgctgtactcaccacgtgcatttcacaaattgtatcctctaaacaaagtatacattcaatattattttctttgcactaaaataatgacacttgattctttgtttttaatagatcaataatcagacatatgcattatagaaaaaatggcttttggtgttagctcatatcaaatatatattaatttaccagataaatagtttcttatatctattttgatatgcattctcttgcacctaaagtggatgataacttttaacatactctgaaactctgatagtttctacgacctccgtcccaaaatatggcaacttttggctatgatgtatccagattcatagctaaaaatgcttacattttgggacggagggagtaggtgtttctcaaatttaagtagctgatctgatacacgttgttttttttctctccatttttttgtatcagctataaatatgtggatccaacgtagtatattgatttaacatcatatccttcttctgctatcactatttccttccccatacagcttaaccaattttgctagatgacaaactttatccagaagaaattcaaagtctcttcaactcaactgctctaccaatcttgtccataccaagcgctgactcttttcatcattggtccatttcttgatggttttcttactaaccagaatgtatttgccttcaagtacacgagtgaaatccttgtgagcattccctggctcgatgttccctttcttatttgtcttctatccattatacagtaatatatctgtttgttatctttttgtcaggtattcatcgttctttcctgtctaatatctgtctcggtaaacttcagtacatttcttgtgatcgggaaaacatctcctgtaacataccaagtagtaggccacttaaaaacctgtatcatcctcggttttggatatgttttatttaacgacccatttagttggaggaacatattagggattcttcttgccttgttaggaatgatcctgtattctttcttttgcttgatggagaataaacagaaggccccggaattgtcagctccatttttccacactaaggtatcagatagcacttcttttctgaagccttaatgctacatttgcgacttgcagctatttttttcatatctcgtccttgcaactttagctgacccgttattttctttcactaacttactttttcgtgaatgtgcaaaaggattacacgtcaatatattagaactttcactaacttactataattccttgcttctcacccatcggtaatcacccttgcttatcaacctggcaggtgaaaggaggtgaagcagggactcttctcctagtacagaacgggtcagctaaagttgcagatggtgttgtgactgagggcccaatgtggaggtcaaacagagacttggacgcatgatcatcccgctcctgcagaagggatcaagggactgacatatggtctgaaaccggtgtaattttcatcggcattttgctccagttcactccagctagctagttctgaaggctccttgctctgcgtcttgtacatacatattcggcacctatttttgctacgactgtacataacatgtccacggctggaattaaacaaacatttgcattcatactattatatgaagatttcatgtctgttatttacccgaagagtaaagtgca

SEQ ID NO: 57458 - DNA, 1094 bp, Oryza sativa
aaaactcgttcttgtcgtagatctcgcttccttctgatctccttattagcacgtttcctctatatgtcaaattatgcaagggtgagtacatatgtactcagcaagacatattataaataattaaagatgaatagatatgaataaataaacaataataaagtaaaggagtaatgaaaaccataaatcatctttatcctcaacaatttaatttttaaaactacttatacttcaggagtaggaatcaccctaatggcacaactccagaaccgggagtacggcacattcgaatgatttaattcacctctgcagagactgtccagttttacccgcacgatgtcaacagtttgcaaggctgaggacaacatagccgttcgagagtcccacttactactagttactgcacagtggggtcttggttcatcatagtggtcgaactcttgctaggcctaggcaaggtatctatatcgtcacactttcatgaatcccactgttgtgaaacactgccgcccaaactccttacgtaagttcaccccaaaaccgctcatagagccacccaatagtctttcatataatgggacaatatactaggctaagtcaaattacttggttgtgtggatggacgcaactatatcatttcccatggtataagggggtaattataatccggttaaaccacccaaaaactttccaaactccccacaccagcatcacaaacttcatcaacattcataatcacaacattcataatctcaactcataaatgcccattttaaccggattcctaagtttgtaaagttatttggaatagtaaattacataaaatgataaccaatgcttctttctatgttctcatgcaatcatgcttaaaagcatttaacatctacccatgagatgttaaaagagtaaggtattatgcatcaaattaaatatgaagatcatataaagttttctatatgatcaaaattttaattatgtcttgccttgtgccttaatatttcccgtggcttcagcgtagccatctgggtccacgtcagctccttggatgccgatagaacttcttgtatggtctaacgtacgaatacgaaaagatagca

SEQ ID NO: 57459 - DNA, 1199 bp, Oryza sativa
gagcaatcactctaaatattgtgataatattattcttgtgccgaggaggaaatcaagccataagaattaaattggtggcttgattaaaataggagagtttgggaatattaaaggggtttatgaaaggtattgtataaagaagaaaaatggggatttcaaaggggaaatatttgtgggagtgtataactggattcacaagtatatgtggatgtgaatttctacaggaacgaaatttgtggtagattgatattattctaaaggataggtatattgactcagggagattgaaaaggatattttatggactaagggaatatttaggtggagatccaaaggaaaagtattggttctggactctccataacactggaaggtcatgcagtaggtcactgattcatcaagctgagcttacacgctggcatgtgtttcaagtcagacctatttcattagtatcaagtcagaggcaagtttatatagcgattcatatttcatgtgctctagatatggttgagcgcaaattaaaagggttttgttcggtaaaggattctcgtagtgttgatctctagagccaaagttagagattaaataaaataaatagaaaggttttgtaaaattaaaaagggattttaaagaaagcttttaacttagcaaataaagtttagactcaagtcaaagaaaagatcaaaagtgaaattactgaaaggaagaatcgagaagagcatgacttaaaatatttcgcaaaaaattttccctaaaaatttaagtccattacatcgtggtacggcgacccggccgcccggtggggggggggggggaggagggaggaggggatgggatggtggtggggttggggatgtcaaggggcggtgtgttgcttatgacatgctcgtggtaggacgaaggagggacccaactcggtgacaatggagaagacctctgggttctctactggggtcgttgggggtgtactggcaacgataactgctcaatgtcatacccgtctcagttggtttgtccgctgcaggggtcttttctttgtgggcgtcgtctcaccacaacggcgtggcggtggtacgatgagccgacgtagaggagcatcggcagcgcgtcgccttccttctccttatcttccaactcttccgccaagtgagatcccccacattttttcttctcatttacatgtggactctatatttttt

SEQ ID NO: 57460 - DNA, 1242 bp, Oryza sativa
aacaggacggcatcaggctaaaaggcatgctgaagctcctatctatgttttattttgtttgctgtaagaactacatgtcatttcagccatttctggtaatagaagtggggaaggcctacctccctttctccaaaaaaaaaaaagatgttatagaaaggatatatttacccaaaacagcctcttctgtgactttagcgtgctgcctcaccaattcctctttagcattaattgtcaaaaatgcagcagcaagtttatcattcaaactcttcaagttctcctttacatcttcatctctgacatttgaagatgactgtggctctgatgattgaccatgccgtggagaagaatcatttagtttaaatcccaatgctaacttctcattcgagggttttgtgactccaatctcttgggtcccatcatccctaacccttgaaggcattccaggtgattggccaagatgtggtgaagcattgtttgagacaggcctcagaacctcctggtttaacatgagcaaacaaaattcgaacactcaggataaatcatttattatcattcagaaaaagaaataaaacagcatccagatttagcaaaagatgccatatatgtataaattatattacaagtattaactatttatgtccatatttagtgctattaggcagctcatttaccttcatacaagaaaacacaaacaggttgacaaaaaggtacatcaatatagactgttgcagaacttaatagttagaaccttgaaaaatatgcatagatttcaagagcatcttacaggagattgggcgaattgaatttaattgtctttagttggcagatactattcagaataaattttaaggaatgaattttctcataattagaagaactctcttggagttaactgaacagggtacttaactcccttaaatactaccagcatcattttgtctgttcaaagctttttctttgcttgcacggaaaagggcattacaaatattatgaaacatcggcacatcgctacaacattttcattaatagaagtcgagattcagcttcatactcaacctcaacatgacagattttatacggtttgagctactgttatgagcacgatagtctgtactcggtaggtactaggtagcaacatgctgctcaatctctagtaccataatacatcaagtcaatatcaatgcattcatcagacattatcatctgaaccactatgctccattagaatcaggccaaactata

SEQ ID NO: 57461 - DNA, 3822 bp, Oryza sativa
ctcctcgaattcaacgactacacggagaagacgggaatgcctcgcatcgcatcgcaagaactccgtgaagaacacacacactctctcaatctcaacaccacatttcttcttgcttcccaataactctctctctctctctctctctctctctctctctctctctctatctctatcctcttgagctgagctgggggggagagggggggaaaagcgcggggtcacagctcacgcgggcagatcggagcaggaggcgagctcaaaagcggaggggaaagaaaggcgcggggtccaggccatggccgccaccaccacctgcagctttcaccatgtgaggccagtacagctatctccctcctctcgcttctgcactcaactctccctctcccccgagcagaataaatgcatcggggaaagtgataaatgcaacacagcatccaaagctcaaaaagaaaagaaaagaaagaaagaagaagaaaaaaaaacagagagatttcacgacgaacaccgccatcgacgaggtcgaagaagaagaagaagagctcacctgcatcatccgccattggcgacccgcattaccttcctccttcccgcgcgtgcagctcgaatcggggaagaaaagctcgcagctttctcggatactactactactacttctctctctcctacccccactctcggagtataatagtgcagtgttcgatgcaaccaccgggggattaagattaggattagtagcagtggcggttgatgatgattctgtgtttcgctgctgctgctgctgctgccgactttggcggattgattgcgagattccagcgacgggtttttagctaattaattaattaattaattaatcagaggggattaagagtaggtacaatagcacactattagccagctataaatatattttaatgagataaaaaataagagagaagagcagcgggctacagatatatagccagctgcagcacggactccaagacatcgtgtgtatgatatgtgggaccacatatattaatagtgtagtaagcaaatattatatgaattaactattacattgcttagggcagtcccaacccataacactagacatagtttccataaactccacatcatcaagaaactagtacggagtactagacactactcttccaatgcaaacaccactattccatacttcaatttaatgctacttatctcacatgatgtcttagatgttgtgaagaaaccatgtctcatgcaagacatggtttccttctctttcctcatttattcacttgccacatcattttttatcctaggtggcaacttatttaatgctatagacacaatcctagtcattgggttgggaatacccttagagcatgtataatagcaggctattagccagctataaacatattttaatgagataaacgatgagagagaggagtagcgggttacagatatgtagccagctgcagcacggagcccaagacacactgtgtatatgacaggtgggaccatatattaatagtatagtaaacaactattgtatgaattggctattagattggctatagatgaattggagctagtagtgggctgtactattagacttgctcttatagatgaattgaagatagtagtgggttatactattaaccttgctctaatcgctgtgttaagagcatgcccaacagtcacccaatatttgattcccaaaaaatctgaattaggaattccaaaataagaattgggcccaacaatcaccccctcctccaagagaggcccaaaaattaattccctatcatttgttagtttgccacataagcaaggtgggcctagttcggtaccgatcgatcgtctccctccccgcaccagcgccgagacttctccctccccgcaccttctccctcccacaccagcgccgccatctgtgtaaatcgcatcatcaccagccaaccagtgtcctgagtgctgcggtttctacaaaaacggaataccaaggatatgccatagctattcgtgtcatcaaggaggtaatccctagcaaatcctattgatctcttgtgccctagtcaatatctgtctctatttggttatgtggatatctattgttggaaaatattaagtttgatctaataattaattttatagattgattattgttgtattcctgccatcggttctctccattgcacttcatccctgtggtaaacgctccaaccctgtggcaataaaaaagagaagatgagtcgtcgaagtaccctcctccaaatgctattggatgaggagtctttatcggatggcgacgaagaatttatttctttggcggttgatatagtgcacgatgagttcgacgatgatgaagttccaaagcgtggtggatctgttataggtcatgcagtaattaatcgggaaagattggctggacatcggagattatataatgattatttttctgaagaacctacgtacctcgatgttcagtttagacgcaggtttgtagcagtgctttgttttgacaatatttgtttgcaaaattgatattaaaaataattaatatcgttaattactatgcaggtttagaatgagacgacctctgtttttacgcataatgaatgctatagaagcacatgatgaatattttgtgcaaaagagaaatgcagctggtgcgcttggactgtcatgtttgcaaaaggtaacagcagtgtcacgtatgttatgttatggaatagcggcagatgcagttgatgagtatgttcgtattggaggtagtaccgttattgagagttttaacaggtttgtggtggctattgatgaagtttttggagaggagtatttaagaacaccaaacgagaacgacatagctagattacttgctcagggggaagaaagagggttcccaggaatgttgggttctttagattgtatgcattggcagtggaagaactgcccgactgcatggcaaggccagtataaagggaaagagggagttcctactatagttttagaagctgttgcctcacgtgaccgatggttttggcatgcgttcttcggttcacctggatctcacaatgatattaatgtccttcaacgctcaccgctgtttgcaaagctagctgaagggcaggctcctaaagttaattatagtattaacgggcacgactacactatggggtactatcttgcagatggtatttatccttcatgggcaacacttgtgaagagcattaagctgccacaaggaaataagagaaaatattttagcaaagcacaagaagccgctaggaaggatgttgaacaagcatttggagtgcttcaagctcggtttgctatagtccgtggaccagctcgtttttggaaagcacttactctgaatcagataatgagagcttgtataatcatgaataacatgattgtggaggacgagcgcgatggtgattttgatctagtttatgatgagatgggagaacaggtgggtggttcccatgaacgtacgaccaactttaatgattttattagtcagtacgaaaaaattcaagacaaggaagttcacaaccaactaagggaagacctcatcgaacatttgtggaatcatcatgcagaccgatattaattttacattatatattcttatagataatgtcatagattgtaataattggagattcacagcttgtttttaaattagtacatattgagcttatagtaattatttattgacaatgtgatttattgttgaattcgatacagtacaatagactgaaaaggacagcagtgcatatcctttttcaggactggatatatatacaggatatacaccacaagggtgta

SEQ ID NO: 57462 - DNA, 13702 bp, Oryza sativa
ttgataaaaaaaaaggcctttcctcatgtcaagatattcacaattgttcatctgggtttcctaggaattttaagcttcacctgtttctcttgtttagcattaaaaaaacatttagtaatggacagattccaaaatcaagagatggtgacactaaacgtaataaatcctgtcaagtggctaatgaatttaggtcacacactcaacatctcatcctaatctctacgttgactcaattaatcatccttttatttgaaagaagttgtattaatttgatgcgatatgaatcgacgtaatgcaaccgtagcacagagatgttcctttaatgccttcttttttgcttatcttgaatatagttgacataaaaattattctccagaaccaaaatagaaggttcggtttgacagtaacatgaacctgaaaaactattgggcatcatcttttgagatggaccaaagccgatagaaattgaccaagaaacttagcgtataaattaagcgtaatattaccaaacgataacagtaaagccggtgtaattttgcgtacatgtagctgattttacactattttcacctataattttcttggtcaaattctgacttattttcatttaaaaaaatttaaacctctccgtttataaacattataaacatataacatctttggagtgtaaagagcttaggatgaagccaatgctcatctttatttacattttacatcttgtcctaacttacttgtacaaaagaatagactggtactatactcgtacttaattgatgtgtaaatataaagattaaactagccacccataattttgacaaatttgatggtaagattgattacacatcgtcctagcttgtacacaagaacagactagtaatatactcatacttaaatgatgttttaaaaaattaaagattaaactaggcctccaacaatttgggctctattaaatttgatggtactaacattgatgagtacctaatactgatgtaggagtaatacacaattcagatctagcttctctttggcacaagccaaaccaagcattgaagcaaccatttctcctccaaaatccccgccaaatttgcagcaagaaacttcactgattctttcctgtttttttttggaacctgaaaagttcagtgattctctcttcctctctcttgctgcacactgacagacacacacaccaaacactttatgtatgtatgtttatcatacataatccaagccactacctctctctctctttctctctctctctctgtcacaatctatgcctttgtccattgctctctgattaattaattcttcaccaagaaatcaattaccttttttttttctcttttctcctcgtttttgccgttcatcttgggtcttgtcgtcgtataaaaggcaccaattcttgtcagtaatcagacaggaagggaggagcttagcagcagtcgttgtgcagaggagagtctcctttgcttcccaagttgccatccatggccgccaaggtgtacaagccggccgccgaggtcaatctcggcccggacagcgacgagttctacatcagccctaacgtcaaaggttcgatcctcccttgcatccagctagttcttgattctggagttcggttcttggaaattctgaattctctgttcttgaagttgagtctgaattttcttctttttttggtttcttcttcttgttcttcagctcctcggtagcagggctgctggtgaagatcttcgtgtggattcttgagatgccgatcatcggctcaatggtgctttacatcctcaagaaggataatctcatcaacaaggtgcaacactgctcaaattctcctcaaaagtttgctctttttttcagagaaaaaaaaactccttttgattctggcaatgatcttgcatgcaaaactgttactactaggtttcagcgagaactattgaggagtttcacccaaaaagaaatgctcttttttttcatcatctcaactagtagtagcagaacatcagcaactggtacttagtgtgttagttgcgttctgagctttcgttgagcagtgtcaggcagacaggaataattctctgatttgacacagctttctgctgtctttgtgatctcaccaactactgttcatcatctgcagcttgtccaagatgctgaaatcccagagcctccactgttcacttccacacacagctgggaaggttgtttctctgaacttctctgaactctgcgagaaatttcctgctctgacaaacaaaatcttcttcagttaatctgatgaaaacaaccacacacactgtttgatccatccatctcctgcagacattccagagcagaatgtgtgcctgacgaagccggacctgtcgccgccggagcgtgtccaggaagccgtcagctgcctccctgcgagcctcgaatcgaccctcgccggctcgccgccgtcgagcccgaaacgctggacgatcagggatttcaacagggcgtacagctcaggggaggtcactcctgttcaggttttgtaatcaatctttgcatggatagctacaatgttctcaatttaaaatattagtagctaaacttattaggcctaataatatggttacatgtctctttccttgactagtaactgaattatcatgtctgaatacattactgaagagtactagtagttagtaattggcaattgtagcaacacatgataaaatactagaaattgcaagaaatgatcaagaacagctacattgttgcaggttgcaaagaggttcttggctgcagtgaaggagtgctcaggcccaggcctcaacatggccttcttcatcagctacagccctgaagacatcatcaggcaggctgaagaatccaccctgagataccagagaggtaaaaaaaaagaacattcttttacactgacatgtaagttacagttggcagtaacagtatctgaagcaagagcaatgcatggaagttgcaattatcatcagcagaagcagcagcacacaggaatggcctgaacttgtccctctcaaaccaactcaccaccacctttctgtcttgacctctagccagccaaccaaacttttttgtacccacttggtaacaaccaggaggcagtacaactacagctacatacacaagcaacactccaaacaatttcttcagttttttttcttctgttttgacatcttgaaaaaaaaaacatcacaatggttgatccacaatggaaggaagacaggaagacagaaaggaaagggagctgcagaaattaatgctgctggagctggttacatttattgttctctgaacaagaaaaagggcaacgacattatcaatggagatatgttaatgttggtaattagcatcacatatgtcacattatggtatggttcagatcatttacatttacagggagattatgatggaagagattaagggaacagtgacagcctgacaggggaggcttggagctggctgtatttgatgttttgatccaactgtaaagacggctaagaagacaagcattcattgcctggccgtctcaccgattagttagctgttaactttgcatacgattggtttgcagatcaatcagtgttcttccagagttattatggctagcaaggttagttcttaggcttgtcggtgatcacattcagatgcaaaatctgattagaaatggacagttatgaactagtatgatactccactacataaattgtgacaaaagaagagctatttgcatcacaatgcagtgcagtagaatggtgccagacagacagacaggacatgacatatagcttaattgtgcgttaatcttgtgataattatatttactgatgatctgttaatttcgacattaatcgcagggacacctctgtctgccatggacgggatactggtcgctgtcaaggacgagatcgactgtttgccctacccaaccacaggtgagtaattaactaattaatcacagtaattaactacaatagcgtgacatggacaataaacttatgcatcctgcatgcaaaaacctaaagtgttatgcagatatttgacaactactggtaaagatttataaatagatttcaataatatttgtctttgtttagtgtcggtggtcattactttgtgtatagttattttctgaatttttcatgctctttgttgaacggattttgtaataattggctatagctttcttgaagcaagggtgaaattcattccattattaaaaaacaattagtactaattactacttccgtttcaaacttcttaagttttgacaaaagaatatagcaatatttttgaactaaagaaaactattagaatatatttaatgttaaatttaataaaattaatttgatgctataaatgttacttcgtactatatatttttacaaattctttcaaaaagtttaactttttaaaaaataaaagcaaacttataatatgaacaaagagagcgagtaatatatatgctctgattaaactggacggtgagatgaagatcggacggtgatgcaggcgggacgcggtggctggggcgggcgcgggcgtgcgcggcggacgcggcggtggtggcgcagctgcgcgcgtgcggcgcggtgctcgccggcaagaccaacatgcacgagctcggcgcggggaccagcggcatcaacccgcaccacggctccaccaggaacccccacaaccccggccgcgtctccggcggctcgtccagcggctccgccgccgccgtctgcgccggcctctgccccgtcgccctcggcgtcgacggcggaggtaaacaaaccgtcgtactcccacgctcggtctcgatctcttcgatgacttgcacatgcgctgaccgccgccgccgccgccgccgcggttttgcagggtccgtgcgaatgccggcggcgctgtgcggcgtggtcgggttcaagccgacggcggggcggctgtcgaacgccggagttctgccgctgaactggacggtcgggatgcccgggatcctcgctgggacggtcgaggacgccgccgtcgcgtcagtgacacactacacctcttaattaattactgtctctccgttttttaatatatgacgcgatttttgcgatatgttttaacatttattttattaaaaaaaatatataattatctattattttactgtaccttaatttatcattaaatgttttttaatcatgacttaaattattttatacttgcacaaaaattttgaataaaaatgaatggacaaatgtttgtaaaaagtcaacggcgtcatatatttaaaaaaaaacatgatgtagtattttttttcacaaatccatctttaattattgcgattaactagttgtacatgtgctgattgatgtacattgtactacattgcgtgctctcaaaggagttgagttgaaatgttgtggtgtttttggttctttgattccagatactcagcaattgttgatcagtctcagccatcctacttgcgggtaattgaccttgctaattacagttttggtgagtactgattaatctatacagaattgctgacttagttggttcctttgattctacagcctgagttgaatctgcccttgctgaagtcttcactctccatcaagaacatcaagcttgcaaaatatgcaaaggtcagtgagattattgcacgagtgaagtgggcaaataaatttggtacgaattaactctgaacattgtggtaattgtgcgatggaaacagtggttcaatgacagttcagaggacatcagaagctgctgcgacaaatctcttcagatgctgcatgcgcactatggttgggaggtaaggaagattactgtggccaaaagtactaattgaattggcatttagaaatttagtactagcaattttgtcaagaattctatgatagctcaattggtttggcagaagaagaactcattaatttgttcttgtgattctttttttctcgctgcaagactctggatgtaaccataccggagatcgaagagatgcgccttgcgcactatgtgacaattggttcagaatgcactgcatcacttgctaaatatcttgacaagctgtgagttatcagaataatgttatttgtatggctttgatgcaataaacctgtggatgatctgaccataacttgtgtgaattatgtcaggaagagatctgaaatcggttgggatgtaagggtcgcacttggcgtgtatggttccttcagcagtagagcctacctgaattcgcaacggctccggtgagttcacatttgtcagatgaagctatcatcagaacagaataccttgtaaacatgacaatttagtgatccagtgtttatattagtactgaactgctagcctatccatgtttgcaggaatcgtcagatgtacttccacaaggagatattcaagacggcagacgtgatcgtctcaccaatgaccgggtattttcatctttctcctctacccattctgttcagataacctcacatgaatcacttggcatgaaacatttctcactcatcaaatctggaaagcaattttggcactcgcgacattgtcatgataagctacagtgaccgtttctgaattcagaaaagcattatgccataatatgcatgattcaaaactctgtgtacttttttgttttcactagagtgtgttcatcctaccttatttaaatctttctgcagtgtgactgcctacaagctgcaagacgacgcgctaaaaagcggagaactggactacataaatggaggtaatgaaccaaactttcaggagaaaaatactcaataatttcacacctagtacaatttatcctaaccgtgttccccatgcattttggatcaaagccgcgttggtccggtactcaattgcaggaaacttccttggtttgccggccatcaccgtcatggtagcaaataactgaacttgttttacagcttctatcagcatgaacaaacctacatatctgaatctacaacgttgtgatcaatctgtcaggttgggtatgacaaagccgggctgcccatcggcctccagttcatcggcaggccgtggtccgaggcgactctgctccacatagcatttgcaatgcaggcaagtgaaaattaacagcctttttcctttcaagctgaaattagtatttgcatttgttttgaacagacacctgaaaaatgtgagttgtgtttatcattactctggaatttggtatttttgcaggaggcgtgcaagaagcactacaagaagcctgaagtgttctacgatctcctcaagaaagattaaatccgtaggctgtatgtatgtcagaattcagaaaattcagatcattgcttcgatcaagtctccaacattgaagagaatccattttaagttagcacggaagctgttcttccatttgtgtcagggagaacaatgtagctacatgaccagaaggacgagagcaaaattagatcaattgcagaaactgtttgattagcggaacaaaaattaagtgaaaatgtatgcattatatgacaaatagtttctgtatgatggtgccaaaaaaaagggcaaaaatatatatgtgtgaaattttagtagcatttctgctgcatcagctgcatgtggggcctctgccatgtgggtcccatggacccaatcggattgtcagcgcggtggccgcgcatacacgtgggcgcagggggcaaaccacggacgtggcgacgagtaaccccaataaatcattttgtgagttgacgatactgcccctgatgcccaggcaccagcaaatacgtctctttcagaggggcaaaattgtctacagatatatggtccatcttataacatctgaaaccaattgctatcttaaattgagaaggaaggtaataatatgttggtgcaacttgaaagcaacattattataaacttataactgaacctagtagaacttcatttagatttagatttataaataacacaaggccaaaagacaacaacttttgacatatgcactaagtatgcattttttaaaaaaaaatgcaacaatttgcacgtcaaatatgggaaatgaactatagataccctacaaaacagttaaaattcaaaattagtccaacaattgaggttaacattctatctcatatgtaccattataaaaattttcttgcaccaacgtaaaatcggtaaagttggatcgttgaaagaataacgagcaacttatttttgttaaaaataaaaaaacacgtttttaattactgttgtacatagcataagtgaggtcttactattttaaactcatgcacattgaaaatggaagatggcctaacaaaggattttattatctcgaactagtagtagctagccaaaaagaactttttatctctttgtgacatggggcaaaaaaaaaagaaaaagaaaaaagacagtgatgcccttactaacccaagacaaaccaccagccttgcctctacctgcctcacgagggcaaaaccgtccaaacccagccacgccgccgcgtgcgcctctcgtttttcctcttctcccacctccgtcttcctcctcctcaatccccaaatcgaagcactcctctcctctcctctcctcagatcggatcgcgagagccccaatcccaccaccgatcgatccattcctgctgctcgcggccaccggagaaggagagagagagagagctcgacctcgtcggcgggtgaaggatcgcagcagcagcagcggcggtagagcaggaggagaggcgaagatgtcgtcggtgttcagcggcgatgagaccgcccccttcttcggctcctcggcgccgctccgccctcgtcttctcatgtactctctccctccctcctcgatccgccgtgatccacgcgctttgatcccgatcccgatccgatctgtgaagcgatcggatccgcgatgcggtttctgacgagatcgagatctcgcttatgggtgtggtttttgcaggcatgggggcggcgtacgggacggcgaagagcggcgtcggggtggcgtcgatgggggtgatgcgcccggagctcgtgatgaagtccatcgtgcccgtggtcatggctggtgtgctgggtatctacggcctcatcatcgcagtcatcatcagcacggggatcaaccccaaggccaagccctactacctcttcgacggctacgcgcacctctcatctggcctcgcctgtggtctcgccggtctcgctgccggaatggccattggcatcgttggtgacgccggagtcaggtataaggcactttgctatcatacacgctgatttattatttgtgattatcattaactttgttttgctagttgttagtatagttaatttgcctattgtcaatctatctgcatgtgattagatcaggagatgaaaagtgcaccaaactattagtgaagtattacatttgcaagtgtatacttgtttatgtgaatatgcgaaaacaatcttttaggccgtcaagtacctaattgtatatgttttagattttatcattttagcgaacacgtcgtatatgacaaactatgcattttattttagggaacacgttgtatatgacaaactatgcatttctgggagcttctgtcttatgctttgcctattacattgatatatcaaattcacacttttgtgtgttaaaaagtgtgtgttaactagcagactttctgctatcactgtcaaatgctaagcttgaatgtgtgtttaatcatggcttcaatctattaaattgcacaggctttactgtgctatagctgttttaggaccatgctgtcaaactgtggattaaatcccttcggtgttaacatcttcacagggctgatgacattgacaccatggatcattctttatcgacccaaagtttctgatgcttataataggatcattctatgtatttatccaccatggaccaaaagatatgaaatgttccatagtattcatacagctatttaaatatacatcatgaatattagatttggtattttagaaacctttcctaattcatacaaatctgactaaaagaggctcacttattccctagattcttcttttgaggttaggggtccagtagcacaatatgttatccttttattttctctgtgtgactgactaatacagtgttcagtgaaattgtgcaatcgtgaattatgactaatacagtgttcagtggaattgtgaattatgactaatacagtgttcagtggaattgtgaattatgatgtgctgatttataccactatttcaacttttgtttcatacctgtttgtaataaattctatagttcatatggcatcttttctgtacatttttgttgctttgtaatttgttaactctattcttctaaacatattcaaagttttgaacactggacaaggcttgaatttattatttgtatgtttacgattgattacctgaagagaggttccgcacatcagcacgtgagaacattctcacctaaaattgtttagatattcttgtcaaagaaaccccttctttagagtagcgtgtaactataagtggagttatttgaggctttaaatttttctaaaagtcaacacaaaagttttcttcaacttgtttgtggcttgatattttgtactgaggatattaagaactgcgttagcctcaaagtcttatctagaataaacatgttttacttttgtagtagtttgtggcttgatatgtgaagttgttggcatgtatgcaatagcaatgatgattttactacttataatatttgacttctaatcatattctttgtcttcagggcgaacgcccagcaaccaaagctgttcgtgggtatgatcctcatcctcatttttgccgaagcgcttgctctctatgggctcatcgtcggcatcatcctgtcatcccgcgctggccaatctcgtgcggattaggcatgtttcaacacgcaaacccttagtgggttcttgtttcatattcctgaaactacaagctgagctctaggggtttattctgtcttagtttctgttcttctgttgggtcatgaacaaaaaaacatctgtatccaagggatgtttgcccttgtggtgccattctttttcgctatggtggtgctggcggcggtctgaatcttatttatgcacagtttttttgggtctggctagacagtgatgtaatctggtgaataagcaaataattcgtaatgcaatgggagcatgagactcttttgttcactcaatcctctattctttttattcgtcattgagttgtgattcctgatttctgcaaggtaaattcgcacatggttgttttcagtctggtacagttttcgtacattccttctatcaccatgttgttgacatacaacttgtagaaattcagcgtgtcactggaaggatatttatttcaattgtcttaaaatacagcaatttcttacgataaattttgtttcagaatacagccactttttttttttgagatgagagaatataaaacttctccatcgctctctcgtctcaaccaataatatctttctacttttacgagtagttcctactgcaagttccaaaaggttcctagtacagcagtttcctcatctgacaagcctggcagattgcttttgtgcgattgggcaatctctacaaattgggtaggccgcctcagtttgggacaatccacaaattggataggccgcctcagtttggagaatctagctgcaatcatcttgccctatctgaagaatgtaaagtccacgcacttgcacagtcccgatttgtctcttgaatgccttgcgtcgcaaatcctgatttcggataaaaagagcaaccagggcaattgacatgtatttcctccctcccatgaaaaatcagatccagggagaaatttagacatagtagtgaatctaaacatagtatatgctcatattcatccttgggatttgaattttatgacattgaggcattcaacttacctaaatagtgctcagaaggacacaaatatatatactccatcttcatctgtttcaaaataagttaatctagtacgagagtggtatatcctaataccataaatatgaaaaggcacctattcaattttgtagtactatgatatgttacatcaagcatacttgaacaaaccaaaatacagatctaaatcataatggtgtaaaatatcccaaaatgatatatttaagctactttgaataatggaattagatcccagcctttagctcaagagttcccaacaaaaatttattacaaaagttcaactttcaagttataagacatcacacgtcgatgtctagatgaaaaaaaaagtaatccatgattggcgaaattttacaataccatcatatcaaaagaacggtataatatattaaggtatagtatcacagaactaagtgtttatcacaaaagcacgcgtggatgttttgtcctaacattgttgtcttgacaaaaacttttgaaatatatagctttttataaatcatttctaaatctgtagttttgtcgtacgccgacttaaatgtacgtaaattgggaaaattcaaataccttcctctttctggttttcagcattttttcgcgccccatgggtctccattgtagtgagcaaagttgctccttgcaaccttacctcgacctactttcaccttccgcttttacccactttaattccattgtagtgagcaaaacaagatgatgccacttacttttatatgctttaattccaccagtattatggcggcaaaacataacgacgatcacataccatataaaaaggtgtattaaatttcatgctcaacgaaataaaacatggggacaacttcgctcaccatgctggaggtccacaggatacgagaaaccgcagagcgcgacgggaaaaaatcacttaaaactaacagaggtaagaagctatctagttttcattggaaatactgaccaataaatctataacaaagaggataatatctcctaaatgtggtttagaaccaatgaactatcatgacaagttgagtttaactaaaaatgggaccaagtgcagcatactttggcattgaacatccatcccccttgatccattaaaaccggtttcaacttcatcagctaccaagcaccagaactagttcatctgggcagcaaaactagctaaatttcacgcaaagattttccccaggatcgacgagtattcacaatgtcaggtggtaaaactgtttttcctgaaaaatcaaacgaaaaattggtattcctcatctcattctcagctgaaattattcctcttttttttttctggctacctaactaaccaagaaatcgtcgccgtccacgatgagcggcgccgacggcccgtcgagcagcagcgcgtccagcgagctcgccgcgccgccgtcggtggcgggcgcggcggcggcgactggcacgcttaccacctcttctttttgctcgtcggggattggctcggcggcggacaccggcggcggcggtggagtggaggggttggtgctctgccgctgctggcggcggagctcgagcacctggcggtggttggcggcgtgcacggacggcgagaaggtggggctccccttggggcggtactccggcagcagcctcccttgcctgtaccgcacgccgcacgcgttgcacagcgtgccgcgccccgtcggcccctcccgccactgcggcgtctccgtcgagccgcagtgcacgcagcttctcttcctcttcggcttcttcgccttcgccttcgtcttcgtcttc

SEQ ID NO: 57463 - DNA, 5151 bp, Oryza sativa
ccggaaggcccaccacgccatgggcacggcgcgggggaggtagctgcgaggcctacggggcacgggcacggcggcgtcgaggtgggcgatgaggacggccagcgacgccatggccgggagcgcgaggacgtacctaacaccaccaccaccaccaccgccgccgccgccgccaacgtcgccgtcgccgtccatgtcgccggtcgccgccacagatcgccggagccgtaggcgcctttccctggctaatccgggcggctgctcggcaacgaaatgctatctttagacaactccctctcgttttgcaacaaaaatcaaacccataaaagaaaaagaaaagaaaaacaagaagccaagagattgacggatacttgtacctctcctattccgccctccaccgccgccatggatggccggcggcgagcttgcttgctttggccgcgcgcggcaagcgagcggcggcgacggggcgcgtcagcaggagagggaaagaggggagcttttttttttttttccttcttccgtgagagatgccgacgcaggatgtgggtcttcttatttggggcgtctctagtgacgttaaaatggggaaaagaagctttttttttctttttttcctttctgtttctgttgtatttgtctcttgtatttaaggttggtagaaatgaggtggattcaattttgtgtcataaagtataattgtccaaatctctttgcctcaactgcatttgttcatatgtgaatgcgaacttgggttccttggttaacatgaacaacatgtgtggaatgtctatcgaggaagtttacgtgtcaatacgtatggagatggaatggatagtttatgattcagtccgtctcggattcggataagagtgaccgagtgaggatctggtaacggctttttaaaggtccgacggattgtaacggacgaatgaagattcggtcacggtattcattttgtcggatgtggattatccgaccaagttaatccaagttttctagctttcatagattcgattcatgtaccatcattagcatattagtgttccatttgtcgtttctacagtatattcggtattgtcgtttctatcctatagacttcccgtgtgtctagaagtaaaattggatcccttgtttgatgcttggttgtcgtttgtttgccaccattgtagtttatatgtatgtgatacttccatgcatggaatgtatatcgaataagtttacgtgcccatatgtaggaaatgaaatgaaatggatagtttttgattaattctgtctcggattcggacgagtgaccgaatgaggacctggtaacggttttttaaagatccgcagatagtaacggaaggatgaaaatttggtcacgatattcattttgtcggatgcggattattcgaccaagttaatccaagttttctttatattatagactggatcatgcaccatcatagcatatattattgtttcatttgtcacttctatagtatatccagtgttccatttatcatttctattcaataggcttctcacgaatctaggagtctaattggacccttgctttatgtcaggttgttgcttgttaccaccgtaccgttgtactttatatgtatgcggaactactgtgtacgtaacgtacattgaataagtttatctctgatggcatgaaaatgttccggttcaatccattttagattcagacaagagtagtcaaatgagaatttcggtaatgcctttttaacttttaaattaagatccaatagatagtaacgtacggatgaagattaggttgtggtattcattttgtcggatgcagattatccgaccaagttaatccaaaacttttgatataccattggttggatcatacaccatcatagcatatccactatttagtttgtcgcttctatagtatatctagtgttctatttgtcgcttctatctcatagactttttgcgagcccgtgagtctaactaactaccttgtttgacgttaggttgctgcttgttaccactctcatactttatacatatgtgcgtattggtccatttctaagttgagtccactcggactccttagtgttttcaaagtctgaagtaattcattccatatttgcaaagttaaaatccacttaaaaatatggtataatattcatcatccatcctcatcccatccatttcatccctaccaattatgtggcatatttggagagtccttatctcttggggagaaaatcaaagggatatgccatatgtcagataacttcagtgagatattttgatgataggggatgcctgatatggtataagtcaagtaatgacatgtgcaaatgtaggtagcaagatagaacgaagttacgaggatactcttaaatttttaaataatatatctgtacatatcacactataaagataaggttaaacagttactccctccatttcagaacgaaagtgattctagattttttttttcaagagattaagaagagattgaggagagtataatatttcttataaataaaatatggttggcgacgggatgatgatcatcgggagtaatatggaaaggggaaaaagatgactaccagtaccatggacggctgtggcctgtggctgctcggctgggagggtcagctggggagggaaagagtgtcagctgaagatgacgatgcaagattttggctctctttctctcttcattttctggtgtctggagtgacgcaaacacaggaaaaataaagcccctttttttttcagtttttgttcccgttgtagttgtctcttgtagtattaaagttggtagaattaggtggaatttaattttgtgctataaagtatacaagtctataagtctcttccacaactgtatttgttgcagtatgaacgtaaatttcaatttcttaattaatacgatcacgtatgaaacgaatatcgaataagtttacatatcactgtacataaaaaacgaacgggatagtttccgattcagttcattccgaattcggacaagaatgaccaagcaaggatccagtaatgtcttttcaagaatccgacgttagtacgtaccaataaagattcatatatggtattcttttttgtcgggtacggattatccgaccaagttaatcaaaatcttctatatatcatatcaatgatttggatcgtacacgctcatagcatatccactattatgtttgtcgcttctatagcatatcctgtgttcatttgtcgcttctaccattcagactttttgcaagcctgggagtctaacctgctcgatatcaggttgttgtttgttaccactgttgtactttgtacatttgcacatattggtccatctctaagttaagtccactttgactgtatagtgtttctcaaaatccgaagtaatccgttccatatccgtaaagttaaaatccacttcaatggtataatatttatcatccattcttattctatccattttattcgtaccaatctcattgggaggaaatcaaagggatatgtcacataactttagtaagatatttggatgattggagatgtctaatatggtatggtaaagttttgatatgtgcaaatgtagatagcaagatacaacgagtgtactcttacttttcttatagcatatccgtacataccacatcatatagataaaaggtccctcccctctgtttattaacattggtgattttagattcatttggagatactaaggttgtgttttagagaaagagggaagattgatagaatatgtaaaatgagatgaactattagtataagaatacactcttattttgctagctaattaaagtgtggcctactttttattggccataacttagctaaagtgtggcacgaaagtatgggaaatggtgataatgttagtatagcatctaaacaacccctaaattgcacaaaaccataactgttttggcgcgcggcacataaccccatacattatggtcataaagtttatcgaacatgccattgatcattttttttactttagtctaccgtatattcaagttctataattacacatcaaatttatacgttctttatccattatataaatattacatctatatgaatatttttcaaaagaaaattgatataggagtatgctaaatcggttaatggtgtggttttgtaaaactttaatatcgtaataaaggttatttattacatgtcaaaatgttcacggttttatataacttacatgatgaagttgtacaaaatttactcatttgataataaggtgcggtttgggacaggatgatcatcgggagtaatatgaaaaaaaaaaaaaggaaaaatatcatggacggcgagcgagcgagccagctgtgggccgttggccgtggctagcggacagccatgccagcaggagagggaaagaggggtgcttcagtaaaaggtaatgtcgcaaagatgtttgctctctttctttcttcctcttttttctccttctcgagtgacgcaaaaatgggagaaggaactttttttttcccttaggtttttgttcccgctatagttgtctcttgtattattaaagttggtagaattaggtggagtttacttctatgttatatgttataaagtttatttgtctaaatcttaccatgactgcatttgttgtcgtatgaacataaatttagaatatttcatcaatataatcacatgaaatatatatcgaataagtttacgcgtcactatacatgaaatcggatggcataatttttggttcaatccgatttagattcggatagatgtggccgagtgaggatttgaaaagcctctttcgacaggttacaacggatggatgatgattcggatatggtatttatttttgtcgtatgcggattatccgatcaagttatccaagttcttttataccatagattggatcatacactatcatagcatatccacggttccatttgtcgcttctaacatgtctattgtttcttttgtcgcttctagctagcatatagatttcccacgaacctagtagtctaattggatcccttactcgatgtcaggttgttgtttgttaccactgttgtattatatgcatgtgcacatattggttcatttataagttgagtccactttgacttcatactgtttcaaaatccaaagtaattgtcccat

SEQ ID NO: 57464 - DNA, 4962 bp, Oryza sativa
  unsure (1)..(4962): unsure at all n locations
cgagtgatgcaaaaatgggaaaagaaagctttttttcagttttattttggccgttgtagttgtctcttgtattaaagttggtacaattagttggattcaattctttgtcatatattcccttcatctaaaaaaactcaacctaggagggactactcctaggacaacaaatctggataagggtagtccagattcatagtcctagcctcctaggttaagtttttttagacggagggagtagtacattgcaaatttcttgccacagctgcatttgttctcattttttaatagtggattttcattaatctaatatctatatgcacaaaggatatacatagccaaaagagatacaagagcacagaggagaacatacaacaatcaaaaagaaaaacctacaacctcggcacgcctttgcttctcgacatcctctcctgaagtagccagattcggtgagtgcaagttgtctagtcatcgcatttgttctcatatgaacatgaacaaggaattcttcagtaatacaaccatgcatggaatatatatcgaaaaaaatttacacaccattatgaatgaaaacggattggatagtttctgattcattcggtttctgattcaataagactgcctttttaaaaattcggcaggtagtaacggatatattaagatccgaatatggtattcattttgtcggatgtggattgtccgaccaagttaatccaatttttctatataccatagaatagattgtacaccatcatagcatatccaatattccatttgtcgcttctatagtatatctaatgttttgtcgcttctatcatatagatttctcgcgagccagagagtctaattggatccttgcttgatgtcagatcattgcttgttatcacttttgtacttatatgtacgtgcctattggttcatttataagttgagtccactctgattccatagtatttacaaaattcaaagtaatctgttccatatccacaaagttaaaatctacttagaaatatgttaaaaatacaatatatttatcaaccatccctatctgatccattccatccctattaattaaatggcatatttggagtcctaatctcattgagaggaaatcaaaggggtatgccacatgaaaagggatatgttcagtaataagtttttgaaaagggataaggtacaacatgactgttattacctgattccttctcagaacacctggattgaatctttttattattattattttagaaaggtggactgaatcttttgatatgctacggttggctactgtggagggatggcaaattcaggttcatttggcaattaggaactttataggattttttttgttcaatttctccaaaattccttaaacattcctccattccaaaggaggtttgaattttctatgtgctacgcatggctgctccggagcgatggcatacggattacattaggcttgaccgctaatttatatggtaaaatatatgaaaaacccacaaaactataatagccttaaaatgttttgaggcaaatctacaagcatgatgtttattttttttctaatacataatacattcaatctaaatatattttttttaaaaaaaagatatttaaagtttaaaaagtttaactcgaacatgtacaactacaaaacgacttgtcttcttggctggagggagtaattatcttcgtgatcataatagccccataatatgtagaatgccttttttttttcctttgaacaatgtaaattcacaagagaatatggcagagacacagaagtaagtgtgaaatgaggctacacataattgtgctagctccaaaagatcaaacaaccacagctccaaaatttcaggctacctcctgccggtatcagcatcttcagtttgctcacaagagctctgtcctacggtagctggttgtgtcaaaacgtcgagtaggcttaatcagcaattcagcattgatcatcaggcgtatagtttagcaagatcatcctcatatgtcttcctgagcacttccctcttgagcttgagggcagcagtgacaaggccagactccggggtccatggctcagatatcagcttgatcttggccgggatctcaaacttctccagtcgcgcttgcttcgcagcctgaaatagcaagtttatgtcattagagttgaatttttcattctaaaagtggacgtggtttgcaaattttcagcttacgttcaaattagtatgccgcaaagggccaggtctagagttcatccaaggatgcaccctacattattgatggacgaggtgagtggagaatacaaacctttgatagagatccaagcacttctttaacagcctctggcttctggcacaaatctacgaaatcggtgtatgtaactccctgctgcgaagcccagttttccagctcattgtgtgcagctaccacaagtgcaacacagtaactgtggaaaggatcagcatggatcatgatgttctccacatatgggctcacaatcagagcagcctccacctgtgatggtccaatcagttaagaagggctaacaactactagtctgaacagaacatgactattgctgaccttcccgagagacacatattcaccatgttgaagcttcacaatatcctttttacggtcaatgatttcaaggcagccatctgggtggaagcgcccgatgtcaccagaatagaaccatcgcatacctttttcgtcatccttcacaagataaatgaggtacaaaggttatgtaaattattgtggatagaaggttattactatgagccgtgaagtagtcatcgaacatattggtaacaagacaacataccttatagacttcatttgttttagcttcattcttgaaatagcctttagttacattgggaccaccaatgacaatctctcctcgaggcattggggagtcacttgttaagtatccaccttctgaccagtcaatcagctggataatataattacaaaaatgtcaagcatcggtgtgatgccaacagataatagtgactagaataatatggagatcaatcagattactgaaaaaagatcagcgtgttacaaatatcaaagcatgagcttgtcagtgatcacaaaaaccaaaacagtgaacatattctttcatatatggacgatcttcaagacttcaactcacagtggtttctaccaaaaacgaattcatctgaaattagaatatgggtaagaaaaacaaaacttaccttaatgtacgaacaaggtagtggagcaccaacgcgaccaacagatgggtcatcatactcagaaaatgttcctccagcacatgtctcagtaagaccatacccttgccctattggaaccctgaaattgcataaacttgttaattcccaggtctctatgcatgttgaaacaaataagcatagttcattcttcattgtgtttaaatttatgatttcattgtgtttaaacatagttcattaaacaaggatggcaactaacaacatgggatgatggtattcataatcttacccaaggcatatattgataaatctctgggtatctcctgatagaggtgctccacctgaaagtacaaagcgaatttttcctcccaaaactgctcgcacctttttgaagacaagcatatcccacaagagtttctctaatccccatgcacccagccaacttccattgactgcggcaagtcgacgattataggcaacatcaaataactgctttgctacaccaccctttgtatccacctaaagccatcccaatatgaaaaataacaatcagtaaattaagaaagagatgaagaacattggacgaaacagcttaaagtgcagtaccttctttctcacaccatcacgaacacgatcaagtatagcaggtacagcggtcatcagtgttggcttgagtgcagaagcatcacccagtgttcccttttttattttgtttgatgtatcagtcagggtcaagggtgatccatatcctatggaagccccaacagcagctatgagtgcctgaaaaaaaaatccatacagtgagttattaatcttaagtaaccgatgatgtaaatagatgctattttagagtcacctcagctgccaactcaagaatgtgtgcaagtggcaggtaggccaggtatacatcctttttaccaatttcaggcacaatggtcataactgctgaaagtgtagccaggacgttccgatgggtcatcattactccctataaaacatttttagtatatgttagtttatttgcagaaaatacagttaactgatatttcacatggtatgtgtatcatgaagtaattgccaacatgagtcctggaagtaaaaggcaaatttgtagcataaagatattccaaaatgagaacactggaaaaacaggtgggcttgggcaaaccttaggcaatccggtgctaccgcttgtatacattatcactgctacgtcagatgggagaggcatgtttgcatcaacaggtgctgtatctcccaatctacctacatcctcaaacggctcaattatccagctagtgcttttttgagctaaagaaacttcagctgagattccttcctcattgatatagataactcgctttactgtgtcaagctgcccacttatatcaatcatttttttcagttctttctgaccacatacaacagtagtaacctctgtctggagaacataagggcaaattagctcatttagtgacagagactacagtacagacaaggtgagacacaagtgactgtactgtctacttacctcatttagtgagtggcacagtgcttcctctcccaaggaggcgtagattgtgacaactgtaatattttgcctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57465 - DNA, 753 bp, Oryza sativa
gctacatatttaaaggtagtatgagaaataaacttacactgtggggaatgcaactgtttaaattataacaaatggttagatatttttatggttagtaactcagtgttgataatggctagatattgttacgtttagtgttgatctctccgaagcaatttaaaccatctgattttctaaatggaagtgtgatttcatatattttaataagactccacgtttaatgatgatagaaaattggtagctttggaatgctatgttctgcatttctgacgatgataaattactagtagtagctttagcgatcagactgcatacctcaatggatatcgctctcctttgtctttccttgaaaccacctatagctgctgtcgtgtacctatgcgtggtaaaattatgtaaacaatcagaaatctggatgatagatactaactactacaagcatccataacattttggttgaattaatggaaggatgaaacatcacgatttgttcccttacagtttttcttaaacaaaaatttctactattcacacaaccaatgtaattccttcatataaaaaaataactatagcaaacagtccagtgctcacccgacaacaaaaccagcacagtgcagcaagaagacagacagcatcacaaccccaatatccccagaaaacaggcctccattcccatatgatgcatcagcaattgttgatctcagccgtacaaagttctcagagaacacgctgtccataagaataaaaaaatgg

SEQ ID NO: 57466 - DNA, 7731 bp, Oryza sativa
  unsure (1)..(7731): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaaagatttcatgtgtaaggtaaactaaaacaggataggcactaaacagtacctgatccatcgtgaagcactttccaattaaaggaccaactggaaagtcttcacggaattgatcttttagatctttcaactctctctccctttctgacagtccctcagaatcctaaacatatgttaaaatatatatgacatagcagaataagatggcctggttgaaacaaccagaatatccaagagattcataaaaaaggggaacaactcagcaggagcattcataagatcaaaaggcaccatcagcatgagtagacaagacgagttatatggaaaaaaaaagagagagagagaaattaagcacacatacctcattgttcgtaactggttgtataaatttcatgtgagaggatataggcaaaatgttgagttcgtcatccatgacgacacatgatttgcaagacgctatggatagcaagaacctctcgttgaacctagcagcagcctgggtatgcgactctgtccggaatctttcatggacatcctgttggagcaggaacaactcaacttagtcaagttatctcagcaccgaagctaagatgtagcatgtaaaccaaaattgtcccaagtttattgatagaaatgggatcatgtatgtatgcatgagagaacaagagaagcagaaggtccaacagagaattgagctcaccatgaccattgtataaagactggtgagagaggaaagggagcggagcagcaggatgatcaaaccaccaccctcaaccgtctcgatggtcctcgcgagtaggttgggcgtgagcgcctcaaaatcctgcggcgccaacaaacaccatatcagtacaggggaattacactacaccacaccacagcagcaccaaaaaggagaaaaaccaagctaagcttgatgttagacagacagacctgcaggatgcacatgccgaatgtgttgccaagaaccctctcggagtccttgtagaggcagtaggtgatgtcagacgtctccaagaagagcgagaaggggtcggccttctcggggtccatgagccccctctgcatgagcttcttgatctgcttggcccgcttcttcttgtggctacacaaagcattccatacaggtaactggaacggcattgctcacacatctccaattcaattcaacaatcaatcaatcggtgcagcaaccaatcgagtactcgaatcgaatcttaagctaagcgaatatggtagagtagggatgggtaaggaacctgctgatctcgagcttgtcgcggtagcaccagaggacggaggggcgggacttgacgcgggacttggcgagcatgtagttgaggttgacgatctggtcgcgcgacttgtcgccgacgatgacgaacatggaccgctgccgctcccgcacgccgttctcgatcagcgtccggatgcgctcgtccaccttcttcctcatcctcgccctcctctcctcttccccgccgccgggccggtctcgtgtggtcacaggagatgagagcgcgcgacggatagcgcggggcggacggcggcggaggcgggctagaggaaggaaggcgccggcggagggtggtgcggcgaggcgcggaggcgcgtacgaggtacgagtgatggagaggaggaggtccggaagcgtggggatttagggtttaagacatagatgggcctttcatgggctcaaacttgaatctacggagataggagatgctgataactttttctataaatttagggtaaatttaattaaatctttattaggactttgactagtaaatttaattaaatctaaatttggctgtgctcttctccctcctttcccaactaacctccctctttttaccgtctgcacgctgctaaacgttgtattttttgcaaaagaatttctgtagaaaaattgttttacaaaatcatattaatccattttttaaaaaaaaattaatacttaattaattatgtttcatgagtcgtacgtgcgcgtggatgagttcctaacttatggtgccgaactcatgatgaaacggagggagtaataatctaatgcataccgacactgaaaaggagccctaatcgaactcatacaattcttaaccagaacaaacaaactccaataccacaacacagtccatcttgccttgcatgaacgaatttagctgtgcagactaaagttctctgcactctggaactctactgtagtagcatctacacaaaataagcgcagagcttactctattgtagcctctccatagaattggttaggcattaagcagcatacacattttctagttaatgctgattctgtattatcacatttcttcaagacatcagtatgacagatggtcataaagaccgtataatattagcgatataatgtgcattcataccttttttttttcctacaaacatgaatccctaactactgtatacatctctcaactctggagacaaaaagaaattcaaaaaacgcaaaagaaacaaagtgtgttatgacaacaatatcaaactattttcttctgatatccgagcacttcatcttcattgacataccaactaggtacatgtcctgcatttgagttcaagtcatttgattatcgtcaaaagtatagccacaaaaatatcacctcgtagtacgaaagttttatcagactatgttaacaacaaagtgaacattagtatgcaagtcaggatactaaccagtctatcacaattcacaatgcatctgcatttctaccacctctcttactaactagttcacaaagtcggcaaggcagtgtgtcaaggctcatttcacgcgaccttccaaagttacccagggtaccacacctcctccatgcatggtattctgcataggctacgggatcatttgcaacagctttcacatatgatgccaactcacggagtgagctgaattttgaggcatctataatagaattgggaggaatgaagtcccagacattgggtgccccgaagtatattggcactgacccagcctccaaggcatagaacaatttctcggtcacatagctttctgtcttagtattctcaattgcaagaacaaacttgtaatgtgacattgcgcagtgaagatgatcccaccagtgtggttttccattatcattggttgaacaaactggatacatggataatgccatgtcaggaccatcaacattattcaagcatttcccgaaagagtggtgcggaaccaatgacaggaaatcttttgcaaccttgtctctatgaggaagacaccttgaagatgaccagtaaataagtgcatcctgacaccatacaggagatcagacattgagatgattaaataaactttttttaaaaaaaaaaaagtactactacagcagaactgattgtgtctcagagtgtgcaaaaataacaaagcaatagacatccacaatttcatatttacaaaaagcattcaggtataccggtaagtaacaggagcaccttagcccccgctgagttatgttgttaacttgttttgaacactacacacaatcggatcttgttggcagttgaaaattgtatgaagtttaaaataaaaatatgagaaaaaatgaaatacagaaaaaaaaaagtatcgaagggaacagctcgacctaaatgtgtgaggttgtgcagctgtggtgcactggtgcctgctaaagtcttaatattatacttctacagtcaactacgcacacttaatcctatcatgctatgatgagcagtgagctagcagagtcaggaacaatgatgtcatgcgccatgtttacataatatattattggcaatacgcaatgaatggaaagttaagcatcatgttgggcttacatttctcttttcagttgatacatggtaacttcggctagtgtggaatgattttccagcatatgttacttgcacatcatctttagcatggtaacctataaaaatgtcctcgaaaccagttggtttcctagcagcctccagatccagatatacacgaagaggcaggcctttcattctctgcaaaacatgttcaagaatatgttaaacttggaaatcagaaagatgttaacatttactttgtttaaaacagcatccttacataagtaatgaaatacagtatcctcaggaaaaagagaactaaactactaacggaaatggtatgtaatggttagtaaaaaaaccaattgtatttgattccatgattaagttttgtcagaattgtaagcctgtaactcatgccactcaatactggcactatatatgtgaatccacaaatattttcgtggagactcttcatgctgttttcgacaagatgaaactaacaatcattgggtttttttattgtatggtggctatatgtgcctaggcagttgttggcacttccatttgggccaggcaggtcaacggctagagtcttttaggaaatatatgtggtgcattagacatcatttgccatatggctacaaggttcattagcacgacatacaaccatttgctgggtaataaggaagcatcaaaactgagcatgtcttcggaataagatgatctgatctcctgctgaggacattgtgctttttcattcctggaattttggacaggccttcagggagcgaatgtcaaagaagtgatgaaggcaggggctgcaacacagccaacactacaggatgaaccacttcggtggcatgaggctcctaaacaccaagcccaaaacgaaaacagagaggaataccatgctgttgcttctgactttatgagagaagggaacatcaaccaaatgttgctgatttcacgtaacctggataccatacaagattactccgttcatcatgtgtttgagggataactctgggagaatgaacagcaatatgtccatatttcaatagttagcaacgcaatccaagagtacgcaatatttacaaactaagggtgcttgtggatcagtgagacgcattgcctagccagcaaaaaataactgcctgcggctatagcccacgcaacaagcgacctgtttcaagtctagctgaggatgtatgaccctctgaaaactaccaagttattacttggcaatgccactaagatacaaaagcagaaaagggggcaagcaatctataggaattaaaaaaaactggcacaattaagtaaggttgtttctctaactgatagtacttccagatatgcattaacactcgaagaattttattaaggccttgttcggtttggaggggattgaagaggattggaggggattgagggggaataatttcacaccacagtaggtgtggaataaatcctctccaatccctctctcatggggattaaccgaacatgacctaaggaacttgttagtccagctgaactatcatcacactcgagcattgcccttttacacctataacactgaaagtgaaaaattgcattcgcgaattcttcaattccgccacacaacccttaccagataaagaagtgtatgaatttgtccataattaacaggaaagtatggaattcacaggaattgaccagcgaagtgagaatcccagtggctacctgcggcggcggcgtggcgccctcgaagagcagcgcgtcgggccggtcgacggcggcggcggacttgctccacacgcagctcaccccgcaccggcacgtgtacaccccgtcgagcgcgtcggggatccacgtccaccccttgacgagcaccccgacgtggcgcgtcctcacgccctcgcacctcccgccgccgccgccgccccacccggccccgccggtgatcgacgcggccgccgccgcggtcgagttggcgccgtacccgggcgcccccacggcgtcgagcttggcgcggatgcgcgggcacccgacggcggcgtcccagtcggcgaaggccgagagaagcgacgtgaacggcgaccgctcgcgggtgccgacggcgtccagcgccgtggcgaagagcggcggcgccggcgcggcggagtaggaggagatggacgggagctcgaagtagccggagacgaggaggaggaggatgacggcggaggccagcatcggggccatgtagttgatccgcttcgggaagagcatcgaggtggcgcgcccctcctcctcctccggaagcttctggaagcttcgcctcctcgccggagcgcgagatctcggtctcggaggagggggaggcgataggtaggaggattcaggattaggtggagtggaattaaaagtttttcgaggggctcttttggaaaagatgtcagttcgcgtatcggaggtttatttcagctacggtgttttttgcgattaggtccttggaagtttgagattttacagtggaaagggtgggaggttgtcgccggcggctgccggtcgtttaccaggtgagaattacgatggtgttgactttgaccatagatgggctgggccctgcattgaaaggccaggcggcccaggcccaacgccaaaatgtaggagtattattttttagatttttcataaacctccatccatttcaaggttgacctcacttgacaacttctaacttgtagccaatgtttggaaatgggtttgggatatgatttcccactcccaaagagtaagtttcaattttagccatccattcatctcaccccatttcatcctatccctctattcatttttatttctcaatcccacctctcataagtcataacccattttccaaacacacatgtagagagagttgtacgaatttatgcctctcccttcccaattcctctaccaaaatccttttatactatttttccccgtagtttgcagaaaatcatcaaatgcagaaatgtttgcaacatcatctgcataactatcttaataaagaagtgcatataagatggtacaagatgggaagaacaacttcttccactttagataacacaatgctattacaccatgaaatacatacgtcatatatatatatatatatatatatatatgatcatatgcaactcgctacgcatcatgtgcaccttcacttgtcaccattctcctcctgatgatcacccgcgaattgctcggatggcagcagcatcgcgagcgaagcatccaactgcccgaatccgaaatccatggcgccgaagcttcccgcggagaagaactcatccccaccaccggagccggacccgacgccggcgatccctttgacgtcaagaaactcattgccgccgccgccgccccacgtgaactccggctcctcctgcttgtggcggcggcgacccgacgtcggcggcggcgggggaggggggagagcgggggcgtggccctggaagagggcgacgtgggcgaagagcttgtccttgcgggagaagctggtgccgcaggagcagagccagcggtcgcggccgcagtgcttctcgtgggtcttgaggtcggccatga

SEQ ID NO: 57467 - DNA, 1231 bp, Oryza sativa
cttgtactcgtcgccgtgcccgcgcatgtgcatccgcaggttcgcgtcgcgcttgaaccccttgccgcagatgccgcagaagtgcgtgtgcggcgccaggatctcgtcctcctccagctgcagcacctcgtacttctcctcctccgccgccgccgccggattctccctcgcatcctgctcgtcgccggcagcgccgacgcattcgtccatggcgccgccgttagtccataccttgaagagctcgtcgtagtcggggctacccatctgctcctcctcatcttccctgttcgtctcgttattacgagccgagctggagctctcgccggcggcgaggctgaccgcttgtgcggctccggccgcggcggcgggcggcggggtggtgcggctgaggaacgaggagttcttgagcgacgggaggaggctgccggcggtggagatgagctggacgatgaggcatgtcaggtcggcgttgacaagctgctgctccggcgtcgccgccgacgacgacgaggcgcggcggccggccatggatcggatgacgtccttgacctgccggatcttctcctcgatgaaggtgaggttgtccagcatcgtgtccgggctccagtccatgtgctggatgctaaccgacggcagcagctgctgcggcggcggcggcgccatgccgaggagagcgtcatccgccatgaacgggtagaagagaggattcatggaggtcaggttcgcagcctgatcgcgcatcgtgttcgtcatctggtcgcgatccattgcaagcttctgaataatctcgcgtgatctttattaggaaaagagatggcgcctctgaaatctgcagaggaagaggaatcaagatcgttagccagttcaaagattgttcttgttttttttcccccaagaaactatttgatgttatttttgagttggttgaaaagtcaagaaactgggaactaattagtagtagtaatctactagattatcaagtgatgcaagatttgcaatctgctccatccttttcactgacacagtcagcaatgctaaaatgaagtttaaatcgattttttttcccataaattacttgatcaaggttcttctctgaacgaatatgctacgaattaaaagatactaccagctttgatcattttcagaatcactaatttattactaacacaagacaggagaaaccaacatcctttttttttcctaagaacaaagaaaaaattttgcaactact

SEQ ID NO: 57468 - DNA, 1646 bp, Oryza sativa
cctcgagtctcggttcactctgctcgagcagttgagcttgagctagacctctctgattgtgggtgtcgcagcctgatttgcttgccgtctctttggttggcagtaacgcaggtgcttagcacatgggagcacttgtttatatcagcttgattatactatggtttagtggagggtagatcaggcctttgcgtgtgattgtatttgttttcagacggggtcctctccgtagggtttgcaatatcgcacggttacaccacggttattgtgcggtaaccttctttccggttttttaaactttatgattcgtaacctccggttttcgcggtaatcgtgatactattgggtagagataatcctcaccaatatggtagtaaaggaaagtctgcctctccactattatgtggccaccgagaactgatatagaactgaaagaaaaatatgagattatttttaagggcacatttgaaatgcaggattatagaaatatattaacattcatgtacgatagccaatctataggattttgcacagtccatttctttgttttaaatgaccttatacaaatatttcccaagaaatgaaatccttcagattttcttttagggcccctttgaaacgcaggataggaaaaacacaggaataggaaaaacgtaggaattgaagttgtatgtttttccaatcctacagaaattgaaaacacaagaaatggagagaggagccctttgattataccacaggataaactcaacaaaggaaagtttcacaagaggtctaatctcttgcttattttcctatggaattgatcataggaatgcaatcctatggaagttttcttatcctctccctatgaatcaaagggctctataggaataaatccttaggaaaatgaatcctccaaaattcctttgctaatcctccattttaaaggggcccttaaatcctttcaatctcaaggagccctaagatgttggtgtttttgttaccttatttttgttggaaatttagtgaggttcactgatgtatcaatggcctttactaggtttagcacttatatttactttacgccatgctatatattgtacaaagttccagttagcattgttccagttagcatcatgatatacatcatcaaacatatagaaatttcattaaacctcacaaaatcaaaatgaaacttcatgaaacatgatctatatttgttaagtctggtatgtctcgctcatgtttttgtgatatttccctctgattatatgaaataacctagtgcaaaagtaaaacttatttccaaatacactagtataaagtgaaagtatacactagaccccatgcaaagtgaaactagatacactatacccaatgtaaagtgcaatttgatcttaatgtatgttagaagagacacattcgtaggtgtgcgagtaaacagtacatgtgtgtattttgtgcaattgaaaaagaatataaatcattacaacaacagaacagttttgtttatatgtacttatgtttgacatattccttggctgtcaactccacactgagatttatgcaaccttcatggcacaggcaaagtttgcacatgggctggtaggcctatagatgtggggtaaggaagaaagggtgaattgtaagagttagataaaaagaat

SEQ ID NO: 57469 - DNA, 1956 bp, Oryza sativa
caatcccgcttccaaaccgcgaaggcgtaaatcctcaatttcccgtcttcgaagcgatatttccactccactccacgcaatcaccgtccacctgcctcgccgcgcgccacgcgcgggaaccggacgaacacccacctcccaccgcccaccgcccaccgccgcgccggccatggctcccctcctcctcctcctccccccactccgcctcctccccgccaccctcctccgcgccacaagccgcccggcgtcgccaaggcgcggcctctcctactcctaccccaggcgcgtcgccgccgtcctgcgacaatgccgcgccgcggcgccgcctccgcctgctcctccggatgccgtgccccggtggcacgcggcgctcgcggctgcggcggggctgtacccggcgtacgtgacggccggcgccgcggtggccgtggcgcggcccgatgcgttccggtggttcgtcgcgctggcgccggggtcgtacacgttcgccctgggactcatcatgctcgccatgggcctcaccctcgagctccgggagttcttggctctcctccgcgagaggcccctctccgtaagcaccccaccccaccctgcaaattttggcactaaatatttctccatttctaggtgtacaattccatggcaatctttcaaatttcaattgtgtccttgaatccaagatcccaaaattgtgactgatccaaaggaaataaattgtgtgttttggccgctgtagatattgtttggttgtgctgcacagtacaccataatgcctgcctttggagcaattgttagccgggtgctggggctctctccaccaatatcagtgggactaattctgctaggatgctgtcctggaggaactgcttccaatgtggtaagattctcaaacttgctcagagaatatgccccatttgagatggatcctcgactggattattgccgcgaactgtctactttattgtggagataaattaaacattttgagaaataaacttaacaaaataatttagaacaagtggtctaagcaatgtagtagaatttgtttttaaagaaaatgtatttttagaggcgtgaagccaggggcggacccagcccagaggcaaggcccggaccggcctatagtatttgttttcataatattagcccatgggatattgggctttcaaccccaggccccgtgccatggcctagggtgcccggggtcggggtccgcccctgcatatagcaaataatacatggctcgactatgagtctatgacccgttttgtactgaaggggaattaaggatcaacacttcaacagacacatagtagtgtaaatcaagaattcaaatgtgcatattatttgaatgttcgagtgttctagcaatttcacagtgccacagtccaatgttgaattttaaatttccaactaggattaagatcaagtgtgctttatgaaggtatatcgactatttaaacgattgattccaacagttaacatatgttttctgagtgccaagaaacacacaattatctagagcaccaagttatttttggtggttcctttaggttatttctacataagacgttctgttattttactttatcttcttggctttatgaaccctgagctctccaagtatatgctgtgtgagtcaaatatgcatgattaaacaaagggtctctcattcaagataaaatcatgatggttggaggcagagtatcccacataggttgtccatgtatgtggatgatgtagttatgttcttcctagcaatattcggggaagcgtcgggtctaaataccaagttcgcaaaattctcggtgtttctgagctgcctagtgtggaattgcccctgtgctgttcatgattcccatgtaccttgggttgcctctgtatgaaaaggcacacaaatattttgcatgctgaaaaaatcatttgtacctggattttctttgttatgtattgacc

SEQ ID NO: 57470 - DNA, 2919 bp, Oryza sativa
atcagttttaaatccatgtatggttgtcaatgcactaagaagcagggtgcaatggcactggtcaaggacatgtaccagcattcatgctacttatgatagattatcaccaaacattgcatcaccccacatggagatgttgttggttggtgaggttcaaggaacccttggagcacatctctatcttgtttttatgtttccacacacaactttagatatgtttagtctgtatatgttgagctgagataactctactggaacagctgcagaaattttatttacattttaatatcagaatgattttcctttttttaatccatgttagtggctagcaactttgcatgataattgatatggtcagatttgaaaggaagctccagggcacatgttgtccagaagaagctaatcatgtgttgaatgagtcataaggtttttacaggtcagattctatcgaacatttctaggtgaaactcaaaatatgaaaaagtatgcaaaggaatatcaataccacctccgtcccaaaacgttactacctagtaatagatgctcatgtccagattcgtagtataggatgtgtcacatatagtagtactagataacaacatttcattttgagacaagtatagtagctgggatgggatgacctgatgacagtcttttacttgccttttcactctgtgtcactgatgggatcatgtgcagaaaggagtttagcattcattggtttggtccaacttgtgaaaaatgaacggatgcatgacaaatctttgtatagtgtatcccaataaatccatcactctactgttcccattaaaaatgaataatttaaaataaaatcgatgatctgacctgctgcattgcgtgcttgagcacccatatcttggttcattggttgctatcagcatccccggggcggctccagcatacagtcgaattttttcatttttaaatttttattttttaatatttacagaaatattgtaccggtgaaagtatttacaaaagtaggtgacgtgagggacggacaagatgaaaaagacactagaaaaatgcatttttggcaggataaaaattacatttgcccccttgcagtccttgtagagggcggcaaggcacctcagtgcaaaatgcacacaccttgccgccccaggggctatttctgtaaatattttagatggtataatatttttgtaaatattaaaaaatgaaaatttaaaaatgaaaaaaattcgcatacagtccgggtggtccaacctttgaccaccctggatcgcgaaggcccaaacgaaaaaaagcccacaagcatcagagccaggttagggttagccggcagaggagagggctcaaagccccgtgcacgcgccgcctctccctccgctgcgctcctcgcctcctctcggctctcgctctgcgccacaggcccacagcgccggccgtcgcccatcggcggcgtcgggtccctctccctcctgcagtcctgctcgagctcgacgacgacgacgagtctatgcctcaagccctaaacagctcctcataggtgagttactcattttagtctttactctttagtatttacttttaatagatcggtcatcgatgaattgaaaaatgtggatgaaaaaaatgtgattgaaaactgaaacttagattttttttttatcaacaacttagttagtagtcaatataacttagtgtatgaaggatgggaagaaactattgtttcattttgcaataaacatagtatccaagttccaactttcgatggaaaaatatgtgcctcatggaagatctccacggttttatccggaccaaacaaatgatgatcattttagaaaacaagtgtacattggtgtacaaagaagtagtgtattgtaatcttctacctatctattgtaatgtaagatatttgaattatttatgttgtaactttcgtaacttcgaacttaaatgttggttttaatcaatttgtgatgttctgagctatattgcaatatttgaattatatttccaccgtatttgtcaattttgatttgattttgtaacatcgtgacaatttgggatgccaagtaggaccacccaacgaatcgatcctagagccgccactgcatcgtctcctcgtccgccgccgccgccatgtgggcgctccgccgcgcgggcaaccccctcaggtacctacctacccccgcctcctctctctcccccgccctctgccactgttcttgtgggatttcgttaacagatgattgattggtaataaatctgtggcttatgttagttcgtgtcatccgtgcctttctcccactcgcgtttttctgtccctgttgcgtggtggcgacaagtagatccatccaaatgccttgtttagttcttgggggtttatttgtgtgattttccggtgccaagttgtgtggtgtccccgttaataggccgtagtttcttgttaagattgatcattgggtcttggatgagttgatcattgccagtgatttatttttacaggtggggagtagggagttgctggtattattcatctgatgttgggactctgttttgttgtaatctcttgaatttctatgcaaattgcagtcttaccatcttgggtttgactgaaatatatcagtcggatgtatgtgagagacatgatagtgtatctactgtgtgtatatgtgcttgaagaagtacccatcttagatgtttgtctatgtagacatgattattactttgcgtagcattatgtacggaacgatattagatgtgtttgaagatggaacaacacctcttcttgtttcaatcatctggtcatgttattgtgaaatgaagcagatattttgtatttcgttttgcatgtgaatccatgttcacgatcataatttgtacctatcatcccatgtttcatgcgttgttaatactgatatttggctt

SEQ ID NO: 57471 - DNA, 9309 bp, Oryza sativa
attgataatacatgtagcgactgttatgctcgttagcttggcatgtgttaagaatgttactttctgaaacatatttgcaatgtcaatggtgaatgagcttttggttttgcacataaatgaagagttatagccttgtaaaatgtagcatgcactagatgaggtaggggcactttagaatgatatgtctatatgcttcttcttcgagtcctagagtattaaaaaagaggaagtgatgaagtactcttagtcaactatgggaatgatgctagacagctagagggtgaagataagaagcacacacaatttccttgactattgaaaaatacaatgttgttgagatatcaccagttcaccccctgtacttctatgttacatcctaaacttaatttagtatgagaatgttattgtgactttgtagatcatgtgaatggtgtgcaaactgcatcttcttttctatagtatcagactctgaaatttgttagagtgcttgtgttggttttgtttgtcaaagggcgttgtctttttctgttcattccatgcacgttttgagtattactccatttctttgattccctctttatgctgcagcttttattgaccaccattttattttactgttaagcattccaagcatgtttaccccttaacatacatattgtgccatctgtgcttttaaacctttcgttgtaatactcatgtttggttatacatgatgtttgaaatagcgtagccatacttgtttctttttatgtgcaatctaatttgtgacatgatgaaatgaatgctacctttctttgtaaattactagctaaattgtgtgttcaactgtctatactcttatgtacaaaacaaattcttgtttgtaacttagtggaccattgtagctatctaatagatcttagtcatgcagctataactgtcttagataataacaaagccaccttgcttccgaatgcatttgtaccgctgcatggtaaattttcaaaatctcactattctttggttatttgtagctatacacggtgtttactttgatggaacttgttacgtaaacttttttcatgtgaacaacctcatatctaaacacttaagcttttttcactgtaattatttacctcggtctttgtgttttctaactcagaagatatttacttcattttctgcagcttctggagtatgttgaagaatccaaactaattgatcttggagaacgtgattatgcttcacgcgtggatttggtagctaaaacccacagtatttacaaagctgaaaagtacattgagaatgttcctgcatctcataggggtgagattgtatacaggactcttttggctaactgtgtggctatagccaatgtgaaaaaagcagaacaagtcttcaataagatgaaggaccttggatttccagttagcgtattttcttgcaatcagcttctgctactctacaagagagtggacaagaagaagcttggtgatgttctcacaatgatggaaaaggagaatgtgaagccttccctcttcacttataagctccttgtagataccaagggtgctgctagagatattgaagatatggaaaaggtcattcaggcaatgcaagcggatggaattgaaccagatcttctgtttcaagccacaattgcaaggcactacatatttggtggttatcgtgagaaatctgaggcaattttggagcaaatggtgggggatgatatcaatgaaaaccgttctgcttgcaaatttgttttacccctgtatgcttttcttggcaaaaatgatgatgttgaaaggatctggaaggtttgtgaggccaatgctcgtctagatgagtgcatgtctgcaatagaggcttttggtaagcttggggatgttgaaaaggctgaggagatatttgacaatatgttcaagacatggaagacactttcgtccaaatactacaatgctatgctgaaggtgtatgccaacaaaaagctttttgacaaggggaaggagctagcaaagcggatgggtgatgatggttgcagactagggccctatacattggattcacttgtgaagctctattcggatgcaggagaggtggagaaagctgattccatattgcataagctatcatataagaacaagattaagcctatgtacaccacatacttgatgctgcttgatagttattccaagaaaggagacgtccataatgcagagaaattgttcagcaaggtgcggcagatgggttatactgggaggattagacagtatcagctgcttcttgaggcatatctgaatgcaaagaccccaccttatggattcaaggagaggatgaaggctgatgacattttccccaatagggctgtggcgtctttgcttgctgctaccgatccattcaacaggaagaacgcaatgtctgaattgctcgattaggttcttctgttagcttcattttgtgcccatctaatacatgtgctggttgtccttctgccaaaatatatatgacatgacgatgagataataaattagccttagcgatgtaatgaactagtagtgtttgcttaccttttgcggctattgccttaccgagcaggcgagtaggattggaatcttatgaatgttaatcttagttctattttgtctacttcattgacgtgtcactatctcttgacttgttaattagcaaacaaatgtcagttttgctagtccttaagctaatgatatattaaggtttctttaggcattcttaaccattttgccctatgaacttattatgtttgtttgcgttgcactgtgctgtactctatcaacatttctttactgatagagaaaatgatactcttgctgcactgtgatctgacatatgttgcaaccttcagtttgtttaatatactggtttatcaagacaacattctttcctgagctggagcgatacgaaattctattttgatttgacttaaaaaaaaaggcatttccatcgttccagatttgcaaagatacaaaattcatctttgacacaggatcaaaactgcttcgatccatgcgaacacttatactgtcactactcaggatacaagcaaggggagattagatatggcgataatgtgtctttggcttaagcattctgaattctgacacaaatcccccaagcaaaaaaccgggctttgatctctctattctctacaggtagctgctgacgacgagcgacctgctcatgtctcggaacacgctctccaccacgccaccacggacagctccgtcgccgtcgtgtcggcgccgcagaacgccgcccagtcgttcaccgccatgccggcggccaccacctcgctgccccggttgatggcgtctgcgggtgaacctgcatcatcatatcattcacaggtttcagagagctgcaaactccagtgccagcctagctaattgggggtagtagtagtgattagtgacgctgatttagttaattactccctccgtttcacaatgtaagtcattgtgaaacggaggaagtagttgtgataagaacttacagaagctccccaccaggatgtttcctgcaatagtttgcctgaaacacttccacaccaagaacatctgagatgacctcttcggttccctgtttgcacgcaatatatatagtttggtcagatggacttatatgctggcattgtttgctaattgctcctatatgctcaactctgtgattttggagtagatttatagatgcatcagctgcctccatggttggtgttttcatcgctattgatggatgaactttttcccacattggccatctctgtcgtcatcaagggaaatactgaaaagctaagtcatcattagtttttttctttatatgataatttccttatcctctgcctcactacatcaatcggttctccattgagcagtgagtcgggggctacagatgttatatcatattttttcaataattttcataatatctatcttgattgcttgtgaaataatccgagtaaaaataaagtgtcgatcgagttatggagttctatcttcctatgctttccgtttggtttgtcgatggatagttgcctttgggccgattcctagcacccggaggctcgttggatggaccgagtaacgcaaggtgctaagaattacttggaagaaatcaacagcatagagataagatgatttgttttatgctcttaacaattgcaaaattacccgagtagtaaattctgatccgtgaaactctgttccattaatgatgaactcaagtcactcatatgcatgtctgggaagtgctttggccaactcccggtgtgtgggggctatgactagtcgggcagagtgtttaaacgtaaggagtcatttgctcggggaaattaaaattgacaagaggagaaatacatatttataaacatcttaaaatacttgaattttcctcaagtactgtatttacatcatatactactcatcctatatgtttgttctgcaggatctagatccagatatgtataatggggattcatgactttaagcttatctcctaagattcaagaatggatcagtcagaacatcaccatcggcttgcctccgccgttgccgactggtgtctttgcctatacggttgtgtaacatcctgaaaattcctaacaataaaaatcactaaaattttgaacttttgaaatataagaacacatgaaatgatcacgactataatgatcgtgtttataaataagtaattcaccggaatatatagattgatacttagaacatttcaccgagttcctcatgacatgaaaatcactcatataaaataatggtcatataaataaattaagctttatatataaataagaatatgttaatgtttaattaaacaattagattaatgttgtaccgagtctcaatttatatttatagaataaataaatccacgtaaaatacattgttatacaaataagtttgttcaatgtgctattgtaataataatggccacattaggatattttaattaattttagaaccctcaaagcctccaaaattatctaggttaattttggaattagacctcatttaaataatgcaatagaaatatatatatatatatatatatatatatatatatatatatatatatatatatatgggtaatattaaaaaatcgagtaaactttcatctaaattaacacatatattgggtaaacatcatttgtgtgaaatctagaatttatgggatgagaattagatgggaaatagactaaaataaggtttaattagaaataacactgttcattgcacattagatgtttgattgtgtccctagccaccctagccctcttcctccccactgccactgcacctagctggcttggagccccgagccgccgtcgccgtcgcgctgagtcccgcgctgcctcgcgccccgctccgtcccatcgccgcgccgcgccaacttcacatcgtcgcgcctcgcgcgtgcgccgtgcgaacgtcgcgtcgccacgccaacgtcgcatcgtcgccgcactgtcgccatcgccacgccgcgccgctgccgcccactgcgtgcgtgtcccgtcgccgctgccgcgccgtgtcgccatcgccgtcgccgcgttttcgccatcgcgccgcgccgtgccgctgccacaccgcctgcctcgagacccgcccgcgccgcgcgcgtcccatccgtcaccgccgcgtcggctacctcttccctccgccctatataaacccctcttggccaccctttcaccccgcaccacttccatcccctttcccctctttttctcccctttccggccgccgtagccaccgccgccaatccgccatgccccggcgcctcgccaccgccgcgccgccgttcccgccgtcggtccgggtaagccctctttcccccttcgccgctcttcgccgcgccacgccgcctcgctcggccgagagagagaagaaaggagcggagtagcgagaggaagaaaagagaaggatgagagagagaagataaggataggaggggtagattagagtgggccccaccgagattagggaatagtaatcaccctgttaatctgcattagactagcctatgacctgtgggcccgggtgattaaaaatctaattatgggtagtttttcatctatagcctatgacatgggggccccaccgggatttaaaggccggattgaccttgagtgccgatcacagaacttgtcgcaatcctagccaatgcagagttcaaagtctgataaagatatcctagcagatatttgcctaagggaaattgttttttgtctacaagggcttcggctatgtgttgccagttggtggtaggaccaccaacttgaccacagaacaaaaatttttccagccacatcaccagaaaagctatgtgttctctgggggacataggacctgtacccatattcatggtgatatagccagtccagccacctatagtcctggttttgaaagagaacttgctcttggtattcatactgactgggttagccgatggtgtgatgtccaaaccagtgatcataactatgtccaaaagggttggtgtcatcggtccttggttgaataagaaagcattgtgttggaccagaaatagcttgcagccgataacataggttcatccttattcattttggctaggatcagagccacgcactatgctattccaagttcttcccaatgagtttgtttgctagccgataccctcttataccaatccggccaggttttgacagcagatggccaagatttgaaagcaatagtccagtggcctaaactagggtttgtcagtctgaagggaactctattgttttcggcattaataagctcagtgggatctgtgttgccgattgggcccaagaaaaactaattctgaagagctaaactaggaactgcgacctgatgggaaagatgctacaacagagaagagaagaaaaaagcggatcatgaaaggaagacaatctgtagcaaggaagaagaaagatctaactgatgggacttacctcagggaactcggtcgttggagcgcttgagggattggtggaagtcgacatcgttagatctagggttgtcgccagacttgggggtcgcctgcgggctcgccgatggtttcaaagggatcgccggagaggttggtgactaaagcagtgaaaacggaaatgacggcgtgaaaagcggtggtaactatttaaagaggcgcggtaacggtcgaaatggaaaagaagccctagattctctcggggataagattgaataaatccgcaacattacaaatgtaacggacttgggggccatgtgttaacgaccaaatttggtaaatcatacattggacttggagttaaagccaaagcggatttggaggaaatcgatattctcagaatcaaagtgcgcatcggttgcaaaccgaatcggctacggtgtacatcggttgataccgagttggacagggaagccgatacagccgatttcggtaaagggatcttagaatcattgtcggatttgttttcagtgcttcatgagaattgccatgtgcggattgagtccgaagaaggcaattttatctattaattaggttattttatgtaatttccttatatatattttcggtaaaagtccgcctaagggacttgatcgtatcttgagttgtaatagatataggagtcgtgtccgacaaggacatgttatgtattttgggtataaatataacccaagacagtgtaatcaaacaagaatcagttcaataacacttacgacgcatcgccaccttttttactttcattgttttcgacgagttcttgctttcgagttgggctgcatcggtttcgatctccgacaagaggtaaagcttgttatgacaggttgcgttctcggaattagtgcttacatcttcatgacactctaattttgtttatgtaaatcgtcaaattatcatatatgctatataatttagatcaattaattacacgttattacaacctcgttttacgtgaaacacttaatcttcatcttcatccttatcttcagcacattcaaacaccaccttagtagagctctaacttctaagtttaactattagagttggatttagggtgtacttgtagagtagtctaaactttactccatctctctaaatttttttttgtaagagtactcaagcccgctccgcttcctttttttaacgctgaggacctcatgttttcgcttatgcttagatttatcagccaaaatttgaattttcaaccttaaatttggagctgattttgggggtttttttttatcgaaatttatttttcagccttgcttttagatcgctaagaacacgtatataaaagttttatttacaaatttcttttcgtccgtaaatatgtgtttggtttatttcacaaataagcgaaacaatggggctctgaaactatttggttgagttttaactcaaaaagagatgaagctcgaagtctaccatcagacccttatcaaggaatacatgtgggcttgcttggtagaacgctcagatctcagtgacccatgctagaggaaattaacataccactgtcaacgggatagaaaaaaaaataaacatgcgggtacaaatgaatagctgattagctcaagattttgcaatcactcttgatggatacaacacaaatgaattaactactataaacttaaaaaattatctaaaacattttttgaaaaaaattaaagtgtttataaaaaacacatcgttggaagctgaaagaagcatatcgccttaatccattcttctattcattcgagaagaacacgcatcatatttgtaatcaatgagatgggtgtagatgcgtagtataacatattcattatcaatacttactttaatactgtattgtgttactagcagaaaataacgctgaatcattcatcaaggtgccttcagatacgtcatgttgtcgtcatgcaagtacaacgatgagctcagctgccatggttgagtttcacctaccatttcccccacatccatcatgcaaataacactactcataactcaatggaggacatcatcattcatctcctcttccattcaaacaagctatatatatatatatatatatatatatatatatatatatatatatatatatatatatatatataatattcatttccatgatggaaatagggaaaaaaggaacaaatagccaagagcattgggagataacaaagataaaataataataataaaaagttagaaaaccattgtcacttatgtaaacctattttatatacgagctaggcttatactacctccgttttttaaaagatgacgccgttgactttttctcacatg

SEQ ID NO: 57472 - DNA, 4876 bp, Oryza sativa
gaatccgcgtgcaaaccgcgagacgaatttattaagtctaattaatctgtcattagcaaatatttactgtagcaccacattgtcaaattatagcataattagggttaaaagattcgtctcgcaatttacacacaattttggtaattagttatcttttcgtctatatttaatactctatacatgtttctaaacattcgatgtgagtcacgtgacagggcgtaaaattttgccagggatctgtcaggcctaaaatatcttgaatgattgaaccagttctaaccagaacaagtccgcacgatcacgtggatctagcaattttcgaggcatgtgcgtgtttattaaaaaagaaaagaaaaaactatgcttatataatacgtagtactatgtgagaaggacaatgtcaaaaggtacaatgaattgaacttgattaattaaaccataaacttggaacgatggcatgatggccggagagcttaatttgtcatatgggttatgcgaccccactaatcaccaattaattattcatttcctagtgatcatcattatactttcgtacaaaaaattctccacttcaagtaaggtattccctcagaacaaaatccataaagtaaaaaaggtatgcataataatttatgaaatttatcgatatctctaagaacatttaagccaaaaaggaggaggacaaaaataattaaaaaacaataaattacaaaccgtttgtgcgaacacactaatcaccaattgaaaatcattattcatttcgtaatgatcatcattagactttactatccactccaagtaaggcatttccccggaacaaaataaaatgcataaagttaaaaagaaatttaagtatgcataataattaataaaatctatcaatatctgagaacatttaataagccaagaaggagaagaacataaaataaatgaacaatagaaataaatgacaaaccgtttaggaaaaaaaaccgtgagaaaaaagaatactaaaaaaataattaaaaataccgtgagagtaatttggaggggaagtttccgaccacggttgtcttcttcctcccctctcctctgcccaagaaaaagatagataatcatcactcatcagcatgctccccccacatgccctaacaatccaaaattccattccaatttgcaaaagagagccaaaattaatcatcaaaagccggttcttttgatccccaatccatcctcacatggagcaaaaatctaatatttgcttgtgacctcacctggaaaatcccctcgcaaagaatccacccaagaaaggggagagaaaaaaaagagagcaatcaatcaatcaatcaatccctcccattgcttcacatttcttccttcccttttgcctccataaacctcccctaaagctcctatttttaccccccaaatcgcccaagaatcgccctacccgagagcccttgatccaagatccaatcttttctttcccttttttatttttaatttttttgcgttggtgtgtgttgttcaatccaaatccctataggaggcgagagagagagagagagagagatagagagagagagagagagagagagagagaaaaggttcgaaatttttgatcggaaaatgcagcctgacccgcagccgcatgggcgggggagggagaaggcggcgggggcgggcccgcggctcccgccgccggtgaccgcgccgtcggtggggcggccggcgtcggtgctcccccacaagacggcgaacgtgcgggaccactaccgcatcgggaagaagctggggcaggggcagttcgggaccacgtacctgtgcgtggggaagcccgacggcggcgagtacgcgtgcaagtccatccccaagcggaagctgctgtgccgggaggactacgaggacgtgtggcgcgagatccagatcatgcaccacctctccgagcacccaaacgtcgtccgcatccggggcgcctacgaggacgcgctgttcgtccacatcgtcatggagctctgcgccggcggcgagctcttcgaccgcatcgtcgccaagggccactacaccgagcgcgccgccgcgctgctcatcaggaccatcgtcggggtcgtcgaagggtgccactcgctcggcgtcatgcaccgcgacctcaagccggagaacttcctcttcgccagcaccgccgaggacgccccgctcaaggccaccgatttcgggctctccgtgttctacaagcccggtgagcatcctcggattctgcgcactttgcttgattcggtaatcggcattataatcgtagctcaatgttgttatttggtccaactgatccgacaatggtatgtgggcaaactgctgtcattgcatttagcagagagtgaactcgttagcattttacatatattagatgatggttcattatgctactataaaagcgttcgctgcaatatccataatgtagaatgttggaatttatatggtaggagcaattgcactggattgaaacttcgccaaaactataagcaggagattatagtagttgatggttgaataaattagtaatactatataaatgattagagaggattattcctttggtctgactagtttgattttctaaggtatttctggttgttggcatatttcttttggtaattttcataagctaatttttttagggaaattcattttgatcaccagtagcagttctcactaggatgtgagggtagatgtgggggttatgcagcattgtcttgttgaaattctggtgtgataccatgggggatttgaaaatgatttccagttttaacagtaatggtgcgatgggtgattattcttgtggagtaatctgagttcatagcatataaaatgaaactttaggtgtgtcagttcatatgtgcatgcttcagacataaaatcattctttttgtgctaatctccatgcacttgtctaagcactgtatcagatagtagaggcatttagacaaattctggtataccagaaacatcacattctttgtttttaactttggcaggcttatcattcctgaaaaagtttcctatactatcttttctgaaatgatacacttccagcatagcaatatcaatttcagtagacaatcttgccagtgattacctttttcacaatttggacatgagctatcttgcatacgatggtttttttggcagtaatatatttccttcaagcagattcccaaaaatggttacgctatgctgtacaatatgctgcataaaaggaacaggagcccttacgtgttaccttctaattacttgtttgcatagttgggccagttattctttccgggaatacgcaaaagaattgtgcatctttgtattaagactttaaaagtgccaaagttttacaagactatagccatggaagggtatactcaggaaaataagaaaaacacaccatgccacgtgccaacaccaccaccacactctgaggtagaggcctagcaccttgacggccgccactagcctaaatgatcgtcgccgggcctaaatgcagccacaaccaaaagaacctccaaaacaacgcctccaaggaggttgcgacgttgaataaactgctgattttttagaactttgccttcaattgagtgtggccctatggacaggaatttcctgttatccactccatcagggagtgaattatttagtttatgtagcatttgcttgtgtttattataaataaccaattaaaagttgaaattcacactcaaagtttgttggcaatgaataatgttcctttacatttcttcaggtgacaaattttctgatgttgttgggagcccttattatgtcgcacctgaggtgcttcaaaaaatctatggcccagaagctgacgtctggagtgctggggtaatcctgtacattttgctgtgtggtgtgcccccattttgggcaggtaaaattatctgttgtttctggatattgaattgtgagtatggaatttccggattaccatgtttacataggtaaaattttccttttgcagaaactgaatctggaatcttcaggcaaattcttagaggcaaacttgatttggaatctgatccgtggcctagtatatctgatagtgctaaagatctagtccgtaatatgcttatccgtgatcctacaaagagatttactgctcacgaggttctctgtaagtctttattgccccctccctctccctttctgagggttgatgtgtgcttaagaacctatgtcatgaaagtgtattttactaaaaattgtttgcctacgccaggtcatccatggattgttgatgatgctgtggcacctgataagcctattgattctgctgttttgtcaaggctgaaacacttttctgcaatgaacaagctcaagaagatggctttgagggtatggggatctttcatgtagctgatttgcgtgcaattttatttttcccattgacctattgttcgcactaagtttagtacttcagtagcgctacattagattaatgagcctcacttctattagcatcgccttattattttgatgcattcaagttgactctatattttgtgaccttacattcaagttaactatgcacaaatatatttcctgccttctctggttactcttgtagtttgttaacagtcctcatgttgtagtatgtaatgagaacgaaatatttattaagattagaaagaatttcactcaaaatggaagtgtctaattgaacttatgtcagtcatttgcacatttttaatggagaagattaggacttgcatatccgaactatcgtgtaactgttatgttattaggcttgtctcttcctcatttattagaggtgcagcctgttccattagatattgttcaactggcatcaggggcggagctagcaccaaaactaaggctg

SEQ ID NO: 57473 - DNA, 19536 bp, Oryza sativa
ctgggaaatgtaaaagataattgtattaggggagagcaagtgagcgaaacattcaacaaatgaaaaccatcaacagacctacggctatcgcattcctcatcaggagactccaaagcaagagtagaatcccaaaacctctgcattactgtacttgccacatcatttacagtgtcatttcctccttcaacctacaaattgagaatgcattcagaagcttagcatgggaatctaccgcagagtggaagaactatcagaaattaaggagtttgggataagggaccaccaattgaatggctgcgtgggtaagttgcaggacatccaagcaagcagcaatttgtccttctgttgaggaaaatgtaagacaagcatcaaataataaagtcccagaagatgctttgttattgtccttttgggacgcagagacatgaataaggctctacctcgatcaagaacaggaatatgcaagaactttccatcatgcattatatgtagagcatcaagaattgtcgtgtctaatgtagcaaaatctgggtttacagtcatcaccttcaaaaataattgaaagtaacacagtgagttcatatgcaattaaacaaagctcagatggcatcggaagaggcaagaaaatgtaaatctggtggagaaaccttttctactagggtcaattcaggagaaagattctgtgcaacaacacgcataagcaaatcctttgagctgcatttggatgcatcagtaaagtagaagaaaaataaggaagttgtaaataatagtagaagtactaaaatagattgctcacgtgaagatcccctgtagtgtgtttcctgtagcaacaaccaccgaattaactcgaaattcacgcattttctgtgttgctacatacactgggtctgaaggagaaacaattgctaccctgaaaattaacagaaaatagtcagagaaaactctcactattcattcttttttgctaaaagttaacagaaaatagtaagagaaagcagttactgtactttgtgccctccgtgacaatggttgacaaagaaggtttgaacatcctctctcttagagtttctatgaaagcataaggagctgtatccacaaacagagaataccttaaattgatcattaccaaatataattatgataaacaaacacatataatagtctagtagaatatgatatacctgataagttgttcgacatattttatttaaaagatgtatatagcaacatgaaaagtgataatccataaaatgtaccataaatagtacatgttatgcacggtgtactttcagtttcaagagtgagaaagagtgaagtaattgataataatatccagtgcagtacctgaaaagtgcctcctaattgacgctctacccttctacagcagctgctattgcactcccttgttctgctgccttttccagtcttgatattgcatcgtaaaggcatttagcaatgtccagcatagcaataacctcaccattttccacaactgggaggtgtctaaatttacctaaaatatgtatgaacattttaaagaaactacagtcagtatgtttgtgaaaaagggactagtttctagccaaccaaggtctatgtgtaacaaagtgaaacaaccagcctacatatatgccactgaagttcagggcataccaaagaaatcttagacgtctgacgatacaaatcaaggaatcttcaatttcttttgctggagatattgagattccaagacagctaagatgcctaacattaccaaaaaatgtgcttttgcctttcattgcacacacagaaaaaggggcagattgagctgatctgatggtgacatacaaaaacagtatgcgtaacaaaatacaacaagaaaacatcatatttttcatctaagatagtacttgaaagttgaaagcatgatcatgcaaagagaatactaagttggcctccaacatcagggcttttttagttttcctctctctgtcagcctttcgagggcttacccatcatgtaatttctggatattgcttttttgttctctccctgctataaattaatgggacaaaactcctgcaccctttttcgaaaaacaaaaaaaaaaggagaacaagcaatacacagcaaacaagtactccattcttttaatgctctactaggtgcagtataccttcatttagtactgtgaattatccccgtttcacaaagctctaacaaaattgacatgtgccgattctcaattaggtgctcccaatttgtttaaccgagtactttatgttaagtactacaatttagtgaatcattggcgaaagaattatgcatcatgatagcgaaaatgacttgaagtggcactagtcactacagctaaaataataatagaaatgactggctaatctgctacaatctcaatcatatgaaagaacattttataagatgacaggggaattgaatttagccagctcaatttcactgttacattgtccctatagatgttttagccaagaaagtgtaaaaaaaatggagtgcgtctgacataccttgaaccatcttctgcaatgcttcaatggcaagcgtatcagacatggcatatgtggggttccttgtcatgatcttggacatgatggtttgctccacccgcagcccctcagcaaccacccttgtagctacatcctgcgattggaatcccgaaaaagaatgaaaacaagaaccatcttcatctcgaatcgtagtactaaaattagaccaagtgcaaagcatgttggctttttggttcacagcagagtaaaaagcataaattgaactccatggcttagtggaaatcgacttcactttaccttaactaattctaccttttttgccaaaaccgaatgaaaaagaaaaggcagaggaaaagtatgcatcaataagtataaatgtataattgcagagactagtgaacacatggtcaacaaaaatgactcctaattttttggatgaaaacatccaaaatctaaaggagaacaaaatatcttaaactttgacacccacaaaaagccacttgctatgctccaaactgagaatccaatccaggcatcgatgtttttcaaaagagcaacgagaaggtgtcgcatccgcatagcatcaaattgaaagaatcaaaccatcttctatcttccaaaatcagcatctataaaagcacactagaaattccaaatttccaacagattgggagggggcaagcaaagaaaatcctgtaccttatcagtgacgatgccggagaggaggccctgcgcgtcggtgagcagcacggcgtcgaccctcctcgccgccatcctcctgcacgcctccgacaccgtcgtcccctccggtatcgtcagcgccttggacagcctcagcttcctcaccgtcctctccccgcttcaaccaacagaagaaacccccaaaatcattcagcggctacgaaccaaaggagagaaggaacggaaggaagggttcgcaggctcggtgtgcttacgtcagctggccgggggaggtgggcttggaggaggccttcccgttcccgttggcggcggcggcggaggggtcgtcggacttgcgggaggacgccgacggcgggcggctccgcgtccggcggctcggcggcgccgtcgccgaggccgtgctcatggtggcgctcgtcgcggggaggaggttagcgcggcggcggcggcggcggcggcggcggccggagagttgggagagcaggtggaatggaaatgggagcttcggcttcgtttctcctgcgacagcgcgtgggttttttgcgcttcgaccctccaagtatcaaattattaatgccctatataggagtagtccttaataatgcctggtttaaattttatttctaatagttctgttttttcattggttttagcctaaatttttaacgcacgtgaaacgataaagatggttaacacatgattaattaagtattaattattataaactttaaaaataaagttatttgaatttgttaaacaacttttaaattaaaaactttttacaacaaatacgtttgaaaaatgtgctaacagaaaaaatataaagttgaagaaaagaactaggacttaaaaattttaagtgaaatagatggctcctattttaagtataatttttattgtattttttgttgaaattatttcaatttccacgatattcctttgctctaagaaaggtcttattgtttttgaccaagagcaaactaaggttgaccgcttaatttctaaccaagcaatattaaagggagcagctttaagcctttaactatataataaatatattagtgaaatactcttgattatgaatatagtgatacgacttttatgctacaaatattagtttgtttgaattatattatttatcaaagcttacaatttcaaaatcaaaataatgaatatggtgtgtgttcttctccaccaaaaaatttcaaatttatgacacctgaccacattcagggaagagaaaaaaaagaaatagtgggactgatttaaaacgtttccaccaaaatttagcacgaggagcaggagcagaatattgtacacccacccattaaactcaacgcgtgaagccctgaaccgtatcccactgtccccggggtcccacactcacgtgggccccacaccaacgtgttcgtgtccacacccgttcaccgtgaaccgggtccacgcagatctccccacaaatcaaaatcatctgggcgttgtgcgccgccgcttcctgcggcggatttgaatactcccaaattttttgaatccactccccgcgggatgagcgaaaagccccctcaggtttcttcaaatttcaaataggtccctccaagtagcggggcccagccgtggtggcccacctggcagtgagtgcgagcgtgtcaattggagtggaaggctgtggtgctgccacgtcacggagggaacgaacagatggacggttgggagcagcgagggccagccacagccacagacggttgtggtggttttggtgccacgctgtcatctcagctgatcgctgacaaaaatcttgggcgctaagcgacagggctgacacgatcacaagacaaaatccaaaaacatctcttttttagagggagaaaaaaaataatttgttggagttttctttgagtggaaagaagtttatccactagttaagatttttttttcttcttctcacatgcttatttgtcatcttcattcatttgagtaaattgtttacacctttaattttgagtgaattttagctaatcattttttagaaaaaaatagctaattatagttcagaagaaaaacatcaatgcaccatgaaattgtactaattccgtcctaaatgagtggataattgtagacatatgcatgcaatattaatgctttgcatttttttgcccacccaatagatccaaataaagagaatgagttcgagtttttttatttcttacacgccttatctaaatacccttttgtagggaaaaaagaagtaaattttacaaaactacagatactttaatcatgctattacaaaactacagatttaaatgtgtatcacaaaacaatagatttagtaccgaatttatcacaaaactatagatttagtgatgaaattatcaaaaaatagagtttatatccataacatattaaggttacaaaagttatagttttatgataaaactattgttaaatatatggttttgtgatacacgttcttagatatagactaatcaaaatacaagcagttttgtgaaactagaatgagttactcttacttgatgatacaatatagagactatactgagttctttttttttccaattaaactcttgttaactaattggaaaaagtacgaattagcaatccagtcagcatcttatttattaaaaaatatgggacccacctgtcatactcctcttctcctcttcctctctgtcgctcttcctctctctctctcggcatgcgcacggcggtgcggggatggtggcagacagcgcggtcggcgtgcacggcagtgcggccgacagtgggtcggtgcggtcggcgcggacggcggcagagagggacgcggaggcggaggctacgcgggacacaaaggcagcggcggtggagccgccagagtggctgcagaccctgcccgtggcgccggagtaccacccgacgctggtggagttcgccgaccccatcgcctacatcctcaggatcaagcccgaggcgtcccgcaacggcatttgcaagatcgtgcccttgctcctccagccccccgaggatgacaccatccgccgcctcctccaatgccgccaacccctccccgaccttccccacgtgcctccagcaggtcggcctctccaccaagaaccgccgtgccgccagccgccgagtgtgggagagcggggagcgctacaccctggaggcgttctgcgccaaggtgcccgagttcgagccctcgaggcacgccgcactgcccaagaaccccacccacctccagctcaaggccctcttctaggccgcctgcacctccaggcccttcagcgtcgagtacggcaatgacatacctggctccggcttcgcctccccccaccgcctctgggtcccgcaccgccgccgcctccgtgtccctctcccctaccgttcgcagctccgcgccgaccgcccccacccaccgtcgcccacaccgccgtgcgcgtcgaccacgccgtccgccgccatcattgcaccgccgtgagcatgccaagagagagagaagaagagcgagagagagaatcagagaagagagagaggaagagggaacaggagtatggcaggtgggtcccacatttttttaataaataaaatgctgacttgattgccacgcatacgccacgtaggacaaaacagctctcgatagggtcgaggggggtaatttgtccgatattgaaagttgagggtgaatgatgtctggttttcgagtttagggggtaattcggtcgaccacgatagttgggggtggggtaattcatacttgttcctaactaatattacaataagtactataattacacaaagcaaaattacaagaagtactatacatattgatgatataactattaactactacctctgtttcaggttataagactttttagcattacccacattcatatagatgttaatgaatctaggtacacatatatgtctagattcattaacatatatatgaatatgagcaatgctagaaagtcttataatatgaaacggaggaagtaacatactatttgttggaggcataccacgaagggccttcggcctaacctgccgaaaccaagaacttaggcgagaagatcggaccagaggcaatcggcgaaggattgagaaaggaaccagacgggtgaatgccgcccatcggggttcgctggacaaggacctcgtcggagggccgcaggggcgatgacgacaaggcgaaggccatggcacgaaggcgtaggcttcgccaaataccaaaccccatcataaagaggccccgcgggccattatgctttctggaggtttcgtcaagtaaatgggccgatccatttggtccaataggggcccatacatgcaaaggacactatttacacccaataatgtctctatcataagggtaaccatgtaaattcccctgtaaagcctaaacccctaagggggaacctgtaacagagctataaatagccccttagagtcatgtaatagggggatccaaaaatttttactaagcaatacaattgtttttttacttccaaccactgttgagagaaccacgcctttcggcatgacgcagttgtccattcgacaacactatttaatatgacataaatcaggtagagatgaacagtctacctaggatcttgtgcacacaaggagataaatggactgtaaggtgtaatactccagatactctgtttttaagagcaggtacaaagaacactataagttagctgtaaacatattttaaagagataaaatacgagaaagaagagcagcggactacagatttgcagccagctgcagcacagactcgaagatgcaatgtgtgtatgacaggtgagatcaagtattaatattgtagtaagtaactattgtatgaattggctattaagttgactataaatgatttggagctagtagttggctatactattaaacttgctctaaatactccgactccgactgacaatataattatttatcttcaaacttcaaccactcgtctttgtcaaaaatatgcacatagatacttaaaagattccatgctatcaaagtatattgtgacttaaacattttataaaatttttacctgatttggtttagttccttcataatccctccaaatttcttccaatccgaagaatccatcactgtaccctaaccatttagggcccctttgaattagaggaaaaacataggaattttggaggatttcaatactataggaaaatttcctatgaagccctttgaaacaaaggattgaatcatatccaatcctttgaaattcctatggaatggacaatcctatagagattttggagaaaatttagcaagaacttcaacctcttggtaactttcctttgagtctatctctctcatccaattcctacgtttttcctgcggttcaatcaaacggtcattctagtgtttttcttgcgttttgcaatcctctgttttacacttacatttctatcaaaatcctgcgtttttcctattcctacgttttctcaatcctgctattcaaagaggcccttaatagttttagcggttaaagcgaaataatgatgctggcggttatttgaaaacagatgaagtaactgtaaatcgacgtatagttaaatttaggagtttaaatcttgccaaacagcccaacttagtaccaaattagtaacacttagcttctcttgtatttgttgtcgttgagacagtagtttggttcgtaacagttctctgatagaaatgaaacaaacgcataaacagaaatacagacagcacatccactttctcttatcttctcctaagccacaacaatgatgtaccatttcgttttccgtcatttatgaacatcacttgttgccgatgtgttgtcaaatgcgttcatacgtactaagtagaatcccgttttcagattgatacgcaacgaattggttgctacgaaaatgtcagagtttcccatatcatgactcatcagctcatgacagatgatcgtctgcaagacagtgacatgactggactaacttggatcatattgctgctagctaatgttcatgctgcagctagccaagaaattaacacatcgaaatccagatgcagcagcagctaccagtcactgaaacttcagtggcagctgcgagtgttcagagtcacacaacactgcatgcatcgcaacaaacgactcccagctgcagccgtttccatcactgaaagcctgaaacgaaatcagcgacagcattcgacgccataggagcagatagagaagcatattgtcccttttcagctaggagtgacgatccattttgaggccagaaacgttcagagaattccagtggatataatataatcaggcacagctaaaagataaaattcattcgtgaattaagctgtatttttacaaggtgcacacaaaattgaaattggaattctgatcagccaccaaaacagttgaggaaataagaggagtgtgacaaagcatcagttgcatggagacaaagaagatgacagcaacaggattggaagtgatcagagacaggcaatgaaatcctgagaacaacctgaacctcacaactcgtactatccctttgcacagccagcaggttaaccaggttcagtcacttcactccagtgcagtgaagtgcaggcaggactaaatacaggcctaagcttagtttcaggtttatcttcagttcagagttcagaacttcagacacaggttgagaaagaaaagaagcagcaatgtcatctgcaactctgctcaaatcctctgtccttcccaagaaggccgccgagtggggcggcacgcgtcagctccccgccccccgccccccgccccccgcccgccgttcgtctccatggtcgtccgcgccggcgcctacgacgacgagctcatcaaaaccgccgtaaaaacccaataatcttcaatccagtcttgaattgttctggtgcttgggagaaacgcccaatggttttccggctagctccatgaagcggtgggctagacaatcttggttcgaagcttcaccacttctaattactacatttgatattaggttctttcctaatattcgtgttttttttgttcttgtgcttgggattacattaaaaaccgagtcattgtggattaatttaaaacggtggcgtcgccggggagggggatcttggcgatggacgagtcgaacgcgacgtgcgggaagaggctggcgtcgatcggaacaggcaggcgtacaggacgctgctggtgacggcgccggggctggggcagtacatctcgggggccatcctgttcgaggagacgctgtaccagtccaccgtcgacggccggaggatcgtcgacgtcctcgccgagcaagggatcgtgcccgggatcaacgtcgacaagggcctcgtcccgctggcagggtccgatcccgagtctttggtgccaggggctcgacggcctcgcgacacgcgaggccgcctactaccagcagggtgcccgcttcgtcgagtggcgcaccgtcgtctccatccccaatgccggcccctccgccctcgccgtcaaggaggctgcctagggcctcgcccgctacgccaccatctcccaggtcggtcatttcatgtaccgaccagttcaatccaaaaaacttaaatatcaatcgaccaaccaagtagtatagtgtcatcgaccattcagcacaaaagtttaaactgatcaaccgccactaacatggtgtcacagtatcagccagttcgatctaaaagcttaaagctcaagctgatcgattgttgctcgcattgcatcagaataccaaccagtttaaaccaaaagcttaaactggacaacaatccacccacacagtgttacaacatcggacagttaaacacaaaagcttaaattgatcgaccagtcgaccaccgatatggtatcatataacccgtcagttcatcccgaagcattgattaatagtatcattaaccaattaattcaacctaaaattataagttgatcgatcgatactgacattggctttagaacaccaaccagtttaactcaaaagcttaaaccgatcgactgatgctaacattgcatcaaatgcatggatggatggatgcaggaggacgggttggtgccgatcgtggagccggagatcctgctcgacggcgagcacagggtcgagaggacgttcgaggtggcgcagaaggtgtgggcggacaccttcttccacatgtcggagaacaacgtgatgctcgaggggatcctcctcaagccgagcatggtgaccccgggcgccgagagcaaggacggcgcggcgacgccggagcaggtcgccgccgcgtcccgccggcggtgcccggcgtcatgttcctctccggcggccagtcggaggtggaggcgacgcggaaacctcaacgccatgaaccaggcggctccgtcggccaacccgtggcggtggcgcgtctccttctcctacgccagggcgctgcagaacacctgcctcaagacgtggggcagccggcgggagaacgtcgcggcggcgcagggcgaactcgctggcgcagctcggcaagtacaccagcgacggcgaggccgccgaggccagcgagggcatgttcgtcaagaactacacctactgaaaataattttcgactgaaaaactctgaacatacatatatattagtaagtacattgcgagaattaggatcacaagaagcttctctgaaaactctgaacatgtatatattagcacatcgagagaatgcatcatggttactgtattttacaaggttttctagatcacaagaagcttatctgaaaactccgaagatagatgctgccaatctgcttagacatatggacatcgagaggatgcatcatggttgctgtattttacaaggtttttctagatctttgtttttttggtttcattagatgcttggctcctcccatctgtacaaggatgctttggtagatttgtcgtaaggttttgtaatgatctacggatttgcatggttgctgcaaaattttgcatgtatatatacacgacgcttgaacgtcgatatgtaataataatggctaatttttaatgatatatcgactatggagtactttgtttgggtcttatatgcaccatagttcttcaattaatccacacgtaggctccgatcggatggcctaatcagccaaagaaaaagctaaactttaaattttcaaacttaattttaagatatttttaacattgtttctttttcagcattagcttttaaatcactaaaaacacatatataaaaattttacctacaaattctttttttcctaataaaccgttttgacttattatggaaaaagccaaacgatggggcctctaatttggatgagtttacttaggagatagaaatttaatttaatgccccaaaataattttgataatatggagtatagtggcatttatcactctactaatcagccaagtttaaacatgatatacacattgggaaaaaaagacaaatcattgcatgaatagtgtaggtattaattgttagtacgatggatttagactcggttgagagtttattgaacggagtacatatactcaatacacatgctatcaaatgttttaatagtttttcataatcattaacttggcattttaatgaataaaggggcgttcctcgagaaataaaaagagttccccacaaggcttgcccatgtagaagccaaagataagcttacctgcaataaacttgtgctacttattactcatcaaattattgatatggattgtctacttgactaaggataaattaaatattttaggaaaataaactcaataaataataagtggcgttaatttgatgaactagatgaaaatgacttggggaatttggctctaaagaaatgctagaattttcaatgcagcttacggctcagtacaaggagtggtggactcgatcatcagaatgtacaaggcgtgggaagaagcccaagaaaatcggatccagatcctctgcattgaagaagctaatgcagagggtggcattagctccaatccaatccttccatcatcatccaacggctgcatcttctttttcccttcgatactggtaccagaaacaaacaagtccccctcgccggtgaccacagcagcgcaacaacgactcctcctccgctttggcgatctaaaccgctgtgccttctgttattcccttgacctatattatcaccaccgtgagctgagagtagcacagagctcatgattatcgaaagaaaatgaagcaacagtgcatgcaacgttcggttctctccgtgcttaataagtactccctccatttctaaatactccatccgtcccaaaataagtacagttttagcagtattcatgttcaacgtttgaccgttcgtcttatttaaaaaaaagattatgattagtatttttattgttattagatgataaaacatgaataatactttatgtgtgactaatttttgtaatattttttataaattttttaaataagacggatggtcaaagcgctaaacacggatatttatggctgcacttatttttgggacggtgatagtatttaacaccgttgacttttttaagcacatatttgaccgttcgtcttattcaaaatcttttgtgaaatatataaaactatatgtatacatataagtatatttaacaatgaatcaaatgataggaaaacaattaataattacttaaattttttgaataagacgaacgatcaaacatatttaaaaaagtcaatggtgtcaaatatttataaacggagggagtattatctccgttccaaaatacttatcgtaccatattatttagcatgtactaaggtttgaagacgaatactataataccccttaatttataatgcatactccctccgtactcgtaagaagtcgttttggacagcgatatggtctccaaaacataattttgaatttttgtttctataaaaatatttattgaaaagtgatatatgtatacttttatgaaagtatttttcaagacaaatctattcatataatttttatattttcaaactcaacaacttgatagtatatatgatttatatttctaagatttgacttaaacattgttctaaacgactttctttacgagcacggagagagtagttggacgcgggatggtggttgggggtataatgaggagaaatttgaaatgtaagtggttgatatgacaagtagtatttcaaagtaacagctattttgaaataatttttgaatgctagaaagacaagtattgtgaaacgaaggaagtagtgcggtttcgtgccgcgggccaaccctttaaaatccagtgcgacgccatgattttcgttcatccatagcttccgcagcgccggcgatgcaacatacttcacgagttaagcgattcggggaaatcgatacaatggaatcaacaagaaaaggcaatcaaagccattccctctcagatggatggccaggattcagcctaatgccaaaaagtggttgtctgccgtagcagttgatacggcagaggatccgcgtccaagaaaatccaacttagatgattttacgccgtttgctgatgctagtcgctttccatttcctaaaactctatgtaattcttcccctatggactgatggtctcttttgaggtggtctacagtttttatctcataatattaatgaaatggcagagatcctatgcgtcccctcgaagaagaagggccctaaaactaaggataatttaagtttacatactcaatcttattatcatttgtcgacatggagagcaaacaagtttagaacaaggcaacaacttaattaaaagtatcaaatctttgcacgtcaatataagaatcttacacaaaatttatgttacactagcaaataattgtgtcatctcaacttcatgcgacattaaacttatgggtaaacttcaataaactatgtttttttaaagcaattactatattgtaattgtatctgcacatatcatataaactctaaaaacacacaatttcctttgctctttactctatatatgtgtttattaattaggcgtttcaggtgttgtgtgtgcatcactagtgaacctaagactattttgatgaaggtacgtaccttttgttggtcctgaactgttaagttggctatggctgcaacaagctctataactacaatttcaatagtagagctctattactgttattcagtgctttaattgtagccagctgagccaaaaagacatgttgtttttcgaaccattcatataaggggtatttgcaaatttgccaccgttttttttccaattttgcaaggatgccactcgaatgacaattctagtggtatttttataattttttagtgtcagtcttgtaataacaattcaaagtagtgataaatttgtaattgccccttcatataatcatttaaaactacatttttactttattctaaattactttttttagcattgttcttacttaaacgttcatccaaagtgtttagagtaaattatagtttggatcaccatttaaccaattttcaccttggacaaagtaatttttatttttattacacattggaccaccccaactcctcttattaagtactctcttcgtttcgtttcaggttataaaacattttgattttggtcaaagtcaaactactctaagtttgactaattctgtataaaaaagtagtaatatttacaacaccaacatagtcttattaaatctataagtgaataaatttttataatatatttatcttgagttaaaaatattactattcttatctataaaattagttaaacttagagtagtttgactttgatcaaagtcaaaacgccttataaaccaaaacggagggagtacatcaatgacctcgattactaaattatagtctcttgcacaccgatgaactatcgattcttgaagctatatattgcctatacgtaaaccatactctcttttttttactgaatgaaccggatgcagatggttaaataagtttaggtggtctaaaatgatacaaaagtaaaaatacctatttcaaagtgaaaggtaaaggtagtccaaattaaaaatttagtaataaaaagctaatcaaaatgtaattaactcatttatatattacggaaaaaaatcgtgaatttataaatacaaaaatcttatgacgttaaactatataaattgagaaattaatggtcagaattacgaatgttttgacttttaaaacgaccgagagagcacaaaatttacttgaaatcaaagagagaataaatttatttattggagcaaaaccatttccttctctcctgcctccttgggctcatctctctctctctcactcttctccctcttctcaccaccagacgccatcaaacccctacctcccgcggcggcggcggcggcggcggccggcggcgagctccggacagacagaggagggcgcgagcggagagggcgaggagggaaggagggagggaggcgacaggcatggggaccctcgggcgcgcgatctacacggtggggaagtggatccgcggcacggggcaggccatggaccgcctcggatccaccatccagggcggcctccgcgtcgaggagcagcgtaagcaccagcatcttcccccccgctctcccttcccccctcgttaactaccgcgcaccacctgctcgtcttcgttttcctcctcctccggagaggagaggaggaggatcgggcctgcgaggtcgaaatcgtttcgatttcgttgtcaaagtctttggcccaatattgggagagttcgtcgctctagttgttgattaattggtactagcagccgtacacattcttcacaacccctttgtggtttggttgttattgggaaggggaaacgggttccttccttcgtgtgtattcaagtatcgtcgtcggtgattcgtcaagtgctgcatttgaagttttcgattagtgattctcgtctgtgtatcgaaacagcagcaagtaaatcaaagatttcacttgcacataattgttattattgtggttatactgaccaattggaatgtcgcattggcatgccgatttcgagtgtttattttctgttccctagcatcatgaagaatgccattttcccctctagctctagttggggtgtgttgctgtagttggttctgattaatcatcaccattctgcaacaggcaaatggccagaaattagcgtagatatgaatataggcacattatgacgagggggggcatcttttgttattttttcgggtgttgtgcatttagcttgatagatcagtttacaacttcgctaagtgtatgacttcttcacttagatacatgaattttatgcctgatcctgagtaacatgttagcgttttttgtatgccattgtcagtttcaaggcatcgcacgatcatgaacatatttgagaaagagcccagagtccacaaggatgtttttgttgctcccagtgcagctgtgattggcgatgttgagatcggacatggatcctcaatctggtacggctccattttaagaggtaagctctttgtcaataaacactagtattgatacatgtgctactaataagcatgggctttgtcttgataattatatatctcacctttcttcttggcaacaagtatgtttactgtgcattttgttttcagagtaaacttgcttctaactgcacttcatctattgctatggtatatagaaaactgacataactgccagttgtcaggagatgcacagttttatcaaagcacaccatgttttcattgttagactctcaatcgacacttcgcatgaaacttcagttttttacctttattcgacgaagtgtcaatcagggtttatcctaccgctagtagactatttactgacctccggcagtagcacgattaccgcaacaaattcgtattccaaattttgaactccctgcagtaatacacggttacgtgcggtaaccactgtgtgtcgaagctggaagaaaaagaatgcaggaaaaattgtaaaacgtagtaagaagtaatagacttgtatcgtagtgttaagtatttgtgctgtcatacttacttggttaacccaagcatattgatatttttaagtttcagtaattataatgttgaagttgtactgtagatatttccagtgttcagtgataaccattttagctccttttcgttgtttgtcctcaggtgatgtcaacagcattcatattggatctggatcaaatatacaagacaattcccttgtacatgttgcaaaagctaacatcagcgggaaggttctcccaaccataattggaaacaatgttacaataggtcagtagagcacttcctatcttatttcgtaataattttggtacacagtttacactgtgatatgctattgatattgcgatttggtttttctggaagacattaatcacgtggcatcgtttatacatgatagaatcggatataaattgttttcattgcagcgttgtgattgattcattaactaaaattctgaacttcatttttccttggactactcactgtgttatgctcccaactaaactaataagcctccaccaggtcatagtgctgttctgcacgcatgcaccgtcgaggatgaagcttttgttggtatgggtgccactctgcttgatggagtggtcgttgaaaagcacagcatggttggtgcaggatcgcttgttaagcagaacacaaggattccttctggagaggttaccttcttattctcttgctaagcaagttttcttttttttttctttttcacttgctatatgggaaatatgcactcaactgccagcattttgtaatgagggaattctcagacactgatatacgatgcttacaatcgttctttgttccacaacatatctaatcgtttggataatggaattgagtgattccaaggtagaggtttagtctacatatttatttttccaaagaacaattactttaaagttacaatgcattgatgacatatttacatgaatctgtgtagtttttctttccttatttcaaaacctgtaattggggactggaggataaccaaagtaccaaacaacgctgcatgtttatactgatgtccatattttacgttccatgctattgctatgaacagctgcgagacttgaatatcttttggtatttatattgtatataacttaatatattacatgactttattgaaccatatggtttcttgacactgctaggtctgggtcggtaatcctgccaagttcctaagaaagcttactgaagaggagatagcgttcattgctcagtcagcaacgaactacatcaatctggcccaagtccatgctgccgagaattc

SEQ ID NO: 57474 - DNA, 1579 bp, Oryza sativa
ttcaactggagtctaaatctgtacgagtggaggagttacttcaggtggtggcttcattggaagaaaacacagataaaaaggaattggagtcacaattagaactgctgtctgcggaagccaaagagcttcgtctgactgtaacatcattattagagaagattgaagctgaaaggtctcttttgtgcagcatcaagcagaagcagtggctgcatgtaatgcgaaagaatcgttggaggaacagctatattcagcaaacactgaagtagagagattgcatgtcattgtcaaagaactggaggatgaggtagaaaaagagaagatgaggcaggaagaactcgtggcagaattagaaatgaagatggaaacagctgtcgaggctattaaagaatcattggaggcacaactatgtgcagcaaacactgaagtagagagactgaatagcatagttcaggcactagagaacgatatagaaaaagagaaggcgctgcataaagaactgacagcacagttagaggtgaagtttgaagaagaaaagctcgttctgttcagactgttaaggaatcaatggaggcacagctatgctcatcaaacaccgaagtactaaaactgcgtgacattgttaaagcactagaaaatgaggtagaaaaggagaaggcactgcatgaagatctttcagcacagttggaggcgaagatcgaagcagagagaactttttctgtggaggctattaaagaatcatttcagtcagaactccagtcagtgaactcagaagttgtggagctgcgcggtatggtgactgcacttgagcatgaggtggtaaaggagaaaacattttctgcagagctccaaatgcagctagaagctctggaggcaataaaaagggtgttggagtctgagattgagtctgcacatcaggataacagaaagctcaatgataaggtgaagtcttttgaagcaaaactgaaaaaacaggtgtcttcagcggtggacttcacagccaaggaagaagccatgcagtcagagagaagggccatgaagcaacaacttgaagcagcaaagatggaagttggaaagctgacaaacaaggtgagcttgctccaaggggaggtgttacaggagagattgttatcagaagagttcgaacaagaataccacaagctggaggctcggctgtcaagggatagccgggacgcgaagctctggcgactcgcaaattcaaatgggggtctgaaggccaagcaggtatatatatactgaagtcttgtaatttacatcacaccatttacccttggcttaacacactcgcctggtatttatcaagaaatggatccaactataaatcgttgtgtttgtcacaggagaaggaacttgcaaatgctgctgggaagctcgcagaatgccagaagaccatagcttctctcggccgtcagttgaaatcattgaccgacatcgacaatacgattgtggagcctgagagactggaacccagagaaatcagagaaatgccgctcgattttagaaatagtgatgctgactttgcagtatttgcagatgagttatatgattttgatcttccaaa

SEQ ID NO: 57475 - DNA, 2115 bp, Oryza sativa
aggggcttgagagttgatccacagacaagtgacatatcaatcaatattatagtaagtcgggcaactgagggtttttattgggaactaatgccagttcaaaactctcgagtgtggaaatggtatgtggaaaatgcattgcaacgcgggtggcctttagctatggttccgtttgttcacccgaaggatccaggtgtgcagatgaacatggatgatggcgagggaccaagtgctgaagtaaatgagacttctgtggaggaggtcaacgcacgagaggatgggggcgtagtagctccagtaggcattcaaccaggtggagtggccgacgagggggagactgtcggtgccattgtggatgaaatagacagggaggattctgacaacgagcgtgtagagaaaggtgattcgtcagatgatgagacggatattaatccagcagaatgggctagtgaggatttttctgagatggtcgtctctgaagaggatagtgtgagatgggagtacaaagaaaatgaggttattcagggagcgatttatagtagagcagaagatatgaaggaggcggtaaaacattttgcagtgtcaattcatagagagttttgggttgccaagtccaaccggtcgcaatatgaagttcggtgtgttaaggaaaaagatggttgtccctggagagtgcacgcgtataaggggaaatggaaggattattggacagtgtcagtcgttaccaagcatacatgttttctacctggtgtttagaaataccacaggaacattacatgtgcatttgttgcaactgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaaggtggcattcatgaactgtcgtcctgttctctgcattgatgggacattcttgacaggaaagtattggggccagatactaacagcaataggggtagatgggaacaatcaggtattgcccttggcatttgcttttgttgagagtgagaataccgacagctggtactgattcctgaaattagttaaaacaaaagttgttggtatgaggccaaatgtgtgcctgatacatgataggcacgctagcattctacgagcgatagaagagttgcagtttgggagtatggaacgaggataccctggtgtttgggaagatgtacagagtaggtggtgcatgcgtcatatgggagctaatttgttcaagcaattcaagaacaaggagcccatgaacatgttcaagaggctatgcaatcagaaccaggagaaaaaattcaatgagctttggaagagattagatgagttgacagccaaatgtagtgatcagcgtgcaacggctccatcgaccgccgttgctgaccctcctgaagctcttggacctctcccaatgaatagtccaacattggttagaagaactggattggagattcggaaattttctcagtggattcttgtaacgccccgattttcgttcgggattaaaaatcatttaatgatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaagaaaacaaataaaaacctccctcctctctttgggcccctttcggcccaattcccccccccctctctccctctcgggccggccttctccctcagcccgctcggctctctctctccctcaagtctgctttgcctccccgtcaacccgaggccccacctgtcatcttctccccc

SEQ ID NO: 57476 - DNA, 5919 bp, Oryza sativa
cccatcgcgaggccgagccactaccgccacacaccgccttcagccggccgttgccgccgcgttagtcgtcgctgcacctcgccgcttgcgccgtcggcaacgccgtgccaagctctaccccggcctccgctccgttttcccaaatcgccaccgtaaccacccctcccccgtcaacccgagccaccaccaccactggccgactccagccgcgtcgcaccgctgctacagtcattgcagacccacgccgttgcctccctcggctccacaaggacgaggagaacctcggccatctcttcccatcgccggaaactcactggacgtccagattcccgtgcgccggtgagcccttcctcccttcccttcctctccagccggccatgtcgccgctccgtcctccctaacacctcccctcccatcctagggtgcagctgccgctcatccgcctcttcccgagcgccgcccgtcgtcggagcgtcgttgtttccgtccgtcccgagctctgccgtcaccgcctcgcgttgccatctcgccgccggccacctccttccgtcgtatgctactcggtgagctccccctcccttttcccgccgcactccgccgctccccggtcggccggtcggcgagccggctcgcgcccgcctgaggccgcccgatgcacctcgagtgaatctgggccgtccacgtggccgttcggcgccgcccgcgtcggtgccctcgtggcgccacgtcggcgccacctctgccgcatgtccgccgtggccgccacgtggccgtccacgtggtgcgcccgcgcctgtgccgcggtggaccgagtccaccgtgggccgcccccttggctcgctgacgtgtggggcccgcctgtcggcgccggccctttgctgacgtcagcacttgtcatttcctttgagaaattaattattaattgcgcaataattcggtttaattctagaaattcatttaaatggctcaaaatttctaaaatccatatctaattcattcgaactccgaattgagccattcaacttgcaaaattcatctaaaattgagctctacatgtttgtttagtttttatgtcctgtttccttggtttttattagagttttttctcgttttgcgtgccagcgtgtagtttccgtcgtttcggaagtccgcggtcgcgaggaaaagagttcggaagatcaaagtgaagaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataactgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgtctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccacggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaattctgcatgaaccaaaagagaaatgggccaaggcgtatgacacaggtggtgcatcatatggaataatgacaacaaatttggcagaagtttacaactgggtgatgcacggtgttcgtggactgccactagttggcatagtggagttcattttacatgggacatgcagatattttagggatcggttccaggcaattcttccctctatgccgaacaacagcattttgtttggaactttcatgcagaaaaagctagaggagttgcgtaaaaaggccatgaaacatcgagctctagtgcaaggtactcaacaacaaaggtttgagatactttgtcaagataaggcaggcaggggtatctaccgcaagagagtgaagcaggagtgtgttctcaaagccaacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcagcgagatttatgggttcggcatagctggggagttcacagagactaacgatgaagtactcaatattcctgacccatcgaagctccgaggcaaggctagaaggaggaggactcgtcgcatccgcaacgatatggatgagtcggatgctggtagggtgaagcattgcagcaaatgcgatgaacgtgggcacacctacaagcattgtcctaaagacaaggagaaaccaaatgcggcggaggcaggactatcaggatcagcagtagatggagctcgccctacgggtgaagacactacctacactcgaccacgtcctaggcgtcgtcgtgccacatctggctacgtggtgtagttcttatgttctatgttggcatgtggctttgcttgtaatttgtttcgaacttattgatgtgtttatgtttcgtcatgtaatgtcagacttcggcatgtcatgtctttaggtctcgtgatgtaacgtcagactaaggcacctagtgtgtttaggtatgctgatgtaatgtcggacttcgatacgtaatgctatgttatgttatgttatattatcgaactctacatatatgttaaattgcacgtcatcgttatgtacccttagtaacgtttgctatatttaaatagcctgtactcttgttgtacataattattctcatgattttattactatttcataattttacaacttatcttttgttttacattactactttttgaattgttctaacacgaaacactatatttttcagagatggcacgtcaggatacacctcagttgttggacccggcgatagatcaccgacaccggtctcaccttactgcggtacagggggctcagattgggacgttccgggcacggacgtgcggtgagctacttacggttcacgactcctttgtcgagaggtacaaacagtgtattactataaattagttgcgctgtaataattattataatgacatgttaatttgttattgcaggttgcgtgaggccggcctcctaccgatgtgtcggctggtggaggctgccgccggcgacgtggacccggccagacgatggactgtggaccggtccctcctagcagctttggtcgaccgatggaggccagagacgcacacttttcacttgccgtgcggtgaggtagcccctaccctacaggacatatcgtacttgttggggctaccgctcgcgggagacgctgttaggccagtgaccacgggtgtggactggcaggacgatcttacggcacgtttcgcactagtacagcgcgcaccgcatctcccgctcgagccgttggcacaccaccgcaacaccggacctacgaagaggtggctgcttcagttcaccgtgagtgtttttgtaccgaaatgacaaccgtactacatatttagtccacagttaaggtgcctaacattttatcgaacgcttgcaggtcgagcagctacaggcggaggctgacgagtactcctacagccgctgtttggaggcgtacttgctctggctttttggctgggtgatgttctgtggcggtcacgggcacgggtacaaatcctaccggctttcgtcaatggctagacgccggggtgttgaggatccgaactggcgtagcgatccttgtgtatacctactaccaccttggtgccagcgtcctctttgcctatgcggtgatcgatgccaactaatggcttcgaggaatcctgatattcgaggaaggcacttttttaggtgccctaactatgaccgtgaggtattttattatctgcatatgcttattcattccgtatgggcaatcgctttattcttcgtaacactactctattcgacagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacagcactccctccatgggaagcccgtccagatgcaggtgtggtgatcgttgtcaggttcttcgttctataaagcctacaacattgggtcgaaggttctttgtttgtctaaatattcttgacgatgatttcatggtaagaatattttgattacatgaatctttattttctcacaacatttactaactttgctcgcttgacatctattctttcctctcaggaaccaccaaggagatgtcaatatagagaatggatagacactagaagggttctaactccacctagccatgttgtgcagcttgaactaccagagcaatacagggttactaaagcgcggtttgagagaggagagggatcctcacgtaggggttagctattatcggacaacttggcatattgaaatttctactgtcatgcttccttgtcccattactgcatcgtcgttgtgttcaactattgcactacctccctcctagttcgaatctaatatcatctatgtaaccgcaatggaaatagttgtatcatgttcaaattgtactactatttcttcatgttacataattctccttgtttaagtccatataatgtttctacgaccgagactgcgataggcctatattaattatccgagtactgatacgtcgaataaggtacaaaataatacctcacttaacatatgaaattgcgaaacaaccaacttcaatacatttttataacaatattaacaagttttaccaataaatacttctttatttattattaacataacatagaaaaatcttt

SEQ ID NO: 57477 - DNA, 1291 bp, Oryza sativa
acaagttttctgaaaaccctacttgcaaattgtctcctctcgcccttcggcatttctttgtgaaacggtttttcaaaattctcctcccaatctctccaattcttttagttgtcaaacctagaggaccagctgtcagcttcatgtctgttcggaagtcaagtcaattcgagcctcaagcttcgtgcaaggagtgagaagatcagttcagagtcgtcgttctgcgaagatcaagtggagttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacaacatatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagtgtagcggaaagaactccagcagtagtgtgttgcagtcaagagtcagtgtgtccatgagctaaatgagagtcacttttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcatttttttcaaggacaatagttcaaaagttctcagtcaggcgaaagtaagactacccactgtaaggggggtaggtctcagagatgagttttggtttacctcgtcggcatttcacttgaatgttcaacccagtgcagcaatttggttagtaattaaaggagtccgttgcgagccactagcagagtctcccaatctcaagtcaacaggttcaattctaatgtacacccttgaggccaggtcaacagttcagcttagagaagtagcatcgaggatggttgcagttcagacgaaagacaggtcaagcaggttttcctggaattacttgttatttgaattgggaccagtcgaagcggacatagggtaaatgatttataaatgccagattccattttcatcctcttatagccagcgtggtg

SEQ ID NO: 57478 - DNA, 1754 bp, Oryza sativa
  unsure (1)..(1754): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaactatctgaaggcccaatcaagtctaacattgattggcttgaggctcgcaagattgaccttttagcacaacttgaagaatgtaacgctgagctggatatggaacacaagaaactagccgatctccccaagtctattgaagaacagaaagcgagactcaaatcggctattaaacatgttgctgaactgaccaagtccctgaaagttatcccaggaaccgatgctcaagatgcccaagccaaagaggaagtagagcagattaggtagaaggctatatcggctatccagcgatacttatcgcggtaatctttgctaaaacattctgttactgtactgttggaacgatcctttgcgccgattaatacgactttgaaatttgcgcaaacaaaatttaaaattttatactgcatgctgatatatatatatatatatatatatatatatatatatatatatatatatatatatatatatatatatatatatgcccccctagttatacaatgtcgagagcattgataaaattatgaaacaactaagggcgataataatatcggccattgtacattggcaaaacacaaccgatcacattataaaaacaactaagggcgatataacaatatcggccatctcaaggcgatgtaaactcatcggctgtcatgtatcggcaatagtagccaatcatgcgttaacccaaacactgtggtaatatttcttcaaatatttgccattgagcgctcgcacataaacttaaccgtcgagcccttgcaacatatatgctcccttagacacaaccttatgaatttggaacggtccctcccaattcggcgaccacttgccgaatttactatcacgagtaccaatcggcaaaatcagcttccatacaagttctccttccaaaaaatctttagatataactttcttattataatgccgagcaacacgttccttatccttagtaaccttcgcaagggctcgcaatcgtgactgaaccaaatcctccctctcattagccataagattgtaatactcatcggctgttaaatcgttttgcagctccgttcgtcgagagccgattctaacttcccatggcaaaacagcctcgattatatggaacttgaatcgatccatgacaggccatcctataagaccacaatgcttcggccaaccgagtatgccattgccgaggataatcagaaattttttgcttaaccaatttgatcaaacttttattagatgcctcggcttgcccattagcttgtgcataataaggtgaagaattcaacaacttgatacccacgctatcggcaaactgaacaaactcgtcggacacgaagattgaaccttgatccgtagtaatagtctgaggaagaccaaatcgatagattatgtgttcctgaacaaattgaatagcatccccagaatcaaccttcttcaaaggaatcgcctctacccacttggtgaaataatcagttgccaccaatataaa

SEQ ID NO: 57479 - DNA, 706 bp, Oryza sativa
tgatcggcttttaatctcaataagggtgtaaaaggttccaatcttccagacagattagaaataaatcttcttacaaaatttatctggccgatcatctcttgtagctctgtcttattttctggcggctgaatcttcttgatcgcattaacgctccttcgagtcacttcaatccccctctcatgaacaagaaatcccaaaaattggccagccgacacaccaaaagcacattttgtcggattcatcttcaagccatactttctggttctctcaaaaactttccttaaatcggctatgtggtcctccacctctttagatttaacaaccacatcgtcaatatagacttcaaccaaccagccgattaaatcatgatatatataattcatggccctttgatatgttgctccagcactcttcaagccaaaagtcatgacgacccactcaaataagccaattgcaccagggcatctaaaagctgtcttatggatatcctcttcagccataaagatctgattatatcctacattcctatccataaaacgcaaaattttgttccctgatgcagcatcgactaattgatcggccactggcattggatattcgtcctttggtgtagctttattcaagtctcgaaaatcaatgcacaccctgaccttgccattctttttaataactggaactatgctagaaacccattcggcatatcgac

SEQ ID NO: 57480 - DNA, 2014 bp, Oryza sativa
ctttcgccactgtcacgcgcggaatttctatccaaaattccaaacgcttacatgtgtgtaaaccctcgtacaagaatcagccaaggcacacaataacaaattgataatagagtgcaatcattactctaattaataagcgaatataaagttattacagaggtagatagttcctctcaaacaataaaaatccatgcagcggaaaaataagatgaacggcgcagacgactccatcccacaagcagcttgaccagggctacacctaatcctccacaccttcagcatcactgtagaactcttcgtctgatgaatgattgcaaggtgagtatatgacatactcaacaagtcacgcagcaaatatgcaagtgcagggaataacaaagaatggcataatatagtctcatttgcataaatggcatttaataaatactccagaatttataaaatagtaaagtatttaattaaacagtattaatccaacgctatacaacatacccgttgcataggcccaaccattctgaacaaccaatcccggctacacagttctacctccaaaccaggaatataccattccaaaccaggagctaaacaaattattatcatcatcatttaatatggtgagaggtatgaaactaaacattattagacccgcccataaccgcgggcacgactattcgaatagttttactctggccatgtcgcgcccggaaaaattaccttttcccaaacgctagtgtattaatccccgtcccaggaaaagccgaggtacaccactcaaacatgatacaaaaggcacatctttattatatcgataatatttacattattacaaagacacttaaggcctgacaatcaaaaataaacagcagcggactagcgggcctacggctccatcttcacaggcgctcaactggggtataagctaggagtccacttaggacttcttctccaaagcttctcgtactgaaggggagggaagatagagcaagaatgagtacaaccacagtactcagcaagccacaccgggagatgcatgattaatgcaagggggtacaaggggtaataatataggggttaagttttgcagtaaacagcatttaaaagtcacttagttgcccaaagccattttataaagacgatcctagagctacactgttattaatcaaggccgtgaaccctcacgaacctgccttaacccaaggcctacgatgattcagaccgaactgacaacccgacctaggtcccagcttgtcccaagccaacccaggccaaccattccacattatagttgttaagcaaattttaagaagtaaaccactaacttgggtacattgctaggcttgcccataaccgagggcgcggctattcgaatagattatactctgatcagaggtgtaaatctttatccacaagacacgtcttcctcacgtctaacaacgcgccacataccaccacggcatacggacgaaagacgtgacatagttcccaacccatcctagccataaacaagagtaccgacctaaccctggctacggccgggattcccgagacgggcaaccaaggttgagcccctagcagcaggacaccggccctgtgccatgacatctcgactaccgggccgcagctcatgtagccttcatttgtcctagagatgtccatcgggccccgacttcgtccatctccatccgtgtacctttgtttataaccagactgagccacaaactaagccttacccactagacatgtggaagtacggtagtgctttgcaatagaggcctgagcttaatccttatattggccgggtgctacttcccacaactggcatgcacccaaaccccaccggaaaataggttttaggggttttgaaagagaaagagaggtgtatgtccaattccatcataatccaaccattccatagtgtccaaatgatatgagaattcccaaagtctaagttataaaaccacctaatgttgcataattaatcagcgaagaatctacctaaattcatactagtgga

SEQ ID NO: 57481 - DNA, 1164 bp, Oryza sativa
tgcattaatttaaatcaaaataattttataactaggattcaatatgctcaatgatgatgtgacttgccttgctcaaagagaacggccttccgaaccttcggcgacgatcgcaaaccacgcttcgggaacctccggaacgatagaagctacacgaagcacaaaagcaaagctacaaggctataaagaagcaataacaatacataaaaaggaagtacatggttctttaggttataacaaacattaggagacttgaacgggtcgattcagagttcgtatgaccaaggcatggtcattcgaagtttaatgctgttatatggagatttgtggattattataattaggttttacaactataaaacatgtgtaagcgctagcctggaaaagacaggaaagctgcgccgttgacatgcggaccacctaagggaccacggtggaccgggtacacagagacggtccacgggtcgatagaagcagatcccgtgtgtcaaccgaggcgagtggccgacaaacggactccactagataccagacgggctgcacacgtggaaaccacgcggctaccaagcgggcacactaacacggtcaccacacgcacaagcgaacgactaccgacaccggtacacgggtaccggggtcgacaaccgcacaacgggcacgggcgacaccgataggatgagaacgagggcagcgagaggagagatccttactaccacgcaacaaggcatgggaacgacgacgaagaacgggcgcggcggagacagacgggaacgacggagacgaatggcgaggggacgacttcggcagtgatccttggacgaaggcgagacgcggccggcatgaggcctgacgacgtggagccgaggacgaaaacgacgatggggctgcagcaaccttgacgaaacgcgggcgacgatcagcacggcttgacggagggacaaacgcaacgacgaccgagaacgacgggaggacgacgaccggaaccggcgaggaggcgacgagggcagccggcagcagctgcacggagacaaggacggcatggaacacgccgctgcgatgccgacgacggtggcggcgcagcgagacgatgagccggcgaggatgaacggtgaagacgacgacggacaccggcggtgttccgccgatggggaggcgaggccaggggcg

SEQ ID NO: 57482 - DNA, 992 bp, Oryza sativa
agcataaaagagcaaaatcaccaaaacagcacataaacaatcatgaatagtacatttggatatttttaacatgtagatctcaattttagaaaaaattagagacttaaaccaactaaatccgagttaagatgaattagttatgaatttttaaagattaaatcggattaaatcatttatttagattttaattgaactatgacgcaataaagaattatttttgaaaaggaaaaaatgatttattgcgtcagcaggctcgggttaacggtggaccgggtgcacggggacggtgtacggaacgaacggccgagatctaatctagacaaaacgaacggccgagatcgatctaatccaccacgggtctacggatgacacggcgctgacgtcagcgatgacgtcatcaccggcggcggctcggcaactcacgctcgccggcgaacgatggcgcggcggcgcaaacggagggcacctacacgtagagggcgacgcggcgaactcactgagggcttggacgacggcggacggcaacggacagcgacggcgacgaggtcgaagctgcggaggcgttcgggtcgacgacgacggcggtgctccggcgatcctcggtggaaacggagggtaggacgaggacggcgacgacttggcgaacccaacagtggccttcccgagcgacgacgacgaccagagcggcggcggcgcacggctggactcgcggcggcgacagcggcgcacgggttgtcgtggaggcggcgctacaagcggcggcgagctgaggcgagggtggcgacgaaaagaggaggtcccgagtgtccttatataggggctaggagcggcgatgtaggcccacggcggccaacaacggcgatggaaggtctagggttaggaggaaaaaacgaatccgaatcgagctcgaatccaacgatttcaaacgaaattagccgaagattccaaaagagaaaaggaagaggggatcccgaggatcatttcccctctat

SEQ ID NO: 57483 - DNA, 2922 bp, Oryza sativa
gaaagatacactggaagcacgtaatgatctgaagcatatggaacaatgcggcgaccttcacccggaaccaaaggagaaaggaagccattacttgagtccagccagctacactcttagcaaggcagataaggaaagtatgtttgaatgcttggagagcataaaggtaccgtctggatactccacaaatatcaagccaataataagcacgaaggagaagaagttcacaaacctaaagtctcatgactgtcacgtgttgatgacacaactgctaccagttgtaataaggggtatccttccagacaatgtccgggcaacaacaacaaagctatgtgcattcatgaacgcaatttcgtagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcattctgaagaagtatgttcgtaaccgtgctcgtccaaaggcaagcatcgccaagggttatggaacagaggaggtcatcgaattttgcatagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctctttacatcgaggagcacttggctctagttcgcgccaggaacatcggtaagtccgatgcatggattacacggcatcacattgatactttccccacgtggctacgacaacatctcatgggtaacgagtcgatcaaccaactacttgccttcctggcaaggggaccgtctgggtcgatcgcgacattccagagatatgagatcaatgggtacacattctacacgagagcccaagacatgaagagcacgaaccaaaacagcgctgttcgtgtcgatgccataggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatttaattagagtttttaccaatataataatatcattcatatatatgctaagtatatatatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaattatatgcagtgctataatctttagtcccggttcttaaccctaaccgggtttaaaaagaatttcgaaatagcgggaaaagatatttactcccggttggtgagaacaaccgggagtaaagatccgggggtatatatattcccggtgcgccctcgtcttcttcaccaacacttagacgttttcggccgatcgatctttctcggcctctctttcgccgccactgcctagggcaaatccccgcgccgacgccgccgtatctcgccgtcgtctcgagctcgtcgtcctcgccgccgcctccgctcctccgctgccgccgcatctctggggtgagagccgccgccgccagatctcccttcatctcgatctctccgatctcgatctctctccgtcgcgccgcccgccacgagacgccgtgccacgacgacgacgcgccacgcggacgccgcgccaagccgccgccggcacgccacgccgccgccttcgccggcgtgcgc

SEQ ID NO: 57484 - DNA, 4502 bp, Oryza sativa
agacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcctccgcaagctcctcttccggcaccttcaaagtcaaaggcccccccagctccaccgcctgcccacacaagggcaacgaagaaggcaaaagttgacgccgccaagaacaaggacccggggtacgattgcacgcaagaggagcttgacgcttacgttgcgtcagaagtcaagagacaattcaagcctcgaagtccagaaaagaagattcctatagaccccagtgtcatgaacttcttcaggggtatgtctgcacttgtcaaggaggccatcaagctatcggactatgagcgaacgctgaagaaagcatcttctggaaagtccaaaccagtccctcagcttggagagcaaccaaaccaggagatcgagccgttggtgaccgggaaagacatgacgatagaagaatttattattgacaccggtctaactacggatcaattgctaggagttgaaccaatagaaaaggcggaattgaaatacatgtacgaactcggtaaaccgcttgtcaagcctgagctggtgcagtccctacccacacaaatgtacaagttccatcagctgtacgtggagatgagcgccaccggtagagagatgatcggagcgaggatcagggacccggacttcttgcaaggagatgatattctctggatcaatttcaagggaatctacgaagtataccagctggacgccctcgatgtctctattatgagttgctggactttgtaagtatattgttcaattataattcttaattactatgtctcctttaattaattaggtccttgtatataagtagactatataaaataaaatactcccttttatcgttgtagaatggagattcaaagggcccgacggcggagggttttcgatactggattcatcgaccctcggagagtaaacgttggaatgctcgaccaatatccgcaggaaacagaggacaatctcgtccatctcctgaaggcgcagcattacaagacgttcatactgttaccgtacaacacagagttagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaatgtatatgactcaatggataaaaaagagtctacgtttgacaaggttttcgaacttatagacaggtactggcataagtttctctgttaattaagaaattcttgttatgttaattatttctactacgaatcatatctttaaactccatgtagggcttggtatcggttccgtcatttggtccgcggcaactggagagaaagacttaggcggaggttcaaatttcctgtgagtacacatgctctacatttatatttctccgattcaaattaatacatacaactgtatattaattagatctcacgccgttaatttgtcatttatttgtaatgcgcaaagcaaaagcagggaactaacttgtgcggctactacgtgtgtgagtattgccactgccttgcagaccaaattatcaccacagagagctcgatgtacgtacaaataaattcaaaatttcattacgtaacgatttcttgtttaattactaatcaatttcatacattcatatagtttattcgcatgagggataacctgaccacacacaaggaatttatcgcagcggttcaataacaactcatgggattcatcaacgaagaaatccttgatcccaagggtgaattctactacgacggaaacacaattcaccggtccttagcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatatatgtatgcatatatatgtatatatatatatatatatatatatatatatatatatatatatatatatatatatatattacttcacatttatcctaatacatctttttgtatcttgcagaaaagacgtgttgtcggagtcgtccgtcaagcctgagtggaacagctagccctagaaggaattggagcaggcaagtgacgtaataatataaatgattgttatatttgtaatgcaattaattaagattattagacctgtaattagacttatcatataagattgcgtagtgttctaatattatttgagttttaatataagattattttattgcaaattagacttagtatgacattattgactacggaattggtgcgactcctagcaattgactattgtagtcttaattagacttagcatatacacacgaaacacttagcatacatgactattttagtcttagcatgcaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttataattagacttagtatgtaattattgactacggaattggtccgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattggacttagcacgtaaggttgtgtagggttctaatgtacgacatttacattagcatacaagacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagtgcacgcggagatcatgagagctttgtcccagattcggagaaagagatgctgtggaccagaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagaagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattgatttcaaggaggacatccacacgtacaggagtcggatgaggagcaagagagataccgaggcgaagattgcagacccagagttccgggtatcgag

SEQ ID NO: 57485 - DNA, 11289 bp, Oryza sativa
ccaccagtgactactgatctagaaatagtggtatatactactgatccagaaaaaagtgaaatatagtaccgatatagaaaaaaaaagtatatactaccaatagccaatgtatggtggtacatagtatgatctagaaaaagctgtatgaagtgctatgcaaattttaaacgtgcccattcctcggcagtgtgcatgcatgcaaaaatttgaaaaaatagaacacctacggatggacatgaagaaatttgaaaaaataatattatttatttctttttaatctaactattcattatcaactaatggatatccaacaaggaagagggagtacatacacatacacctaggtatacagaagagtaaatgattccatacacctaggagtacgtactccactagtggagaaatcatctttgcccggtcgaacaaaaaccacaatagtctcggatgcagtaaaaaccaggactaaagatggtttttagtcccggtttataagtagaacgggactacgtgatctttagtcctggatggtgttaccaaccgatctttagtcccggttcacatgctatcaggtgttgtcaggcctaatcccggttcgtaacaccacccgggactaaagatcacgtgatctttagggccggttggtgttacgaaccgggattaaagatcaaacacactatataatccctattatttatcatcttttctcgtccactcttttctcatccacacccactcctctctccctccatctctaatcttatctcttcccttcctccttatctcttttccttcttatcccttcccaactccccttcccaactcgatccagtgtgcgcagcaggaggcggtgggcggcccggcgcggccgccgtcgtggaggggcggcgtggagggccgcgtggcggcggccggggaggaggggaggtagtagccggctcagccggccggcggctttgcttcgttttttttctttttttttcaaataatttgtgatccatgtgtagtttgagatgaagaatctgtggttcattgtatggattgagatgtatattttttttttgaatcttatggtatggatctgagatgtacatgatttgtgtatgatttatatatttgggatgtttctttgatttggggtttgacttgggttgtataatctgtagtgtatatgattgatttttgtacttgggatggtatgcatcccacctaatttgggagaaaataaattagagattaaatagtaagtaaatgaaaaaaaaaactattgcccactcccatctttagtccggttggtaaatcgatctttagtcccagatatttgaaccgggactaaagattagggatctttagccccgaattcgtagtcccggtttgaaaaccgggactatagggggttatgaaccgggactaaaaacgatttcttgactagtgctcccgctcccatctaccgtccatcatagccaccccgaagaagcccgttaccggattcacagaacggacccgttttcatttttaacaagaaaaaaaacataatcttaattaacccgcggtaatcggaaaaccggatagataaatcccttttcccagctcattagatcgataaatcagttatcagtggagacctcgatcttcggaggggttggcatcgttgccgacaagggcagcatatctacatcattgatttggcgtcaacgacgagtcggaagcgacggcgtgatccatcggcctggtgtcttctgccctaccggcgtcggaggaccacggaatggcattggctggctccgctcgacagaacgagaataggtctaggtattggcgatgcgctgatctactccttttctccagttcgtttttctttccgttgtttctcgcttattaagcggagatcagaacgggttataggtcagctgctagagtgccgcaaggattaaaacgcacagagatcacggtggccaggtattttgtctaatccaattgatcgtctcgatctcgatgagatccggtaagcacctttgttagttaatttcaccattagttgtgatttgttttcatatatgtctagtcaaggcagccgtggcggcctatcgctactaccagatctccaggatggtggtgtgtactgttcttagtttatatatgaaattctgaatcacagatccacactcagatgagtatacactatttcttattcttcttccttttaatctctgtacgtacacgtagataaaaattaatcctagagttcagaatgaaaaatactgtgatttggatgagaaaaaatgtcatcaacagatggtagattaattgtcctttgcatgcgtgaatgttgttccaggatagtggtttgtgatggatttctttagttccttgaaatttgaatgaataagcccctaatctttttgttgcttgcaggtggtgtccggccgcgccggccgtctgcagaacatgtcgactcaacgccacaatccaacggcaccagcggagagaatatacacgcaaggggaaggatccttgtttgacaaactgtgatttggatgtacattattacttttcaatctgcgattcagcatgttcaatttgtgttcttgatcatgttttctcgtctgtgaggctagttcttttggaactacatatatctttgagaatatactaaaacttttggatcataatacgtgcatgcagcacgaacactgagttctgcgacagggtaaaagcaagtaataaaaatagcatatatactgctactatcttaaaaaatagcatatactgctactgctaaaaatggtatatactgcaattatcttaacaaaagtataaacctgcaccttaaaaaggtatatgttactaccaccttaaaaagaagtatatatgtatattgctaccacctaggaaacagtatatatactagtcttaactgaagcacagtacttaaactactttggtgaagcacagtactaagtaaaaaaaagaagtatatactattaaaaaaaataagtatatactgtcataaaaaacacgtatgtgggatatttatctgtatatatttctctacatcaaaatgaagtatatggcagctgcctataaactgctgcctactacaaataaaaaaaaacagtatataccgttgcttactaaaaacaaaaacagtatatactttcatgcagaaatggcagcatatacatagctaggaaatatactgcacgaaaaaagagtataaactgttacctactactaataataaaaaacagtttactaaaaacagtatataccctatatgggctcttctggccccagcttcctccaggagacttccatgtgggcccctaaatcagtgacatacattctaggcccatttgtgattgttaaattggacttttgggccttctcatgcaattgcagatcaccagcagactttcgactgattgattgatatatttccacatccttctcttcatttatgagtgcttctcctgcatacatgttagtagcatagcatatagtggaagtaattattttatttgggaattatgcattgcaaccataggtagtcttcatatattggataatattgacggtcgaaactggtcgacaacgaccgcttgttcttgtacataagcgaggttgacaccggcctcaacatcatcgacgtcttcgccaagctaatcctacagaagttcaccgacacgatgaacaggagggagctactcctccagagcgacaagaaggcagttgcggaggccttctggcggggcatcatggatggaagggtcgatgacatggtccccacggaaacgatgaggactccgtggcgtagtggcagccttttacctcacacgcaggggtacacacatgaggagcagcagcatgattgcgcagctttggccgtggagccctcgcggcggagcggtgtagcagtgaggacggggcagcggggcacacgtgcgtggtctatgaccttacgcacaacagggggcgcgtgagaactgagaggagcgtcggaagaagaccggaagaagggagaaacacaagcacaaaactattgttttatgtggtttctctctcatcaattgggttgatattatattggcagggccagaaagttttacaatatagaacggagggaataaaaaaaattgatagatggaaaataaattggtaaaaattagtagatgggaaaaaagtagcactaagttgataggttgggtataaaatatcgtcgcggatcacaaaatatatatcttacatttgggacaaatttaaagggcaaaatcatttatattgtgggacggagagagtagttatatagctgaattttgcttctggcctgtggtgcagttgcttccaaaataataattctctccgtctaacaatatatttggagctttttttctggatattaacaatgagtatgtgaataaagagttagtattgaatgagatgagtagttatgtgagaaaattaaacgagcagtagtagttgtgattggttaagataaatagattgttgtagatattcgtatattatattaaataaattttaaactatatatcattatatttctagacctaatgattaaccaaggaaaaatgcaaggatttgacaaaaatatagaagccaatgctaggcgcctaagtgaatggatatgaaacaaaaagcgagcaggctgtctatatatgggcaattagttgcattaatatagtagtttataattgcaagcatggcactacatcacaacaccaaaaagacatgccgtgatgctagaacagccattgaataaattagaaagaaaggttgtggttaattagttaacgaccaatcgagcctactagtataaattgtacctcgttgttatgaagtaattcatcctgtagtaacgaaacaagcagagagagagagagagagagagagggagagagataaataatatacagaaatgagcaggtcgagctcgagcatggccaccgtcctcgtggtgttgatggtcgtcagcgccggcggcttatccccaccatgtgcggccgctgcgaaggaggagaagccagtggtggtgctgccacctgcggcggcgccaggggaggcgccctccgcggacgcggcagcgttcgtccgctcctgctgcgacaccgccctgcaggccgaccgcgacggctccagcttctgctatgaccatctcctcccctacgctgccttcttcgagggcaaccaggtgaaggtcgccgaggtggccgccaccatcctaagcaccaacctctgggtctacgcatgctctctagctacctactaagtggaagtacattattttatttattatacttgttgttaattcccatgatcgattagtggtgttgtccacgatttttggtaacattgtttttctcaattttctatttcatatattcccaactctcaattctacattatatatcattttttcattcaacttcatacatacaattcctcagttctttcttatatataggccttacgctaaatttcttttggatacacaccaccgtcgattatatcgtgcatacttttgtatttcaattaattaattgtgatacttgcttcccacacattgatcgcatgcacgccacatttgtaacattgttatcaaatttcggaaataaatttatctatcgtgtgaattatttcagcttgcatgaatctttctttttattttaagcaacctttttctggtcaaaacaaactacacaaaaagatgacaaccaaaatatgttgatatattattaggagtatcctgattcacaccaatgctaaaacaaaaacataaaattacaatagaaaaatgtaagtaaacatcaaggctagagctaggcatttaatgctaaaaataaatgtcaatgtgtagctgtgtgaaccaaaatagaaaagagaaaacagatagttagttattgatcgtccttgttcctgtagagaaacttgtggagagtatgcgtaccgggtaccgacacggcctccatattcgactagagataggagtgggccggatccatctattatgtactagagtgggctgtctggcttgttttctactttgtaaccctgccccccaacctatataaggcgggcaatgagcccctacaagggcatcagcacggataaccacaatcagatcatcagatcaatatccacctggcggatacaaatccccaaacaggtgtagggttttacctctcatcgagagggcctgaacctgtctaaattcttgtcttcacatccatccacttttatgtctcgtgcgatactctttttcatattgccgaattccagtttaaacagttggcgcgacaggtaggggaagcgtcgaattatccatcaagaagtgcaatggaaacaacttcaggaatcaaaggcattgtttttgctcgagggcaatctcaatgagatcgatgattctaatctctgacgtcgattggtttgtcgtttcaatctatatgaaatcttttttgacctgaaatactgccagggctttgccgagcagtgtaattttatataactcaaaaaatatttacaaagttacagtcgaaggagttaaataaaactataaagcttgcaaccaatcaaaaacaatttgctttaagggatccttcattctgcacatatacagaagaacttctttcacaatctatataatattattagcttgatttataatcatggattgatctgtcgtacgatgtcttctttgcatgcatgtacgggtggctgatgaggtccatgggccgccgaaccagcacgtctgcccgggagggaaagtgaagtcggtgatgcccgaaacgaatcccatcgcactagtcggcgaaaaacatggcgcaacccctacctgacgcgccaactgtcaaaacaagattccggcaatactaaaaggggtagcaatcaagctggaaaagtggataggttaggacgtaggaggcaaaggtttatacagccagggaattattccaccgagtgtattattgatctgatgatctaggagaaaagttatgcccctaggtacacttagacccgaccttatatagggagaggagccaagattacaatgtacagcccatatggcttacgtactaggctaacgaatatgtattacaactgtagctaactggcactactggatatttccttgacatacaagttaacataattcccgagtcatttcctaaacatattctatctatacaagctattacctataaccagtcggatatacgtgccatgtgggtatgtggtacccaactacccataatctccactctgtgtgtaagatgcatcccttcatttgtaggagtcaagtcactatctttcttcttgtgatttcttctagcagtctttgtcacatccttattttcgtattaggatttataaattatttaataaattattattaaaatttatattaaatgtacattaataaacaagtgaagttaaatgtgggaaataaaatttcctaaatataaagcaaggatggattaaatttttattaaattctacatggttaattatactctctgaaattttctcggattttttagagctcaattactaattttaataatacaaagaacattttaggaattatttaaatattaaattagtcattaaatgatcttatcttaagtttgttaaatactctaagtgtccaagcagttgcgagatttttcttgaacatatttcagtatttgaagtatttttaacaattcaaatatcatttcagtgattaatttagttggaaaagtaattaaaatactttccaaagctcaggtcttaatatggcccatctctctccttcagcccagccgatccagcagcctctttctctctgtcgaagtctgctttgggcctgtttgggggagctttagattctgagaagcagctgtttggtagccagcttctgagaatgtggaaaagctctgaaacccagcttctccagcttttggcttcttagttcattttttagaatctataactacagattctcagaagctgtggactgtttgaggcagcttctaacagaagcagcttttgggaaaagctgcagctgggagaagctcccataaaccgggcatttgcttccctctttaatcaggccttggaagatgaagcccagctgaaagtctatacgttttccctccagctacagtgtcgtcttccagctccagatagagcccgtgcagctgccgagacgctgccgtttcctccgcctgattcgctcgattctctcagccgtttcttgaattggttctcttccgtttccctagactttatcccttttaattcgacacggaatcgagctcggattgagtttatctctgcaaaaacaaaccctaattttccttcaacgaatccatccgttcccgagccgatctctctttcccactcctataaataaagtcccctccctctcctctttcggccgccacctctccctatctctgccgtcgcttgtagcgctgccgccgcgttcgcctactcagtctaccgccgaccgccgctccagccgcatctcgccgtcgccctggccgtcctcggtcttagctgcttcctccctcggctccgcaaggtcaagagcaagcccggcagccatcttcccgaagctgaaacccattggaatcccctcatcgacgtgaagccgatctactccacctccggtcgagccctgtcgatgactccgtggtggtcggttttcgccgtcgtcttcctcagcatcgcagcgccaagctgaagcccggccatcggttttccttcgccgaagattgccaaaatgtcgccgtcgtcttctcttgtccccaaagcagttgttgcttctatggtggatgctagttgttgagctggaagtagtgggttcctaacaatctggtatcagagccagcctggtttcccccatctagctcttggtctagttgagaaagttctcatcaagtagggtgccatggcaatagaagacaaattggacttgctgttgaggcggatagaggagtacgagctgaggcgagaggaggctgatcggagaactagagctgatatacggtctctcatagatgtggttgaagcatgcacaccggaagttgggaagaaggcaaaagacttgccagcgtcaattaagaaagagcagtcaaaggtgacgcccaccacatgtttgacgaaatgctctagtcccgacatcgagcccaaactcacactggttgcgatggtcaaatgtgccgccactgccatggcctccatgaagttggtagctgataatggtgcaaccagcaccaccaaaattcccaccactgactattccaaggagacgcacgccaagtgttcgatgttgggcttcgatgtcaagtgggacgccaacaaagccgacatcgcgttcctgaccaagacggttgtacttgagaccgttccagcatccattgcatcattgagcgccttctcaccaaggatgatcgccgacatcaagcattacacattgatgcccaccaggtattcagcgaaatgttctgggtctaacaactctcaagttgtgtcttatttgtccttcttaagcaccccagtgttagtggaatcagttgaaggacatttgttagttccatggcaactgctgttgcaacactttgaggttgatccatggccacccataacatcaagggatcaagagttgatcatattggagtcacagttaatgtcatggctggcattcaactgcagctgttgtaaagtacatatactgccaccttggccccctccaaccgaagcgaaatggtttcaactctttgtgggcaagcaattttcattggtaaactcgctgaacattatacatgtcatgtttgggccactagagtgggatccaggtgatggaaaggtccaccttcgcaaaatattaatatggatggatgattggttcccacaacattattttcattggaggtaaattttgtggagcaataagctgaaattcaatgttggagtgaaaagtgagttgtcctttttgatcaaccttatagcagccactagcaaggaaggtatctatgctgctggtgaacctgaatatttacttttggggctatcttttgttgaaatggaaagaaagggcaactgctacttaagttggagtcacttacttcttgcaagagtgatggttgtggagctgagcagtactgggcaatttggttctgtgaacttttccttcaaaggaaaacatgttgacaagctcagactatttgtcatgccaccttggctgccattagtttgtttgctggaagttagagaagggaaatgttgcactactgattctgctgcaagtataattccttggaatgagcaaaagaaaatgatgattactgaaacttgcacttgctttgagcaaaaaatgcagaagttttgggatctgactttccaggtcagtttgacatcacttgatagcaaggaaagcaatctagttatttgtgatcctaaatcattatctgtttggttatcatctgttgatcttcaggggatgttgctcaactactaccaaactagagtggagaaatggaatatgagaataatttgcatggtgatatcagaatctgagtcatgtttggaatcaaattacattggtttgaatgttgaaggagatttgctatatgtgattgctgatgaaaaaggccgcaaaagggtgaaagaaatggaagaagatgctaattcaattcatgatgagaagtatacttttgggttagttcctatagtggtgttgatcaagcgaggttgtcactgtttgcagcatatcaaattgttgggaatcaatgttggcaagcgattcgtaacagtgctattgtcatgcatcacccaggtgtactttacatggagtaagcagttattcaagctaaagctacttgctctattcttcttcaatgatggttcattgtctaacaccaaatatttggaggaaccatgggatccgagaggtgtattccatcggcttttggacaagccaaatttcaagaagaggggattgtcaggatcccgggtgggccgcacacgggctggtcagcccatcgccatgaggcccaagcaaacggaagggagcagcatataagcagcagcatcgacaacaccagggggcatcgaaagatcatttggacttggcagagcagaacctcccggcggcggaggcgacttgggtggccggtgggcaccctcgtcgatctctctcccctacctctcctccgatctccagccttccctctcccctcggttctagaagtttccagcacttgtattccatagcttcttcttctcttg

SEQ ID NO: 57486 - DNA, 2938 bp, Oryza sativa
tggtcggttttcgccgtcgtcttcctcagcatcgcagcgccaagctgaagcccggccaccggttttccttcgccgaagatcgccaaaatgtcgccgtcaccgtggaccagtacctccacgccagcgtgggcaacagctttaccttttgtatagcatagttcgttgcggggcaccagactgtgaagtagcgagaagtccatggggatcgctgcggagtccatgcctctggttattgagggggtgattatgatccaggtatggtgcgctgtggtggattgtgttgtatgaggggtattgtcacagtcccgtttcgaggtaccgtggtgatactgagggcatggtaacatgttttggggctgtgtcttgtgggtacagtggtacatctctggccagagtaaaactattcgaatagtcgtgcccgcggttatgggcgggttgagcaatgtttttcgttattagtctcacacctctcataataattattgatgctatagcaggtaataatttgcttagctcctagtttggaattagatctgtacagctgggtatggttgtttaggatggttgggcctgtgcagcatggttgtgctgttcagtgttgattaatattgatgattaattactctattgttttactactcctaaatgtttgctaaatgctacttttgcaaatgagcctatattatgccatccttcggaatccttgtgcactcacatatttgctgtgtggcttgtggagtattccacgtactcatcttgcaataatcaatcaacctcagttgaagaaattaaaatgatccagagggagaaaacgtttggcttataccccaattgagctgcctgtgggagtggagccgaaccttcgctagaccgtaattccgccgcagcttttcttttcttttgtaagtatgtaacgatattattatgatggattggtatattaaattgtcagtttatgtacctcagctgattcctggacgaggattttatgcacaaataagttcagaaattaccagaaaatttccggcaagacggtcttgctgctccttttcatcttatgattccatccagttgtgttaccacacgacaggatatggacctgttctgaaacaacagtttcgcagtataaattaattcgttactcctttcgataaaatgattagattaatgggcacaccatttttccatatcctacacggcctgttgtctttgtgtttgatctgagtgaactaatttgattactctctacgatctcaataaccatgaaatggtcatctctgctcatgatgaatgggtttactgtatcttcctacttcccccatcttaatcgaattgcttgacttacggcctcttcttgcacctaatccacaatgaatgtatgtcaggatcccgggtgggccgcacacgggctggtcagcccatcgccaagaggcccaagcaaacggaagggagcagcatataagcggcaccatcggcaacactagggggcatcgaaagatcatttggacttggcggagctgaagctcctggcggcggcggcgacttgggcggtcggtgggcaccctcgtcgatctctctactctacctctcctccaatctccagccttcccccccccccctcggttctagaagtttccagcacttgtattccatagcttcttcttctcttgtccccaaagcagttgttgcttctatggtggatgcttgttgttgagttggaagtagtgggttcctaacaatctggtatcagagccagcctggtttcccccatctagctcttggtctagttgagaaagttctcatcaagtagggtgccatggcaatagaagacaaattggacttgctgttgaggcggatagatgtcacgcccagaaattcccgaatagaattccaagcagaatgtgcattaaaatccccgtccaggaccggccggggtacacaaacgacaatgttgacattcagatccacgtcttacaaacatcataaaagtctcacgtaaatgcagcggaaagaaagaaagaaaacaggagctaagccttgactagaactgcagtgggaacaccactccacaggcatccttgacggcacggacgaagcctactcctcagagaaacctccatctgacacatactcgtactctggggttgggaaaaatagagcaagactgagtactacccactgtactcagcaagtcataccggaatagaggcatgatgcagggaattatcaaagaagagctaaagtggttcgtttgcataaagcgagcattaaaaaaaacagaagttgaaagatttaaacagttgtaataattaattaatattaactatccactgtccaacgctatcccacattgcaacaggcccaaacctcaacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcaccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgttacaagcccagccgttgcccatgctggcttgtggtaagtacgataagttcttccagggcatcccacgaacctgtccttaactgccatgggtgcgaccagcaaaaccatgcacccacagcccaccatgtgatttattttaattaaccaacaccaaagcggtggcactaatccaa

SEQ ID NO: 57487 - DNA, 2250 bp, Oryza sativa
  unsure (1)..(2250): unsure at all n locations
ccccattgtgcactagttgaactaagcatggcaagcaatccctagtccaatctctagtccaaacggcctagatcgccctcggggtcgatcggacgggcggcgacgacccggctcggcttggctcaaggccggcctaccggccgcggtgatggcgacggcgtgcgcgcgcgaacgcgttgccggcgacggcatcaggcggcggaggcgacggcgcaaaggcgacgcgaaggcggcggcactaagcggcggctaggaaggagagggaggggaatggatgggagaggaaacctcaccgagggtggccggcgcggaggaagacgacggcgaacggcggctgcaagccacgggaggacgacggcaaccggcggacgggtttcggggtgccctaaggaaggaagagagagagattagagagagggagatgaaccacgacgaccggcattcatggccgaaggcggcgatagcggttgaactcaccggagcgcgagggggtgcgaattccggtgacgaaactcaacggggaaggagcggccggggtagagcttagcctcgcgaacccgacggcagcgacggcgcggcacggcggcgaccctagcggcggctagcggcggccggagtagcggaaacggcggcggcgggtggttgcacggcgcgggagcgatggggagcacgagggagttcggcgagatgggcaaaaagcgagagggggtgacggggaagcctaaatagtggaggggagccccggatgtggctggaaggggcgggatttcgccggccaacgtggggagtgggggaggagagagaggcgggattcgaaaatcgaatcccggccatctcgggcgcggggcgcgggcgcggatgggagtgagaggggagaagtgggtgcgggagatgcggcgcacgcgcggacgtggctgacgtggcccggagaaggcggaggcgtgggcgcggcggcggttgcaggcgcggcggcgccggctggaggaaggggacgggtccaacaggtggggcccacctgtcggcgtcccggggagagagggaggtgcggcttgggccggcccacaaggaggaggacgcgcgtggcggggtggactgggccgacggcccaagaagaggaaaaggaggaaaagaatttccctggaattgaaaaaaaaaaatttaattttggccaaggcctccaattttaaaaatggttaaaattatttcgagagctctgaaaattccactaaaaatcctattagtgaatttcgacatgtagaactcaagaaaaattccacatgccaattttgattattgtttgcatttctttaatagggtttactcttgctttgcaccggtattttcttagggtctcttattaattcacttttaggcttaggaggagaacttcagggtgtgagaaacctatccccccttaaacggaatctcggccccgagattcggaggagctggcgaagaggtgcggatgggcggctttcaactcatcttccctttcccaggttgcttcctcttctgaatggtgactccactgaactcggcaaaacctggtgaccttgtttctagttcttctttcgctggtatcaagtatatgaaccggcttctccacataggttagatcctcctggatatcaatgtgttccgaatcagcctgttcttcatgtacccttaagcacttctttaattgggacacgtggaacacgtcatggatgccgatcatattggatggaagttctaactgataagcaacttctcccctttgttccaggattttgtagggtcccacgaagcgtggtgccaacttgcctttcgtctgaaaacggtgtactccccggagcggagtgacacgaagatacacgtaatccctgcctcaaaagtgagttcccttcggcggttatccgcgtagctcttctgtcgagactgggcaatcctaaacctttccctgatgattctgactttctcttctgcttccgttaatacctctatcccgaacagttgacgctcgcctgtctgatcccagaagagagaggtgtgcggcacttccggccgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57488 - DNA, 1591 bp, Oryza sativa
agctttttagcagacctgccccttggcttccctatgcccattcttggatccatctgcaagtctttggtcaccttgtcctacagcaacctatagctttgtcttctgtatgggcgggcatcttaagtgatacacctgggaaaaaccatctctattccaactccttttatattctccactcccatctctctctttctcccactcctacctaccctggccactccccctctctcccccactcctcactccggccacctcctctccctacctcccgcaacagggcatcttaagtgatacacctggaaaaaaccatctctattccaactccttttatattctccactcccatctctctctttctcccactcctacctaccctggccactccccctctctcccccactcctcactccggccacctcctctccctacctcccgcaacaacaggtgtggtcgacggcggtgcccccctccgctctcccttgcgcggagttgatggcgtgctcgagtgggaggtagcgggcgcggcagatggcattgtggtggcaggcacgggctccggcgacaggtgcagatggcggcggcggcgcagatccggcctccacgcgcgcagatccactaccgtcgacgacgacggtggtggccgactagggttaggattagggtcaggttttgatttttagattaatatttgtgattttccattttcacatgagaatggcttaaatgcccgcatgcgggtgagccatatggaaaaattgctatttcacggaccatttcggacagacggctggtcgaaccgcaattgattttgacagtttgaaaaaaatccctttttagtagtgcatgcttaaagtactttaactaataaaataacttacaacaaaataaattattattacgtaaatttttgaataaaacgaataataaacatataaaaagggtcgatggcatcatctatttaaaaaacgaatgtaaaaaacgaatgtagtatatataatctgacacacgaacagcccaagacagatatatacccaatagattcaacgagataattattatcagtgggtgtggttcgagaaatgacactaataaattttctttgtgccgcaatctttaatgcgttaacagtccgagaaaaaaaatgtacgagacgaatagcatatatatacttcctccgtccgtacatagtataagggattttgagtttttttttattgtttcatcactagtcttatttaaaaaatttgtacaaatataaaaaacgaaaagttatgcttaaattactttagataataaagtaagtaaaaaaataaataataattctaaaactttttaaataagacgagtgattaaatagtataaaaaacataaaatattttatattatgagacggagaaagtatatgacaaggtaccacgctatcgctacctactatatatacccagcatgaaaatgtcgtgagtctctctctctctctattggaatctttctactactggtagataaacaagtctttaatacgctggccttctactgatcaagaacaaatgaatcagaatctgacaaggttgccagaaataaaaataagcag

SEQ ID NO: 57489 - DNA, 2072 bp, Oryza sativa
gatgaatccacgagtggtatactgttgatcgacgtcagcaagcaccggaatttctgcctgcagggccattctcctccacacaagaccatcatatgtaaatggtctcgaatggaccggcagcagttagcgtgcagctcttggtctctcaaccatcgtactactccctccgttttataatgtaaaaggatcttaagtttgcttatagtgtttgaacattcgtcttattcaaaaaaattttagaattattatttacttttttatgacttactttattatccaaagtactttacgcataacttttcgttttttatatttgcataaactttttgaataaaacgagtggtcaaacactataggcaaaaactcaaaatcccttatattaaggacggagggagctaataactaattagcactgtacttgttttggaagactcagcgtacgtgcttcatgtttatcatctgccagaatctagcggcatctttttccttgcttaccacgagcacgtactgtacgttttattttttaaaaaatcatgtagaagtccttttcaaaatcaaatgaactaatttttaaaatttctaacagttaatatttaattaatcatgcactactagcttccctcttgtttaatttcatttggcaccgacttatcaaatcctacggctctatcaaactaagggtatcaacaatgtattatttaccaactactccctccgtccaaaaaaaacgaatctataattagatgtgacacatctcagtacaacaccctcattttacataccttcagtacaaatctggacagaacaatacatcccttataccaaataataaatattgtagtacataccttctaaaataagttcattttacacattccacctaccaatgtataaccaacacaactagaatacccttactttcttaaaacccaatgccattattccttactaagagtaacaatgcttttttattccttcctatgaggttgtagtgctattactacctgatattagttgcttagtaccttcacaatgtttactaattggtactataagagatgtattttcgcttactatacccttgtcccaaatatgtatttatcccacggtaccaatacaagaccaaaacgaccataataccgttacttgctgagatgatcaatgtttttttattccttgctagcaggttgtaatgcaattgtcacatatttgtagcttactacctccaaaatgtttactattcggtataagtgttgtatttggtgcttactacaccctcatcccaaaataagttcatgtttcacacatctcacaccaatacaaaacaaaaagaccacaatacaatagttttctcaaatgacaatgaaattcttgctaaaagaattaatgtttttttattccctactagcaggttgtagtcctattgctctatatgtgttgcttagtacctccgtatgtttactatttggtataagggatatatttattgcttattacaccccgctcgtaaaataagtttatttctcacacatcccacacatagcaaccactatctatttaatttatttatctattttttcttctcaaccaatcacaaacttcatccaattatttttgttacttctttaatatccatgcccacctaatatttgaacggagaaagtatctattttgtgacaaagacagtatccttttcaagagttcattctggaagccctatgccttatcctatataaagcagctagctagctagctaaagcaaccatcagactaccacactacaatagtatcagtgaactgctagctgttgccctcccaagggaaatatactagtatgtctacttccatccctctccctttcttcttctctcatggtgttgtgcatgctaggacaggccatcctccaatctggccgccggttgggctcctttctgctggtgccccggcaaaagtctccttccgacgacaaagcaatgcgcatcgacatgctgcacaagttgtgtccacacaatcaatcactcctgcgaaggaggtgtctagctttgagccctctgtgtggggggacttcttta

SEQ ID NO: 57490 - DNA, 723 bp, Oryza sativa
tgtatttagtagatcaatgaatgatttgatctaaaagaagtataactgtgtaccaattagcacactctccatttttttttctgctgatctatgcattatgtttatggaactaaataattaatagaaattttagcacaactctcaaaccccaaatttttgaacaacgggattttattataagctataaaatctctggcagaggtaagatggagaactgtgattacataccgtcaaataaaagagtttacactatcaaactatatggggagagtttttttttttaccgcccatcaaaactttggtacctcgcaggagcagacaagtggccagcatcgtatcaagaatttgttcgcaggcagggctagctagagattacggtgtcgatgcgggcacgcgaggacgagaagattgaaaggcatcgatatacaagtgctcatttgtgcgagggagagggcttgagttcgtttccaatcgtgcccccatcaattcgactgttcaatggcttctggtaccttgaggtactatctgttggaccatagcaaaccttgtatagggaacatctcatattaagaatttattaacacacacaacacaagtgcatatttcacaacgccaagaaggataatggaggcatagccacacttgtgtagttatcattcaatcttattccttccaggacgacaatggcggtgtctcggagtccctctaggtggtgaggaagct

SEQ ID NO: 57491 - DNA, 4966 bp, Oryza sativa
ccatcacgctcacccgctcgaagatcaccgtgttcttctccatgttctccggctggaatcttggtagatcctggaagaaacagaaaatggccattcattgagtttgcaaattttggatagtgtcatgattgatttaagagagatgacggtggtcaaatggattgttatatactacctccgtgttttaatacatgatgccgttaactttttatcatacgtttgttcatttgtcttattcaaaaaatttaactgattatactttattttgttgtgagttgttttatcacacaaagtatttaagcataatttatatcttatacatttgcttaaagttttatttatatcttatacatttacataaaatttttaaataaaatgaatagtcaaatatatgtataaaagtcaacggcgtcatctattaaaaacacggagagaaaatatatatgggcaaaagaaaccttccggtaatcttgttcggactagggatgaaagtggttcggatactttccgtctgtccggaccaattttccgattcggccggccgcctgccccgctccgcaccgctctcggccggccgccgcccgacccgacctgcgccctgtggatgagaggaagtgagagagagagagtagaaagtgtgtgtgtgagagagaggagaggaagagtcaagaggataaggttggggtgaagaaaatggtggatttttttaatgtaaaaatcaattttcattttacatgtggctctttaaaacgaatttaaaggcactaaatcaactcatatgaaaaaagttgttaaaaacaaagttgtataacttattgagatctatcatttttattttggtcatttctccatccgagtttgattaaaccatataaaatttgaatttaaaaatataagaaattcaaataatttttcgggtagtaaatgatttcaaatgaaaaaattttcaacaataaagttgtataacgcatcaacatctacaacttttgttttggtcatttttctatatgactttgtttgaaccgtttgaatttgaatttcaaaatatgacaacttcaaacaatattttgaaatactaaatgatttcaactgaaaaagtcatcaacaataaagttgtataactcatcaagatctataacttttattttggtcattttttcatccgacaaagtgatagtaacattgttcataaaatttacatctatctcatttgtttctataaactataagagagatgtgtaaactttttgaataatactactatcactttatcggatgaagaaatgaccaaaataaaagttgtatgtcttgatgagctctataacttttatgttcatgactttttcagctgaaattaattacagcttcaaaatattatttgaagttttgaaattcaaaattttaattgataaaataaagtcacaagaaaaaaattgccaaaataatagcagtaagaacacaataacatgatagagcatgattttaaaaacatttaggaaaaaaaaatcatccaatttggagttcatatgagtgagataaattagtttcaaattttcaaattttatttttgcatacggcttcttaagtcatccgtatggaaaaattgatttttccatgcgggtccttaaatggtccacaaacaaacaaataaaaaaattcaattctgaaaaagaaccactcaaatttttaaaaactttcaattgaaatgttcaacccaaaatttaaaatattcaaccaattttcaaaaatttcaatgtgcttacgaaaatttcagctatacacattaatttatttgtttcatgataacataaatttgtatggaaaataaacataacatttaagaatactgataaaatttgagaatactgatgttttgtttttgaaaactaatggctacatctcttcctcgttttaagaagcttattttgaggggtcttgatattttgataattatacattaccgtattcgtttcgattcatattcgcttcgtatttgtattcgataatattcgattctgttttcgtatccgggtttccgattccgattttgatttcgagaaaaaatatgaaaacgaatatgatagagctagtttccgagcgtattcgatccgttttcatctctagttcggacattgtgcctactatttttgggccactggacaaaaagccgacaattccaatgccgagttccctgaaatgttcagaaacatatgtccaattgaaaatattatgaaaattcactctgggcagattaatatatattgtttgttatgttgacctgcaagttgggattatgtcttcttcagcatctcttgaccacagagaccactcaagctggacagctgtgatgggatgcactgcgtgtgctcttctgattgttgatgccgacgcttcagacagtccaatgtactttatctttccctcttcaaccagtttcttcagctcccccatctgcatattaacacatccaagtttgttgaaaacttgagcacttgtttctgcctatgcggactgtgatatactcccttcagtttgactgttgttcattcatttaactgctattttatttaaaacttttatacaattacgtaaaaattgtaagccaagcttaaagcacctttaaaaataaactagatcatatcaaaataaataataattatgtgagtttctaaaaagataaatggttaaatatatatacaaattaaggtccaacattaaaaaagtggagcgagtatatattatactttcttttcaaactcatttttttgtgcttttacatcctatccatgtgcatgggccaggaagatatattaattttagtgttcagaacattttgacggtgaagaaatcgaaatctgtcgacagatatacagcaattccacggaagaaaagatcattctcatacactggtggagaaatgctttgtattcccagttggtaaccccctgtagtcccggttttccaatcgagactacgaaggtttaaatacttgacactaaagatcgatctttagtcccggttggtaacccctggactacgaagttcaaatacctgggaccaagttttttttcttttttttttttgctattttgtatatctcacgcccattatatcaaatcattcacagcaacatagttcaacataaatcattcagaacaatatagttcattctcaacacagatcgaatcacactttaagaaggaaaaaagaaaaaaatccgtgtagccgcgccggcctccaccgcttgccgccgcgcgcctccgtgccggccgccgcctgcagctgccgggggtggtctggccgcctcccctctggatccaccgcgcgaggctgcctccgccgccgcccggccgctgccacgcgaggccaccgccatcaccgcccggccgcctgagatgtgagcaggagggggaggagaggggagggggcggatccggaggaggaagaggaaaagatggggtgagtgaggagaggaggagataaatgtgagggaggagaaggagactaacttattaactgatcccatgcgcctcctcctcgatcacgcgcgcatgcctggtcctctccgcgcatgccaatctttttttctggttgtttagcaaccgagactagaaatagatctttagtggactaaagataatagaggggtctgacaccgcctaccgttttttaaccgggactaaaaattgatctttagtcttgattggtataaaaaaagtagctctaaccttttgatcgagactaaagaatatcgttagtcccggtttttattgcatccggaactattgtggaatttgattgaccgaccaaagatggtttctcccgtagtgagagaagatgcagcgccattgcactgtagtgtgtgctgctaaagtgtcttgatgaacagtagggtgatcacctgaatttgttgttaggcgtcaccaaatatgtcaccagccggctaaggacaataaagaaatggtcagggatggcagacggacagtagtgctttgtagctcgatccgtatatttgcaccataatttgtgacaaggtaacgtcaaaaggcagatctaattatattgttcatagatccaattaattatatatgctcgctccatttcacaatgtaaagtagtgtttttagttttaggactgtctaggtgattctcacacatgacattcaatgatttcaattgcttcatcttttttttcttatcgaaaaggatgaacaatatattttaacatatagaaataataacaaaaattacagctcataacctttacaaaactagttacaaaaagttcaatcttagataaaaataaagtaaagccatatctaacatcataagtactgttaaaaaaggtaaacatacacacgcataccaagtacaattttagacttaggagtgtgcaattttaggctttatttttttttaatatatgatgtctggttttaagcgaacatgcatgtataaggacgttacatatgtgacgcagtgtattagtgaattattaaattaaattagataactagaaaccaattaaatctctccttcgaagtagacttttgattagtagtacatggacactccagccaatcatttattaattctacacactactctaacaaccattgtgcgggtaggtataatgtttctttctttttactagtcatgcgcattaccatggagaaaagtgattgtatgacatactatgtttacatatttatccgacattgttttttgaaatagataattcattattggttaatgaatatgtgattctttcatgagaatctttatgttgtatgttactatttataaaggatcgctgatcaaatatcatatatggaacaaatatgtttaaatgatcaacacatgtattaattgatgatcatgtctcatggatcatggtattgagatattaaattaataatatggacacatgttggggaatatgttattggatagccccaacatgaga

SEQ ID NO: 57492 - DNA, 900 bp, Oryza sativa
attctgataggggtctgaataggagtcctacgggccttgaaggcccgagtcatggatcctatatattcgtgaggggtgtgactggggaggtattgaatcacgtgagaaaccctagccgctactctccttcccgagaaaaaccctagccgcgcgcgggtgctagcgcatctgcgcgtggcgttccgtctctgtacagtagaggcgccgctgcattgcggtgctgatcggcgtggtactacggcgaggagaatgcacgggaaggagaaggtcgacctggtgcgatcgacaacttcctctacatcgacgcgcgctacatcgcgagggttcctttgccttcttagcgctttcttccgctgcgcaacacgtcgagtggtaatgatctatgatctaatacttgcatggttcctagtttacgtggtagaaaattttgatttatgctatcgtagccttcgcgtatcctaacagtggtatcagagccgccttgtataatttatgatttagatcattgcatatagttgatatgcgggcgtagtagatgagatctattttgtagtagatgagtacttagatgatcggaacataagatggaccgataggcacatgggttgatgagatcaatcagtatatgtgttggtgacttcactagaatgtctggtactcaccacggccgagcatgattgtgttcatcggatagtccgatgtccactggaaccgcacgcattgagaaaaacgagacaatgagattgactcagtttcggcacaatttgattacaccgttaaggttttcatatggcgaatcatagatgagatctgtgtaccccgtgaccttttcaggatatgacatggtaggatagattccctcaaaaattaagtgtaatttatgctcttacgataattgca

SEQ ID NO: 57493 - DNA, 771 bp, Oryza sativa
taaaagggataaagtctagggaacggaagagaaccaattcaagaaacggctgagagaatcgagcgaatcgggcggaggaaacggcagcgtctcggcagctgcacgggctctatctggagctggaagacgacactgtagctggagggaaaaagtatagactttcagctgggcttcatattccaaggcctgattaaagagggaagcaaatgcccggtttacgggagcttctcccagctgcagcttttcccaaaagctgcttctgttagaagctgcctcaaactgtccatagcttctgagaatctgtagttacagattctgaaaaatgaactaagaagccaaaagctggagaagatgggtttcagagcttttccacattctcagaagctggctaccaaacagctgcttctcagaatctaaagctcccccaaatagccccaaagcagacttcgacagagagaaagaggctgctggatcggctgggctgaaggggagagatgggccagattaagacctgagctttcgaaaggattttaattacttttccaactaaattaatcactgaaatgatatttgaattgttaaaaatacttcaaatactgaaatatgttcaagaaaaatctcgcaactacttggacacttagagtatttaacaaacttaagataagatcatttaatgactaatttaatatttaaataattcctaaaatgttctttgtattattaaaattagtaattgagctctaaaaaatccgagaaaatttcagagagtat

SEQ ID NO: 57494 - DNA, 1851 bp, Oryza sativa
tagtattgccggaatcttgttttgacagttggcgcgccaggtaggggttgcgccatgtttttcgccgactagtgtgatgggattcgtttcgggcatcaccgacttcactttccctcccgggcagacgtgctggttcggcggcccatggacctcatcagccacccgtacatgcatgcaaagaagacatcgtacgacagatcaatccatgattataaatcaagctaataatactatatagattgtgaaagaagttcttctgtatatgtgcagaatgaaggatcccttaaagcaaattgtttttgattggttgcaagctttatagttttatttagttccttcgactgtaactttgtaaatattttttgagttatataaaattacactgctcggcaaagcgacggcgctcttcggcttgacgacggcgacgatgctccggcggtcttcgacggcaacgaaggagcggacaaggacggcgacgacttggcgatcacgacggcggtcttcccgagcgacggcgacggctgaaacgacggcggcgcacggctggagcggcggcggcgacggcgaagctagggcacacggcgctagagcgattccgacgacgagaggcgaaggcgaaggtggcgacgggtagaggagacaccgggggtccttttaaaggggctcggaggcggcggcaaaggcccacggcgacggcaacggcgaaggaaagctcgggcttgaaggaaagaggccgatccgaatcgaactcgattccacgaacttccaaaacgaattagccgatgattccaaaggagaaaaggtagaggagatcccggagattgtttcccctctaacaattcggccggagaaggaaaggaacggccggatttggaaaggaaacggcggcggcgcgaaactagggtttcggcggcggcggccgaaggtagacgacgactgacaggtgggccccacctgtcagcgagcgagggcgcgcgcgcgggcggcggactgggccggctgggccgaggagagagaagagaggttttgggccgactttcggcccaaagccaaaagaagactttttaaaacctttttcaatttaaattatttcttaaatgcaattccatttattaaaaatactttcttagctcaaataaaccccagaaaaatctaggaattatagaattaagcaaagtatttaacgaaattttatcttgccccattttatattggaatttatttattaaaattaaatcttcttttcaagacttttaaaattatttctaaaaaaattccatttaaacaacaatttatatattttgaattttcagggtgtgacattagtttatttataatcagtataatcttagtagttaaaccttctgggatttgcattgatgctggtataatgtctgattaccaggtcataagtctgctctggctaggccgagaactatgccccggggactcagatgctctacaccgattgcaaggctgtagagtaataagtagtaacttaagcatggggtttaggttatcacttatcattattttgggatatattcaccgggagagtagcaggccgctgatggtgacagcttaatacgtgcgtcttccccacagtttatatttctacgtacaatttccttgggtaggatacacctttgtatcctactttggtttgagggttatgacaggttgtcataagaaactcgtcaaccagggtaactttgcgatgcatcatatcgggagggcatagctgtcacgccctgaagtacccctcccttgctctaaattcataaaataaatcgttcgaagaaattgtttaatttaacctagagagaaaccctaaattaataaatgcaaata

SEQ ID NO: 57495 - DNA, 5305 bp, Oryza sativa
tcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctttgagcagaaaaagctattgcaatgccttatgcaccgaaggcatgtgtgacaaattgcagcaagatcttgagcacctaaatttgggcatcgtggaacacgggtacgttgctgccctagaggcacggcctacgctcgtggatcaagtcagagcagctcaggtaaatgatcctgaaatagctgagctaaaaaagaatatgagggtcggaaaagcccgagagttccatgaagatgagcatggcacaatctggttgggagaaagattgtgtgtgcctgacgacaaagaactgaaggatctcatactcacagaagctcatcaaacccagtattcaattcatcccggcagtactaaaatgtaccaagacctcaaagagaaattctggtgggctagcatgagaagagaaatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcagggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcaaggaagtcaattcacttcaaagttttggcagaaactgcaagaagaattggggactcgtttgaatttcagcacggcttatcatccacaaacagatggtcagaccgagcgagtaaatcaaatcttggaagatatgttgagagcttgtgcacttgactttggtggagcctgggataaaagtctaccgtatgcggaattctcttacaacaacagctatcagtccagtttgcaaatggcaccgtttgaagcattgtacggacgaaagtgccgcacaccacttttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtaccttcgtgtcactccgcttcggggagtacaccgcttccaaaccaaaggcaaattggcaccacgctttgtgggaccatacaggatcttggaacgcagaggtgaagtcgcttaccagcttgagctcccatctaatatggttggaatccacgatgtgtttcatgtatctcaattgaagaagtgtttgagggtacctgaggaacaagctagctcagagcacattgacatccaggaagatctgacttatgtggagatgccgatttgtatcctcgagactagtgagagaaggaccagaaacaaggcgatcaagttttgcaaagttcagtggagccaccactcggaagaagaagccacctgggaaagagaagatgaattgaaggccgctcatccgcacctcttcgccaactcttccgaatctcggggtcgagattccgtttaaggggggtaggtttgtcacgccctgaagtacccctcccttgctctaaattcataaaataaatcgttcgaagaaattgtttaatttaacctagagagaaaccctaaattaataaatgcaaataataatcggaatcggcatgtggaatttttcttgggttctacatgtcaaaatacgctaacaggatttttagtggaattttcagagcattggaaataattttaaccaattaaaataagcaaagtgcaatattaaatcgctgggaaaatcctttttcctttttatccttcctttttccccctcttttcctcctttgggccgccggcccatctctcccgccccctcccgaagtccaggtcgcctccccctcactccctcgggcgctgacaggtggggcccacctgtcagcaccttccccaacctccagccggagggacggcctccctcctccctaccgccccgcgctccctgccgccccgggccacgtcgcccactcccccgcgcgcccgcactccccgcgcccacgccccactcccgctcaccccgcgcccgcgagatggccgggattcaaatttgaatcccgcctctctctctctcctcctccacctcctccactactccggcgaaattgcgccattcccggccacgactcgccgcctcccctcctatttaagcacgcccgcaccttcctctctctttttcctttctcggccgagccctcccgagccctccatcactcccgcaccgctacacccgccgccgccgccttttccactcctccggtcgccgctcgccgccgctggagccgccgccgagccaatctgccgccgccattagcttcgccgccgccaaagctaccccggccgccgcatccccatccaatcccgccgtcgggacccgcttctccccgcgcgccggtgagtaccaccatggccgccgccttcgaccggcgaatccgctcgccgtagaccacccctctccctctaatcctttccattttgttccctaggaggccccggagatcgttcgcccgtcgccgtcatcctcccgtcgctcgtcgtcgtcgttcgccgtcgtctccactcgcgccggccaacctcggtgaaaaactccccctcctccctctttccctctctcccgtgtgcgtcgccgtcctccgcgcgcgcaccgtcgtcttcggccgccgacgccgcttttcgcgccgtctgccgtcgccgtccgcgccgccggttgccgtcgccggtgaccgcgcgtgccgccgtcgctcgccatgcttggcctgccggctttgaagccaagccgagccaccagcggcgcccctcccgccttgtgccactgccagtggggcccacgtgccggcgcccctccctctctctcttgagccgccgctcggtggggcccgcttgccagccgcccctctctctccttgagtcactgacccgcgggtcccgcatgtcggcgccgccccaccccttgctgacgtcagccctggggcaatattgcgcaataaatcgattaagggtttttcttttatagtaaaaacacagagaatcttctaaaaatcataactaattcatccgagctccgattaagtccattcaagtctcagtaaattcataaaaatgtgtagaatccattaaaaatggttttgcttcctgtttcagtagtcttatagcatgttttgcttgtgtgctttgtttgtcgcgtagatttcggccgtttcgtcgattcgtggtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagctagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacttctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaatagctgagttccggcttagctatgctgcattgttaaagggaatatactacatagagtatactagctagaatagactaggatgttgtatactagaagtacatgagtgagacatttctattctatttccacttattcatatttaggataaggaggagttagcggaatccttggctgtgtgtcactctacccttaagcttaacttacccctgcatagaccttaatgtatacaggtaatacataaactattagcatagtactcttttatcatatatttccttgggataaaataaatacgatatcttcgaatactcccgggtgaaatgctacaatggtatatccgtgcgtttgcggatcatatttgtaaccataatataccaggattatttctaatgctattgctgggaattatatttccagtagtgttactaagaaataccaaca

SEQ ID NO: 57496 - DNA, 835 bp, Oryza sativa
gggataactacgtggcgacccgtctagatgcaacggaggttacttgggcagagttttgtcaaagtttcaggaaggcacagattcctgaagggattatggcacaacagaagagagagttccgtgcgctccaacaaggaaccatgtcagttacagagtacttgcatgagttcaaccgccttgcacgctatgctcctgaggacgtgcgcaccgatgctgagaagcaggagaagtttttatttgggctcgacgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgactacaacggtggcaggcacaacaacagtaagcagcacaaccacaactcgactccacccccactaatggcaccagctcagtcagatccgccagctgtgtcagttcagtcagaacaacccaagaagggggctgtaggaaagccaggaccctgcttcaactgtggcaagcacggcccctttgctggcaagtgtccgaagctgaatcgcactggacccaggttcatccaggcccgcgccaatcatgtgtctgcagaggaagcacaggcagcaccagaggtcgtgtagggcacgtttccagtgaactcatatccagcaacagttctctttgattcaggtgcctcgcattcttt

SEQ ID NO: 57497 - DNA, 3412 bp, Oryza sativa
acgaacaagctcgggcctggaggtactcttgcgggcggtgatcttcaggctgcggcagacgcggcggcgcttggggcgacagacctctccctaggcgatcttgagctcacatgtcacgcccggaatttctatccaaaattccaaacgcttacatgtgtgtgaaccctcgtccaggaatcagccgaggcacacaataacaaattgataatagagtacaattattactctaattaataagtgaataaaatgtcattacagaggtagatagttcctgtcaatcaataaagatctaagcatcggaaagataagataaacggcgcagacgactccactccacaggcagcttgaccagggctacacctaattctccacaccatcagcttcactgtagaactcttcctctaatgaatgattgcaaggtgagtatatgacatactcagcaagtcacgcagcaaatatgcaagtgcacaggataacaaaggatggcataatagggtttcatttgcataaacaacatttaataaacatttcagaatttaattaaacagttgagtaataattaaacaatatcaatctaacgctatacaacataccctgttgtataggcccaacctttctgaacaaccatacccggctgtacagatctatctccaaaccaggaatataccattccaaaccaggagctaaacaaattattaccagttatagcatctgttatcatgatgagaggtgtgagactaatcacgaaagacattgttagaccagcccataaccgcgggcacggctattcgaatagttttactctggccagaggtgtaccactgtacccacaagacacagccccacaacatgtcactatgtgcctcaataccaccacggtacctcggaaaggagctgtgacaatacccctcgcacaacacaatccaccacagggcacctttcctggatcataatcacccccttataaacaaggcatggactcccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgagctatcattaagccatcattaaataatagtgaatcataagttatcccaatcgctgcactgcacggtgtctagctttttccccacggcatgcaaccaatccaacgcatccacggggttgttggagctagagaaggtaggtggacggatgcggaggaactcggcgagtttagagtgttgtgggggtggtggtggagcattctgttgtggcggattttggaggtggtggaggaaagcagtcatcatgtaggcctgctgggcgaggatttgggtgagaatggcgttggtgtctggtggtggtggtggaggcggaggaggaggtggaggtgggctgccatggttgttgtggttgctgccctcaggttggttgccatcaccggtattagcacttctcctggtcgtcaccatctaaaaaccccacacagaaccagcaaacagagagagctgacaattaaagctaaccatccacgactaccataattcttgaatttattactgctattaaattggttaattaaagttcaaattgcttaagcaaataaaataaagacaggctccgacacagttatgccacacaccggcataaccatgccccacacgactccaacaagaagacaaacgagaaagaacacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctgaacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctaggtccttcttcagctgcagattctcctgacgcggctccaggatcttcatgttgttctcgaccatcccacggcgcaccatctgatggaagtcgatacaagtcgcgtcgtacgcctccaccatgcgcgccaggtgcatgatggtagcgtcatcctccgagctagcatcccggaaggtggcgaagtcgcgggctcctccgtggcgagggtggtagcggtagggcgagtgctgcaactcgtccgggtagcgctggtgaagagtgccgatggcgaggagagcggcgttctggcaagcggcggagaaagaatctccacccgcggtgactgccaacgaagtcctctcgggtgagctagtgaggatcactgcagtaacctcccaagcagcgtggggctctgcatcgtcaccctcctgctccgggagcggcctgccctggtagtccactctatgcggataccccaggacaactcacatgccccacagctccaagacgaaaccagtcaggtccagaccacgacggctgatgctgccggccatctacaaacaaaaacaaaaagaaaagcaacatttaaaagtcagattttggcgataaatgaagcagcaggacagagagagactagagggttttcacaattaagacaggatttttatttttgaaaatattgctaaggcttgggatctaaggctcgtcctagggtcaagggggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagataatttattacatgggcagcgaaggcccggcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtactcaacaagacacacccacaagtgcagaataaatgcaagggagtacaagggagttataatataaagggttagggtttgcagtaaacagcgttaaaagacacttagttgctcaaagctattttgtaatcacgattctagaattatacaatattatttatcaaggccgtgaacccacacgaacctgccttaacccaaggcctacgatgattcagaccgaaccggcaa

SEQ ID NO: 57498 - DNA, 9637 bp, Oryza sativa
cctttttaactttgtttatttcttcttaattattatttgtgctctgaaaattccactaaaatttatttacgcattttaggcttttaggaaatatacaaaaatcctccaagccttatttgacttttaactttgcacattttaattgtggaggctttcacacggattttaattattctcggcataatttagaggatgtattttagggtcgttttgggacgcgacatcggccatcatacatcggcaaaacacaaccaattaagataataaaaactgctaagggcaatataacttatatcggccatctctaggcggtgtcaacacatcagctaacatgtatcggcagcatccagccgatcatgaattgacccaaacacttgggtaatatttcttcagatattttccattaagcgctcgttcataaatgtcgcgtcccaaaacgactctaaaatacatcctcgaaattgtgcaaagaataattaaaattcatgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggtttataaaaagaaaaaccctaaaagaagtcttctttcccccccttcccttcttgggccggctcggcccaacttcctccctccctctcctctcccccgcggcccatcggccttcccccgcgcgcgcgccgctgatgggcgggcccgcccgccaccctcgctgacgggtggggcccacctgtcatcccctacctcgcgccgcgcccgccgcccgcccgtgccctagcgccgccgccaccgccgaatccgccgcatcccgccgtccccgcgcgccataaagagggggaaatcactccccgtgattccctccctcttttcccccacttttccctctctctctacctcggattcgtccggatttgctcccgcaatcctcgccggcgccatcaatggcggccggatcttccgcggccgattccccctcgtccggccgctctctccccctcccaaccctatataaaccctccccgtgcctccctccaccgtttccgccactcgccgctctttctccccgccggaatcgagctcgcgccgtcgctctctctctccgccgtcgccgccgagctccggtccgccgccgttgtcgccccggaccacccctcccctcggcgccgcctccttcggcttcgccgcatcctcgccgacctcgtccacccctccgtttcgcacgccgaccaccggagcaccgtcgaccccgtccacccgagccgcgccgccgccttcctccgctccggtcgccgttcccgtcgtcgccgttcccgtcgtcgccgtcgatccagggtgagccgtggaccgcctattcgtttcccccttccctcccctctctcggccgccgctccgccgtacctatggccgccgccggcgaccataggggcgcgggcgcgccgcctcccgtcggccgtgccggcaaggccgccatcgggcgcgccccgcggctgccaggtggggcccggccgtcagccgcccgcgcccacgggtgcggctgacgcgtgggacccacggcgccggccggcgtcagccgcgtgggcccggtccaccgtggaccgtgaggctgacgcgtgggccccactcccgtggacccggtccgcgcgccctctccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttcttcttgttatatggagtttattagagtaaaagccttttcttttccgttggtcgtgtagatgctgcagcttcggaagatctgctcttcgtggaggttgaagccgatgtttgggaaagcgagcaaggcaagtcacatcatctttgaacatattgaatcccagtttataaaattatgttgctttaaattattgcattatcgctttatttaaattcccgcgttatcactgttttatctagccatgcctatttacctttgttatgaccttattattgttattgttattatttccttgttcaccctagaataaacaaaaccccactagtggacactctactcatggtaccactagtatgattttaggtagatgcttcgctatttaattagttaacattaggtggttttacaactctagactttgggatattcatatcacctggacactttggaattgttggattattgtgaaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcctggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttgcacgtgaggaagattgtgtcttgtgggtaaagatgtacacctctgatcagagtataatctattcgaatagccgcgccctcggttatgggcaagccgagcaatgtacccaagttagtgtttcaattcttaaaacctgcttaacaactaaaaggtggaatggttggcctgggttggcttgggacgagctgggacccagggtcgggttgccagttcggtcttaatcatcataggccttgggttaaggcaggttcgtgtgggttcacggccttgataaataatattgtatagttctaggatcgcgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttatcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgttacaagttggtatcagagccacccttgaccctaggacgagccgtagatcccaagccttagcaatattttcaaaaataaaaatcttttgttatttgtgaaaactgtctagtctctctctgtcttgctgcttcatttatcgccaaaatctgacctttaaaatgttgtttttctttttgtttttgtttgtagatggccggcagcgtcacccgtcgtggtttggacatgactggcttcgtcttggagctgcggggcatatgcgtggtcttggggtacccacatggagtggactaccaggccaggccgcttccggagcaggagggtgacgacgcggagccccacgctggttgggaggtcactgcagtgatcctctctggctatcccgagcggacttcgctggcagtcaccgcgggtggggattccttccccgccgcttgccagaacgacgctctcctcgccatcgtcactcttcaccagcgctacccggacgagttgcagcactcgccctaccgctaccaccctcgtcgcggaggagcccgcgactacgccaccttccgagatgctagctcggaggatgacgctaccatcgtgcacctggcgcgcatggtggaggcgtacgacgcggctcgtatcgacttccatcagatggtgcatcgcgggatggtcgagaacaacatgaagatcctggagctgcgtcaggagaacctgcagctcaagaaggacctagacgtggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccagaagggggaagcctccggcgttggtagcacggaggatgcgctgttgctcaccttccgtcctggcccgtcgcagcggtagacgagcagttagtaggcttgcgcgtgtgttctttctcgtttgtcttcttgttgagtcgtgtggggcatggttatgccggtgtgtggtataactgtgtcggagcctgtcttattttatttgcctaagcaacttgaactttaatgaacccatttaatagcagtaataaattcaagaattatagtagtcgtgggtggttagttttaattgttagctctttctctgcttgctggttctgtgtggggggttttcagatggtgacgaccaggagaaatgctgctaccggtgatggcaaccaacctgaaggcagcaaccacaaccaccagggcaacccacctccacctcctcctccacctccaccaccaccaccagataccaatgccattctcacccaaatcctcgcccagcaggccaacatgatgactgctttcctccaccacctccaaaatccaccacaacataatgctccaccaccacccccacaacactctaaactcgccgagttcctccgcatccgtccacccaccttctctagctccaacaaccccgtggatgcgttggattggttgcatgccgtggggaaaaagctagacacggtgcagtgcagcgatgaggagaaagtcatcttcgccgcccaccagctgcaggggcccgcatctctatggtgggaccatttccaggctacgcagccagaggggcaacctattacttgggcccgcttcaccgccgctttccggagaacccatgtgcccgccggagtcatggcccttaagaaaagggaattccgagagttgaagcaaggcaaccgcttcgtgatggagtatttgcatgagttcaacaatctggcccgttacgccccggaggatgtgcgggaagatgaggagaagcaagagaagttcttggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatcccgggggatcctcttcgcagcagcaacaacagcagcagcaaccccgctctgcgccccgacctcaattcgtggtgcgcgtcccacagccgcagcagcagcagaatcagcaagggactcgtgcgccccgtcctcctacgccaacggtgcagcctggtcaaggccgcagggacgctcaaggtcagcagcgtctgtgcttcaactgcttcgagcccgggcactttgtggataaatgcccgaagccaaggcgccagcaaggccaagcgcctccccgctccaacaacggtgggaaggatgtcattcggggtcgtgtgaatcacgtgacggccaaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgagacgcaccgtcactctgtaccgagggccggaacaaccggttgttttctttgcacccccaacctctgtcagtagttcagaactgcattagataggactgtcagaaatccccatcgtcagggagttcggagatgtgtttccggaagaactacccggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtacatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgcgaagaagatattccgaagaccgcattcaccacgcgatacgggctgtatgaattcacggtgatgtcattcggtctaaccaatgcacctgccttcttcatgaacttaatgaacaaagtgttcatggaatacttggataagtttgttgtggttttcattgatgacattctgatatactcacaatcagaggaagaccatcagcaccatctccgtctggtgttgggaaagttgcgggaacatcaattgtatgccaagcttagcaagtgtgagttctggttgtccgaagttaaattcttaggacacgtgatatctgctaaaggagttgctgtggaccccgaaacagtgaccgccgtcaccgattggaagcaacccaagacagttactcaagtccgcagtttcttaggtttggcaggatactaccggagattcatcgagaacttctccaaaatcgctcgacccatgacacagttgttgaagaaagaagagaaatttgtgtggagcccgcaaggcgagaaggcgtttcaaactctcaaggaaaagctggtttcctcgccggtgttaatcttgctggatactcgcaaggatttcatagtgtattgtgacgcttcgcgccaaggattagggtgcgtgctcatgcaggacggtcacgtggtagcctatgcctcacgtcagctatggcctcatgaaggcaactaccctacccatgacttggagttagccgcggtggttcatgctctaaaaatctggcggcactatctcattgggaatcgctgtgaaatatataccgatcataagagtttgaaatacatcttcacccagtcggatctgaatcttcggcaaaggagatggttagaactcatcaaggattatgatgtgggaattcactatcatcctggtaaggccaacgtggttgccgacgctctaagtcgaaagagccattgcaacactcttggcgtccgtggcattccacccgaacttaatcaacagatggaagccctaaacctaagcatcgttagccatggattcttggctattctggaagccaagcctaccttgctcgatcaaatccgcgatgctcagaagaatgatccagatatgcatgggatcctcaagaatatgaaacagggtaaagccgctggtttcacagaagatgaacatggaaccctatggaacggaaatcgtgtatgcgttctggacgacaaggaacttaaacagctaatactttaggaagctcacgaaagtccttattccatccaccctggcagtacgaagatgtacttagacttgaaagagaaatactggtgggttagtatgaagcgggaaattgcagagttcgtggccctttgtgatgtgtgccagcgtgttaaggcagagcaccaacgaccggccggacttctccaacctctacaagtaccagaatggaaatgggatgaaattaggatggatttcatcaccggacttccaaaaacccaaggcgggtatgattctatatgggtagtcatggatcgactaaccaaggtagctcgatttattcctgtgaagaccacctatgaagggaacaaactagccgaactctacttcgctaggatcgtgagtctccatggcgttcctaagaaaattgtatctgataggggaagccagttcacctctcatttctggacgaagctccaagaagagttgggtacccgattaaatttcagcaccgcgtatcacccgcaaaccgatggacagaccgagcgtctaaatcagatcctagaagatatgctccgtgcctgtgttctagatttagggaagacctgggataagagtctccccattgccgagttctcctacaataacagctaccaagccagcatacaaatggcaccttatgaagcgttgtatggccgcaaatgccgaacaccactattgtgggaccaagtcagggaaagccaagtgttcgggactgatatcctgagagaagctgaagctaaagtcagaaccattcgggataatctaaaggtggcatagtcccggcagaaaagttatggagacaaccgacgccgtaacctagaattcgcagtggacgattttgtgtaccttcgggtcacgccattgcggggcgtacacaggtttcagacgaaagggaagctcgcacctcggttcgtgggtcctttccgtatcgttgctcgacgtggagaagtcgcttaccagttggagctgcccgcatccttgggcaacgtgcatgatgtgttccatgtgtcgcaactcaagaaatgacttcgagtgccatccgagcaggccgattcagagcaaattgaagttcacgaagacttgacctacgtggagaggccagtgaaaatcctggacaccatggagcgccggaccaggaaccgggtaatccgtttttgcaaggtccaatggagcaaccacgctaaggaagaagctacttgggaatgtgaagacgagctgaaggcagcccatcccgatctcttcgccagttcttccaaatctcggtgtcgagattccgtttaagggggtaggtttgtcacgtcccaaaacgaccctaaaatataacctttaaattatgcctagaataattaaaatccgtgtgaaagcctccaaaaattaaaatgtgcaaagtaaaagttaaacaaggcttagaggatttttgtatatttcctaaaatgtgtaaataaattttagtggaattttcagagcacaaataataattaagaagaaataaacaaaattaaaatgattttataaaaagaaaaaccttaaaattttccccctctccccctcttgggccggctcggcccat

SEQ ID NO: 57499 - DNA, 11511 bp, Oryza sativa
gtcgccgccgagctccggtccgccgctgtcgtcgccccggaccgcctcccacctcagcgccgcctccttcgacttcgccgtatcctcgccgacctcgtccacctctccgtttcggtcgccgaccgccagagcgccgtcgtccccgtcgacccgagccgcgccaccgcctccctccgctccggccgcctcccccgtcgccgccgtcgccccggggtgagccgtggaccgtcgcctcctttcccccttcccttccctctctcggccgccgctccgccgcgccggtggtcgccggcggcgaccatcggggcgtgggcgcgccgcctcccgccgaccgcgccagcatggccgccctcgggcatgccaagtggctgccgcgtggggcccggccgtcagccacccgcgccctcgggtgcgactgacatgtggggcccacggcgccggccggtgtgagcccgggtgcacctggtccaccgtggaccgtgaggctgccgcgtgggacccactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcagaattggaccgttcaagtctctaatttttccttaagaagtcaagtcatatcatccttgaacatattgaatcccactttataaaattattttgatttaaattattgcattatcgctttatttaaattcccgcgttatcactgttttattcagccatgcctatttacctttgttatgaccttattattattgctattgttattattattactttgttcaccctagaataacaaaaccccaactagtggatactctattcatggtaccactagtatgaatttaggtagatgcttcgctggattaaataggcaacattaggtggttttacaactttagactttgggaataatcatatcacctggacactatggaatggttggattattgtggaattggattcacacctccccctctattcaaaaccctcaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgttatggcacagggccggtgtcctgctgctaggggctcagtcctgcctacctgtcccagaggtcctggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaatccttaaaacctgcttaacaattaaaatgtggaatggttggcctgggttggcttgggacgagctgggacccagggtcgggttgccagtttggtctgaatcatcgtaggccttgggttaaggcaggttcgtgtgggttcacggccttgattaataatcttgtatagctctaggatcatatttacaatatagctttgagcaactaagtgtcttttagtgctgtttactacaaaccctaaccccttatatgataacccccttgtactcccttacatttattctgcacttgtgggtgtgtcttgttgagtacggtggttgtactcagtcttgctcaatttttcccaaacccagaagaggagtttctggaagatgaaggctttggtgtctagctcgtgcctgccgtcaagcgcctgtggtcgtcgccctagtctttcgctgtttcccgtttgtctttgtgtgctgggccttcgccgcccatgtaataaattaattatttacgcttccgcttgttaaactctgaattgtatcaacttttagtgtaccttgcctcctgggaaaaggaataatgcacccacgtaaggaacgcccgttgggttatttccggtcgtgacaggcggtgacgaagcgagccggccgcgtggcggccgtgcggcagacggtggcgatggccatgcggcagcggcggagcgaggccgccgcgcggtcaggcagcggcggcggagcgaggccgcctgtcgggcggcggacgggcggcggcggccggtggggccgcacccgatggcggctggcaggtggccggcggccggcggcaacggcatcccatttgcacatttgtgtggataattttgtgattcattgcacgtttgtatggatctgtgatgtatttgatatgtttgtaatttttgtaggatttgtgatatatttgaattgtatgtataagtaactttaagatttgggatgttactttgatttggggatttgggtttgatttgggatatatcccactcaattcgggagaaaataaaaaagaaaaaaaaagaaaaggggaccatcttactgccgcttccctcaccaaccgggactaaagttccctttctttagtcccggttgataacaccaaccggacgtgaacgaaaaagaaagagattagatagatagattacgcggttgaaccaggactaaagatagcgatttttagtcccggattggtagttccggttttaaaaccgggactaaggggggttacaaaccgggactaaaaagcacttctccaccagtgtactacacatgttgtgaaccatgataatctcaggtctaaggattcaacagcaacactaaatgagatcactgatgacacaatacatatggctcttgcagtgtctcatgttgggtctatccaacaacatgttcaccaacatgtgtccatattattaatttggtatctctataccatgatccatgagacatgatcatcaattaatatatatgctgatcatataaacatatttgttccacatatgatatttgatcagaatcctttagaaatagtaacaaacaacataaagagtcccatgaaagaatcacatatagattaaccaataatgagttatctatttccaggaataatgtcggataaatatgtaaacatagtatgtgatacaatcatctttatgattgcctctaggacatatcactaacataaacccgtagcaagcagcgagcggcagcctccacgcgctactccgcgagcgctgcgaagctccggccgacgcggcagtccgcctcagtgccgagccgcggctccgccgcctcctccggcaatgcgtggagcgtcgcgaggctccatcacctccgaggccacgcgcgactccgccggtcgcgtgcggctccgagtctccgacaccctccactggctgcccgcgaccccgccgagtcgacgtcgcgaccgcgtgcggtccgtcgcctccgcggccacgcgcagctccgcacctgacgcacggctcggactcctccgccggctaacgtatagcgatgccgcgtgcgcatccgccgcctccaccggccacgagcggctcgagccgcggccactttgcgcttccgccggccgtatgcggcttcgtcgcgtcagcggccccgcgcggccggcttcgccgcctccgccggccgcgtgcgccgccggtcgcgcgtggcttcgccgcctccggtcaccggcgccggcctccgttggctccgccacgccggccttcgcaccgtaggcaatgccgcacccgccttggccaaggccgcctccgcaggagggccgtgtgcggttgcctggtctcatgacggccattgctgcgccacacatcagctgcacgaagtgggctcactcgtgcgcactcggcgccagcaggccctgagcaaagggaaataggcggcaggtatgcatgcaaatgcatggttgcatgcatggtcctgttcacgtatagattagaaaagaaaacaaacaaaaaaaagaaaggagaaaaggagggcgtacatatgggtccgcggcatgaccaccctcgtgggacgtagattctaatcactcgagtggatgtccactcatttagtgtatgttaactaaatgatcatgaatttttttttaaaaaaattacaagatagattaatatataatatatcactacataaacatgtaacttaaaattcaacttttataagttgtaaaaaaagtaacaaatcaaacttttgatttgttatttttgttacaacttgtagaagttgaatttaaatttgcatgtttgtggggtgatatattgtatatgaatctatcttgtcaaattttttaaattttttttatacccatttagttgacaagcaacaaataggtggatgtccacctaggtgattaaaagtgtttccccaccctcgtgcgatccacgccgcagcatgtagccgcatgcggcttcgcagctccgcctccgaggccccatgcgcctcgccaccaccgcggacaggcgaggatccgccggccacgtgcagccgcgagtggttccgcctgccgtatgcggcttcgtcaccacctctgcggcgaccgcggtttgccgcccccgcacggccccgcttgcttccgccgatcgcgccagccggctccttccgctcggtgtgcgtgcggccccgccgcctccacagcctggcgcgcagctgcgcccttctcgaatggtcgcgcatgcgaatgcatggcactgttcacgtgattctctctctctctctccatatatatatatatatatatatatatatatatatatatatatatatatatatatatatatatatatatatatatatatatatatagtaaattataaagagtgctccactcgcagcaaggtccagggcggcgctgccacggccccgtgcggttccgccgagctccgccggacaagcacggccttgtacggccccgccgcggggccgcgtcatgtgagacctcccccctgcggcctcgccgacgcggcggttgggccgaaggccacgcatcccgagccttccggcagacctgagcatgggcacacgccatgcacggcctggtgatggcgctgtcccagccactctgcgcagggctcggcacagcgaccgccgacacggccaagggtcagcactaaagttgcatttatctccctagtggattttggtgattaatgataaataaggttaagggactaatgtgtttattgagatattcaggtaattagtccctcccaaggtgaacttaggacatcaaaagatgcttggagacccctacaacattcattcaaagcggatttgaagctccaaggtcaataggatagtttaatttttgaaatcgagttttaggaaaaaccgtactattaagaggggttccaagtgttgttctgagatataaaaagtgctcttagtgggttccttgtggtagaatatttttgggagccatttttgcaaatgggtccagaccggatagagaaggctggccggaagttccggtccctggacccggaacttccgaaccttgcgacatgtgaaattttcctaagtgttgtctggaagttccgaatgtcaggaacttccggacctcttccagttcaaaaatgtgagtaacggctagatgtcgtcacctagccgttatatatatccagatcgcaccttttggccattttcacttcagttctttcatgccctaggttgttctagactctcccaagatccctttgcttcctccactcaaatctagagccattcttgtgagattgagagaatagatgagagtgtaggagtgatttggagaaggtttgaagactaggtgtgtttgagcacttggatatcttgtgggctgttacttgggcttattactcttggagatcttctcctaaacggttaggtgccacctgagagcttccaaagatcatgtggatgtctcgagaaagtttgtgaaggttttccttacctccgcaaggaaacgaggtaagtgagtaaagattcttgtgctgagatttcagaggttctcctaggtagagcaacttgcacttgtggtcttttctagaaggatttgtgagttagatcttggtggtcactcaaattctagaaaatgacctagaaatgttgagttgaaggcctcggacttcttcgaggttctttgcacgggtgaggcaagaggttaatcgagacccagctctttggagcacctcaacggagagtaggattgcaagattcgaacttcgggaaaaaatcgcctttgtcttctctgtgatgattctatgcatgttgctgtgattgtgtatttgctctttcttcctgtagtttaattcgtgcaaattagtttaagtctctgctagatcttcaattttttctgttgcccggaagttccggtggttagaacaccggaagttccggacagtctgagcagatcggaagttccggtgttccacacccggaggttccgaacctgctgaattttaccgctgtgatttgtttgtgaatttcaggaaaacctatttaccccccccccctctaggctacatctttgcgcgttcaagcaccacctacgcgctcaagatcggctcgcaccaccgctgttgccctgcctcgggcaatagtaggtacaatatcatgcaattacatttcaaatcacatgtgagacctccacgtccaagagactgatgaagcaatctccgcggcggagtcagtgttgagaccgtcctagctccggccggatggagtagttcaccatgactcttgaaaacaaaaggaaaaaaaggtcatgatgagattcacgtggcctctggtccgcgaaccaatttccttggccaagtcatgtgagacctccgcgtccaagagacctgtgaagcaatctccgtgccggagtcagcgttgagaccatcttggctccagccggacggagtagttctccacgactcttcaaaacaaaaagaaaaaaaggttatgatgagattcacgcagcctttgccccgcgaagcaatttccttggctaagtcatgcgagacctccgcgtccaagagaccagtgaagcaatctccgtggcagagttagcgtcgagaccgtctaggctctggccggacggagtagttctccgcaactcttcaaagcaaaaggaaaaaaggtcatgatgagattcacgcagcctttgcccgcgaagcaatttccttggccaagtcatgcgagacctccgcgtccaagagaccggtgaagcaatctccatggcggagttagtgttgagaccatcctggctccggccggacggagtagttctctgcgactcttcaaaacaaaaaggaaaaatgtcatgatgagattcatacggtctccggtctgcgaagcaattttcttggccaagtaatgtgagacctccgcgtccaagagacccagtgaagtaccctccgtggcgaagtcagcgtcgagaccgtcctggttccggccggacggagtagttctccgcgactttaaaaaagataggttagcaattgagatatatatatatatatatatatatatatatatatatatatatattgcagtcttaagctgtgtaggtttgcaattctaagcctcggctaaggctccgcaagttgctccaaattccgagcctctctacggtaggctctgcgttcggagcccgtggtaggctgaattcggagccactcaaaaaaaaaaaaaactacgtacgctcatgcacatcaacccgtgcgttcaacttcggctggcctccggcgcggggcatgcctccacatcgagctccggcttcgaccttgtgaccccgctgatgcgcgataggccgtggctccttgccggctccacccaacggcgccgggagctagcgccgcgccgcgcttcggcctcgcgtggtgggccttgaggcgccgacaatgctccgcgtggactcggcctcgtcgcgccgccgctgttccatgcttcggccatggcgaaacagcgtcaggccccacgacgccgcttccgtgtcgtgcttagactgcttcgcggaggcttcgtccttgtgcgccgccgctgaacaacggcgcggctactagcgccctcaggccgtcagaagcacaagaaaaagaagaaagaaacagagaggtggtgcgcggcacagcatgcatcgcacatgcgtgtgcagccatcacgatcgtgtgctgtcctgcagtgctagctagaatagctaatacgtactgccagcatggtcaggatggaacccacaaccacgtcaaacttgacgaccacgcgccatgcaacgcgcgcgccggggtactccgcctcctgctctgccagcacactcgggaaccgccgcctccgctagccccgcgtggctcggaacgctccggagctgccgctagcgcgccaagcttcggccgctggtcaccgcgcccggcgcggcaagggaactccgtgcatctgtcgccgcctcggccagccggcatcgtcgcctccacgagcgccgcggggctccggccgtcgcggctccgtcgcccacgagcgcctccgctgagtcgacgtcgcaaccgcgcaaggctccgtcgcctccgcggccacgggcggctctgtcgcttccgccgttcgcgtagggctccgccgactctgtcgcctccaccggttgcgcggggctccgccgcccgcacatagctcggcgcggccccgccggcgcacgcgcctccaccgctcgttcgtggctccgcacggtcccacgccggcgcacgcggctccgtcgcttccgccggtcgcgcagggctccgccacctccatggccccgcgcggctgcgtcgcctccgccgccagtgctcccgcacctatctccgacgcacgcacctacgcgtagccccccgcgaagccatcctttgtgaggcggcggcaggcaacatgcagttgcatggtactgttcacgtagaagtaaaaagaaagtcgggactgcctatacatcatggcaccatggtatctaggtgtatgcatgcaatttaaatagttgtataaaaattttataaaatttggtaagatagatcatgataatataaaacactatacaaacatgcaagtctaaattcgattgatatatgaagaaacaaaaataataaattttatttgcactttacgagtactattcactgtctgattttattatttttgtttctctaatggtagatcaaatttagtcctgcatatttgtgtatagacttgtatcatcacaaaggatgttactacattttttcaatttttttataactatttgagtcacatacaaataatgagtgccatggcacctaggtgtagaaaaaccttgtctgatatattataggacaagtgacagattttttagcctcatatcatgcaaaggaatagaaaaagaagcctccacgttcgctctcatggcctagaaattctcacattaatcggagaaaaagaaaaagaagagtccatatagaaatacaatttagaaattgttgaaattcggaattgaaaaataaggaatattagaagaggagactagagtccatatagaaatacaattaggaaataactgaatttcagaattaaaaataaggaatattagaagtagagtatatagttcatatagaaatacaattaggaaataatagaaattcggatttaaaagtaagaaatattagaagtagagtatagagtccatatagaaatacaattaagaaaaaatagaaattcggaattaaaaaataaggaatattagaagttgttaacaaccaaatttggtaacattagcagcggagagaagattagatcgaagcaaagtcggaagcggagatcgagtttgaaaacagggtaggaatcggctgaagtccagatcggctacgacaagatcggctgagtctgagtcgagctaaataagccgatatagccgattccgacaatacgacttgtgcgcgacatcgggttcaagttaatgtacttcaagatgattgccacacatggatagagtcctggaaaggcaattgtatctattaattagaatattttatgtgaattccttatagataagtgtgggcaaaagtctgccgcaaagacttgtggtatcttagagtttgttagagataatggttgtgtccggtatgggcatatcttgtaatcctcgggtataaatagaccccgagccctatgtaattttgaacacacacattcaacataatttcggcgcatcgccaccctttttgctttagttttgtttcgacgagttcttgctttcgggttgagctgcatcgatttcgatcttcaacaagaggtaaaattcgtcgtgatggattgcgttcttaggattagtgcttccatcttcatgacactctaatcttgtttatttaattcatcaaattatcatatatcttacataatctctagcaatatcgccatctagactactatccgccaatatctgtatgcagaagacagccgattaggttagatcttgacgttgatctagattatataagatatctatcattctatgaaatttctagtggcttgattgtctagatattgttcttctttttatacttaatgttgcatcagttgagtttgatctgttaagtcgtgcttagaatatcgatctctagcctgccttctagttgccgattagaatagtatcggagtttcagccgatcgtatctgatttaacttcatttgttctatatgccttattgatatgttaaatctgccctttatgttaagatattgccgtatctaagtatgttaggcttttgctcaatatattatacttgctttaatatcttgatatagagtagtatcggagtattagccgatacatgctagatctatctgatcggctatgctataaacatatatagtcttgttattgacatatatttcgatctaagtgatttatactgtctcggcatgatgaccgatctatcccaatcacttgatttaagtagacatcgatataaggagtatatattgttaatatctacagccgatcgagtagatttagtccttttttacttattcatgactgccgatcgacgcacagatgacatcggctcaaagataaatgatatgtcatcggcatctagccgatcggctatcgtttataaatttaactacggtttctttgtttctatttcttgttgattacaggatcaaatcaactggcacactaatacatccgaaggcgaattttggacctgcactggagttaagcagatctcccaagccacgtgttttctgtcaacacgcttttggcacacccggtgggacctgattagaagtcagacgtcagtccctcctcatggccgagaaacagccaccgccaccatcaagcccaggttccgttaaaggcaaggcgccgaagccaggattgaccgacatcattgatgacaacgtcatg

SEQ ID NO: 57500 - DNA, 6868 bp, Oryza sativa
ttagatctgtgcagccgggtatggttgttcaggatgggtgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagcttcgctagaccgtaattccgctgcagttttcttttcttttgtaagtatgtaacgctattattgatgattcagtatattaaattgtcagtttgtgtacctcggctgattcctggacgagggttctatgcacaaattagttcggaaattactagtgaatttccgggcgtgacaagttggtatcagagccatctcgactgtaggataagccaaatggtcaaaccttaaggactaattttccgaaaacataatttgtgaaaatttctcctttcttccttatctagaattctttgcaaattgtttcattgtctactctcctctctcgttcaacttgaagtagttctgaaactagtggttgaaacctgaagacgccaatgaggtctactgatggaggttaagtaaagtggatcgaggaagaactgaagtgccaagtggtcaagatggaatgaagtttggatcctgtcttagcacctataccgccaaagtaattttgaagaatagttagtagggtagaacgtttgttgtttgctttgtgtgtaggtatggttgcattcccatcattggagaagttcattgatgagtgtgtgactatactaggttgcttgcttaatcaacttgaacaatataatggtctacacacatcagatcagtgttaacctggttaaggtcttatctttagtgtaacccctctccttctatcctttctaatctgcaacagatggtgaacactcacgctagtggaagtggaaacaataacaatgaagagaacccaacccttgctcaagtgctggctcaacagacccaattgatcaacatgttagtgcaacaaatgcagaaccagcaagggaacagcgggtgtgtttcaaatgttacaagccagggcactttgcaagagagtgtccgaagccgaagcatcagcagccgcaaggtcaggtgaacaacattgttgtcacaggagccaatgcagtgccagttgcgtcttcatgagttgtgtcttcaagtgttacagctcagccaccagtttcaaagcggcattagttttctttaaagctttagaataattatcggagttatggaataagatagactgcagtttacctatgcctttttctttctagccgttccgaatctcgggacgagattctttgtaaggggggtagatttgtcacatcctgatttttgtttcaggatttataaattatttaataaattattaatagaatttatattaaatgttcattaatttacaagtgaagttaaatgtgggaaataaaatttcttaaatataaagcatggatggatttaatttttattaaattctccatggttaattatactctctggaattttctcggatttttcggagctcaattattaatttttatcttacaaagagcagttcagcaattatttaaatattaaattaatcattaaatggtctaattataatttaaatattaaattaatcattaaatggtctaattataatttttttaagtactttgagtgtccaagtattttcaggatttttcttgaaattatttgagcattggaagtatttttaacaattgaaagatcatttaagtgattattttaattggaaaaagtttttaaatccttccctaagtcgttgggccgattttggcccaactctttctctctccgcgcggccgaaccggcccaatcggcccagctgcagccgagccgccctcttctctctctctgtcaaagtctgtttgtggtccctccttcaatcgggcctagcataggaaaccacacagaaaagtctagtttgcctccctgctacagtgtcgtccctaacctccagccggctgcctagctgagcccgagccgcgcgccgcgtcgcctttccgcctccaagtccgctccaatccgaccccgtttcttccggatttttgaggggttttgatcctctcatcctcctctatcttttcccccaagaatcggagcaaatcgttgggtattttatccgaatcaaactcgttttcgagtttatctccaaaaccgagttttgattttcccggatcgatttcttgcgggaggagtccgatctcttcaatccaaggctataaataggaccccctagtcctcctctttcgtttgccccctctcccgtcctctcccgtgacccgtagagccgtcgccaccgtgcaagccgccgccgccgtcgcttcttcgtcgccggccgtcatccgtcgtcgttcgtcgcgttggtgagtaccatcgggttcgtctcgtcgtcctctacgtgtacatgccctccttttccgcagccggccgctctatctccggcgaggtcgccatcttggttcggccatgggtgatgtcagcatgacgtcatcggtttatctttttcccgtagattaaatcttcggaaaatcataactaaataaccatagatccgtttcaggtggttcaagttgctaaatttttctaaaataaagatctacatattaaaattatccataaattgaattaaatttatttaattctttttaaatgggctttaattagatttaatcttgtaaaattcataataaattcatttgaagtcagaatgaggccgttcaagtctcataattcatctaaaattatgatctacatgtttgtttattttttatatactgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttgtttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataagggggtgattatgatccaggaacggtgcactgttttgagttgtgttgtgcaaagggtattgttacgattttcccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattattgatgattaactggtaataatttgcttagctcctggtttggagttagatctgttcagccgggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagcttcgctagaccgtaattccgctgcagttttcttttcttttgtaagtatgtaacgctattattgatgattctgtatattaaattgtcagtttgtgtacctcggctgattcctggacgagggttctatgcacaaattagttcggaaattactagtgaatttccgggcgtgacaccagccaatgaaccctcggttgttaatgagggaacatccacaacctactgggcagattgcgaatcaaccaacccaagatcaagttgctgccatgcttttgccacctccacctattgttgatccagtgcagcagcagccgattcagcagacatcaccaatccagccagttgtacagccgatccaacaacaggtcgtacaaccagctcagcaaacaccatcaaggcagcagcctctgcaactgattcagcagacgccaccaaggcagcggcttcagccgatccaacagactccgatgcgacagcagatcgttcagccgattcaccacccggggtcggcaaatgcatcggcagggtttgcagcacctggtgggcaacctgcgcaacaatttgtaaaccaggtcgtcccagagcatttggttcaccatgcacaaccggatggcacggtggtgtctcagatggttcctaagcacttggtacgcaacatccagtcgaatcttcataactaccaaggaggtaacttgagctatcaatatcagcctccttccccgcaagcccaatatcagccggggggattggctcagccccagttcgcacctcagtttggtcaagtcgagcccatgcagcaacaaccacaaggagcagctcagcaacgaccatgggccgatgtgatcgcctgtcgcgaccgagaaaatttgcattttcccgaacgctagtgtattaatccccgtcccaggaaaagctggggtacaccacacaaacatgatacaaacggcacatctttattatatcgataatatttacattattacaaaggcacttcaagcctgacaatcaaaaataaacagcagcggactagcgggccaacggctccatcttcacaggcgctcaactggggtataagccaggactccacctaagacttcttctccaaagcttctcttactgaagggggggaagatagagcaagaatgagtacaaccacagtactcagcaagtcacaccgggagatgcatgattaatgcaagggaaacaaggggtaataatataggggattaggttttgcagtaaacagcatttaaaagacacttagttgcccatagctattttataaagacgatcctagagctacacagtattattaatcaaggccgtggacccacacgaacctgccttaacccaaggcctacgatgattcagaccaaactggcaacccgacctaggtcccagctcgtcccaagccaacccaggccaacctttccaccttttagttgttaagcaatttttaagaattaaaccactaacttgggtacattgctaggcttgcccatatccgagggcacggctattcgaatagatttactctgatcagaggtgtacatctttacccacaagacacatctttactccgcattccatggccttggaacccgtcgtaaacatgtgacataacccttcacccatcctagccgtaaacaaaagtaccgacccaaccctgcctacggccgatatcccgggacaggcaggccaggattgagcccctagcaacaggatctagaccgggtgcgccacacccataggggtgagaccacccgtgtactagtccagtgccatggcatctcgactaacgggcaccgacccgtgtagtcttcatttgcctagacatctcgattaccgagccgcagctcgtgtagccttcatttgcctcagagatatccatcgtcgcaacgacttcatccatctctatccgtgtctttttgttcaggactagactgagcaccgagttaagccttacccattagacatgtggttatagtgctttgcaacagaggcccgaagaccggtccttatagtggccgaggtgctactagcaaaaccctgcacctcgagcccaacctaaaaccattttggggttttgaatagaggggggaggtgtgtgttcaattccatcacaagccaaccattccacagtgtccaaatgatatgagaattcccaaagtctaaagttataaaaccacctaatgttgcctaattagtcagcgaagcatctacctagattcatactagtggaactgttaatagagtacccactagttggggttttgtttatcctagggtgaacaaggtaataataaacaatagcaatgataaggctataacaaggattaataggaagtgctaaataaaacagtgattacgcgggaatttaaataaagcggtaatgcaataatttaaatcaaaataattttgtaaagtgggattcaatatgctcaagggtgatgtgacttgccttgctcagagagaacagccttccgaaccttcggcgacgaccgcaaaccacgcttcgagaaccttcggaacgacagaagctacgcgaagcacacaagcaaagctacaagcctat

SEQ ID NO: 57501 - DNA, 1149 bp, Oryza sativa
agatgttgcaggacgctagggagaactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactatgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgcccattattattcaaggccccaagcaacctggtaacgacatcgacgtgtacctaagaccactggtcgaagatgttaaacagttgtggaagaaggaaggtgtccccgtgtgggacgaggacaaacaggaggagtttaacctacgagcgctgctgttcgtaaccatcaatgattggcctgcacttagcaacctatccggacagtccaacaaggggtacaaggcttgcactcactgtatggatgaaacagaaagtacgtatcttaagcactgtaggaaggttgtatacatgggtcatgtcgattccttgcagcaaaccacccggtacggaagaaaggcaagcacttcgaacataaggctgaccaccgtacgaagcctaaacat

SEQ ID NO: 57502 - DNA, 3172 bp, Oryza sativa
attgtgtgtttgcatggtgttcctaagaaaatagtatccgatcgaggtagccagtttacttcaaagtgttggaagaagctttaggaagagatgggttctaagttgaatttcagtaccgcttatcatccgcagacagacggacaaactgaaagggtaaatcagattttggaagacatgttgagagcttgtgctttagacttcggtggaagttgggataagaatctgccttacgcggaattctcgtacaacaacagttaccaagctagtcttcaaatggctccttatgaagcactatatggtcggaagtgccgcactccgctgtcgtgggatcagacgggagaacgtcaggtttttgggaccgatattctgagggaagcagaagagaaggtaaagatcattcaagaaagattgtgtatagcccagtctcgtcataagaattatgctgacaatcgccgcagggatttaagttttgaggaaggagatcatgtgtaccttcgtgtcacgcctcttcggggagttcatcgttttcacaccaaaggaaaattggcaccgcattttgtgggacctaataagattgtcagtagaagaggagaggtcgcctatcagttggagttacctcaatccttggcagatgttcataatgtgtttcatatgtcacagttgaaaaggtgtttaagggtacccactgaagaagccaatcttgagtagatagaaatccaagaggatctgacatatgttgagaaaccaatccgtatcctggagacagatgagagaagaaccaggaatcgagttatccgtttttgcaaggtccaatggagtaatcactcagaagaagaagctacttggaaacgagaagatgaattaaagtcagctcataagcatcttttcgccagctcttccgaatctcgagaacgagattctgtttaaggggggtaggtttgtcacaccctaaaaatcctgaatttataaattgttgtttaaatggaattattagaaatgatttaaaaagcctagaagaaaagatctaattttaaataataaattccaatataaaagtgggctagataaaattttattaaatacttctatagttcctagatttttctggaatttatttgggccaaggaaatatttttaataaatggaattgcatttcatgaataatttaaaaaagaaaaaggttttaaaaatcttcttttggctttgggccgaaagtcggcccaattctctccctctctctcctcggcctgcttgcgcccggcccaaccagccagtcgagccgagccgccgctcgcgctcctctctcccgctgacaggtggggcccacctgtcagggccatcgtcttcctcgcgccgcccagccgcgccctaccgcgcaagccgccgccgcccccttccaaaattcgcccgcgtctttatatctcggatcaaatcaatagaggggaaatgatcctcgggatccccctccttccttttctcttttgaatcttcggctaatttcgtttggaaatcgttgaattcgagcttgattcgaattcgttttttcctcctaaccctagatcttccatcgccgttgccggcggccgtgggcctccatcgctgctcctagcccctatataaggacccccgggacctcctcttttcgtcgctacgctcgcctcagctcgccgccgcttgtagcaccgcctccgcgacaacccgtgcgccgctgtcgccgctgcgagtccagccatgcgccgccgccgctccggtcgtcgtcgtcgctcaggaaggctgccgtcaggttcgccaagtcgtcgccgtcctcatcccatcctccgtttccaccgaggaccgccggagcactgccgtcgtcgtcgacccgaacgcctccgccgcttcgacctcgtcgccgtcgccgtccgttgccgtccgccgttgtccaagctctcggtgacttcaacgcgtcgccctctacgcgtaggcgccctccgtttgcgccgccgcgccgtcgttcgccggtgagcgtgagttgccgagccgccgccggtgatgacgtcatcgccgtgtcatctgtagacccgtggtggattagatcgatctcggccgttcgttttgtctagattagatctcggccgttcgttccgtagaccgtccccgtgcacctggtccaccatgaacccgagcccgctgacgcaataaatcatttttccttttcaaaaataattctttattccgtcataattcaattaaaatctaaataattgatttaatccgatttaatctttaaaaactcataactaattcatcttagctcggatttagttggttcaagtctctaaatttttctaaaattgagatctacaggttaaaagtatccacatgtactgttcatgattgtttatgtgctgttttggtgattttgctcttttatgcttcgattccgacgttcctggagagtccgattttgcaggagaagactttgaagagttccaaggccaacaaggcaagtcacacatatcccaaacaatcctttgagcatgttgatcccgtttaaagctattgtttctattcaactactgcatttattttcgaatgtcattgggtgggaataacctattgcctttgttatactttgtcgtttgattaataattggattagctagaacattatatagttttagctaaaagtgcataggatgcttagccatgcttagagacattagctcatataaatgggataacttatgattcactattatttaatgatggcttaatgatagctcacgatggttaatcgtgattggttaattaattaatttgccaactaaaacttgataatggtgggttgtgagcgcatggttttgatggtcgtgctcatgacaattaaggaccggttcacgattttcggttgtgaaacattaaccgtgccaaccacaagccagcgtgggcaacggctttactttttatatagtatggttcattctggagcaccagactgtgaagtggcggagataagcacacgggggtttctggggagtctatgccttgtttataagggggtgattatgatccaggaatagtaaactgctttgaattgtgttatgcagagggtattgtcacaatctctattcgggtacttgttaagtatcgcgacgcatggttgacatgatgttgaggttgtgtcttgtgg

SEQ ID NO: 57503 - DNA, 6830 bp, Oryza sativa
tcttaatgccactagaatttcaccaattcccttatatgcacttaaaattggcttctcccttatatgccactagttcaagtttttccacccttttatgccacttccaccactatagtgttagttgactgttagtcaaaggttagtttttttcataaatgaccaatatgccctctcaactaaaaaatgtgtaaacttcaaaaaaatcataactagtttattttaaatcttttttaagtgaacaaaattttgtcataaccagtgaaaaatgctctttatattaaaaatattgttggaaaactgcatgtttcatgcttacattgaaaatttatttgtgatggtaatggtaatggctaaaattgcatgtgatgcagaaaaaatcaattttcatatgttatatccagtagctatattagtactaaaatacctattattggttgtatactaattctcaagggcaaatgcatctttttacaatcaagttaacggtcaactgacggtggattgacggtaatggcataaaagggaagagaaacttgaaccggcggcataaaagggagaagccaatttaaagtgacatataagggaaccagttaatttagagtggcatataagggattctctctatatacttatatacttagtacactagaaaagcatatactggtaagaaaaaagttaccgccgctcaggaaacggcgagatggatgatggcgccggaagcaagatctatgcatgcatccaaagaaaattaattaaacagaagttcacaatcatatttggaaacgaatgatttggtgcatacctatagagatctaacaagaaaacaaaaagaaaacagatccatcttcttgatgatcgatgacgttgctgtatgattcagcgagcagatcgatcacgccgtcgcctccggcttgccgatgggctgcgctgtggacaccattgccactggatcgtgacgtcggctccggcttgctaatgtgactgcatcgtagatgcagaaacgccgacagatcacaccgtgaatgtacgccgaattgccgccgcggacgccgagtcgcctatcgatctcacggtcaccgccgaattcgtccgtaaatcaaggtctcgccctgggatcgatctgtggtttgatttggcaccaccgtctacgaacgagagtttttaaaagtggttttcacggttgttcggatcgctatatccacgaaaatcaaaacgggtccggtagttagacccagtaccaggtttgatcgggactaggccgctgatgtacggtggatgagagcaggagtacgtacacctgggtgtatatatatatatagaatcggatctctcttttgtactcccaggtgtatgtactatcttttcttaatggatatccattagttcaaaatgaataattagattaaaaaaagaaaacaccattctttttttcaaattatctgcatgcaacggctggtgcgtaggactaggttaaaaaaaattaatggtagctcgttaggagtatatacctttttttctcattataagtatatacttaggctgcttgttgttagaagtatatatacttgttttgcagtattagtatatcctttttttttaagtagtagtagtacataacttcttttttcatttagtaccactatacttaggctgcttgttgttagaagtatatatacttgttttgcagtattagtatatccttttttttaagtagtagtagtacataacttcttttttcatttagtaccactacataccactttttaatttaatgtcagtacatgtatacctttttttccggatatattatgatatcttggaatgggtatatactgattttttcttggatgaagtatatatactgatatcctccctgaatgagtatgtactgatcttcccttggaggaagtatatatactgatctctttttgagtgagtacatacttatctcttctaagagtgagtacatacggatctcctctgagaatgagtatatactgatcttttagattagtagtggtttatatttctttttaattagtaagtggtatatgcctcttcttagtcagtataatttttttttaatcagtatatactacattcctgagaagtttatatacttctgtttgatctgtatttactgcgtttctcattgaaggagtatatgctagaacgttttttagtcggtatatgctagtattttttttgtttggtcagtacgtacatactatttttacctggtagtatcaacgatcaaagaacagtacgtatataccactaagcagtgcatgctgtttaaacaaacgagcagtgtgtaatcatactgattacaataacgagtggtatgtaagatataatcgattaagaagtacagaaggttaagttataatcaactaagaagacggtaacagtacatagatacaactgagattaagaaaaagaaatcatagctacagaggaaaaactgcatcactgcatcgccatcgtcgtcagactataatcttaagctaagctaattgttacatctctaccagaaaccaaatcacaatgggagatgtgcgtacatgttcgtatctgcggtcttccaccgttgccgcgtgattcattagctgggaataactctacaaactggcatcatcgtgcatggtcgatctgtggcagccgccggccgaatcgttcgattcgtttgcctcgaccagccgtactgattttagttggaggagagttcgcgtttcttgctgcggtagtggaactgtggaagccgccgccgaccctgatactgttgccatgggaatcctgcgaaaggggagtaatggatgtaaacaaccatcaatgataattcaagcattgaaaggacgtaaatctagtcgatcggcaccatcgacggggagcacaacccaactacctgatgtcgttgctaatcccatccgtctgaggactgtatgaggaagcgggtggtcgaactggttgatggagcgcgccgtccacccgtccgtggctgccgtggcaagattgctccagttcttccaccgccggcggacttcgcgacctccaaccaagctaccgtcaaggaaccgtcgccgcctccgcctcgcgtcaaaccgcaaatgtcgcgagagctgttcgatctgttgagtactaaccggtgcgatttatataattaagcgctaattaaggatcatggattattattttacaaaaggaaaatcaaaacgggtccgttcggtgatccgctaaggagcttcatcgagatggctgtgatggacggtagatggaaccgggtgtacgtactcccgggagtacataatcattttcatatatatatatatatatatatatatatatatatatgacatatattaataatatgtatttatacatatatctatgcatatgtacatgtacaaaatagacatatatgtatatacttaacattttatgtgcatatataatatatttacactaaagtaaatgtgtacatatataaatatagatatgtattacaattcattatgtcctagctacgacttcgacgtagtcgttatctcagaagttaacgacttatgaattgtagatccgtcgtagtagaattcaccctcgggatcaaggacttgttcattgatgaatcccatgagttgttcttgaacagccgtgataaagtcctcgtgtgtgaggttgtccctcatgtgaataacctatgaatgtatgaagttaattagtaaacaagaaatcgatacatacgcaatgaaattttgaatggtttatttatacgtacatcgagttctcttgtggtgatgatttgggttgtaacgcagtggcaatactcgcatatgtagtagccgcacaagttagttccctcttcctgttttgcacactatatacatgacaaacgacgagagattttatatttgaattagagattcgatataaattttgatcatgtactcactacaaatttgaacctccggcgaagtttttctttccaagtgccacggaccaaatgacggaaccgataccaagccctacatgaagtttaaaactatatatgattcgtactagcaatagcaaaattcgtaataattaataacactggaacatatgacattacctgtttataagttcaaaaatctggtcaaaagtagactcatctttattcattgagtcatagacattgactctacattccttcaagtcgaagagtaaaaggacccagtggaatatgcaatttgtgtgagatgatatatgaaacactgtgcatctatatgtacgggaacgaaatttgttcggtagatagtaaaaactaactctgtgttgtacggcagtagtatgaacgtcttgaaatgctgctccttgaggagatggacgagattgacctctgtgggttgcggatacttggtgaccatttcgacgtttactttccgagggtcgatgaatccagtattgaaaaacccccgctgtcgagccctttgaatctccattctacaacgatgaaggaattgttatatatggtgtacatatatacaaggagctaattaaaggaacgtaagaaatataactcaatgatatgtacaaaatccatgcgctcagaatagagacgtcgagggcatctagttggtatagttcgtagatatccttgaaattgatccagagaacatcttctccttgtaagaagtcggagttcttgattctcgctccaataatctccctaccgctggcgctcatctccatgtaccattcatggaattggtacatctgtgtgggtagggactgcagctgctcaggcttgacaagcggtttaccaagttcgtcaaggtgtctcacttccgcctttggaggtgcacctctaagtaactgagccctagttagcccgatatcagaaatgaattcttttattccaatttcttgcccagtcaccaatggctcgacctcctggtttggttgctctccaagctgagggacttttttggactttctataatatgctttcctaagtgttcgctcatagtccgttagctttaaggcctgcttgagtggtcccgacatcttctggaagaacttgttggcactcgggtctataggaatctgcttttctggacttcgaggcttcaattatctcttcacttctacagccacataagcgtcaagctcctcttgcgtgcaatcgtacggcggctccttgttctcggcggcgtcaactttcgccttcttcattgcccttgtgccggcaggcagtggagcttggtgagttcttgacttagaaggtgccggaggacacggcgcaggagcctgatcaggaggagacggtgcaggagcctgaggaggagacggtggagccggaggggatggtgcacgagacgccgcttgtcgcccagggaggatgaggtagcgcttgcgccatagtataatggcgtggcttgtgtcacgtagatgcgtctcaccgtctcctccagggtagtccaattcgaggtcctcgtacgtggcttccaccagctcaacttcgactctcgagtatcctgcaggaatcggcctacagtggtaagtccctgaagggtccgttgggatggccattcccgacacaaccttcacgtgatgagaggttatctattagtaatcaacctaagcagaaacttgcggaatgtacaagtccaaaaaacataaactacgggcataccttgattgataagttcttgaagggaatatgcagctcacgtggtgtctactgcgtgatttcatcaacggggcaggtggttacgtcctgagtttgcatagcatccatgctctgtgatcctacctgccccgttgggtcatggatcaattcaagttccttcttataaacttgtttatggacacgaagcggttttgccatgggaaactaaaatcggctccagacgattagatttacaagacagtttagcagccgatgagtattacaatctcatggtagatgaaacagaagatttggtccaatccagattgagagcccttgccaaggtgagtaaggataaggaacgggttgctcggcattataacaaaaaagtggtgcctaagtctttttctgaaggagagttagtttggaaattgattttgccggtaaggactcgagacaacaaattcggcaagtggtcacctaattgggaatgaccatttcaaatacataaggttgtgtccaagggagcttacatgttgcaaggacttgacggtgaggtttattgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacagagacaaacgataaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataccataaagggttagggttgcagtaaacagcatttaaagacatttagttgctcaaagctattttgtaaacgcgatcctagaactatacaatattatttatcaaggccgtgaacccacactaacctgccttaacccaaggcctatgatgattcaaaccgaactggcaacccgaccctgggtcccaactcgtcccaagccaacccaggccaacaattccaccttttagtagtaagcagggtttaagaaatgaaacact

SEQ ID NO: 57504 - DNA, 1065 bp, Oryza sativa
ccggaacccccgggacaggcaggtaggactgagcccctagcagcaggacaccggccgtgtgccatgacatctcgactaccgggccgcagctcgtgtagccttcatttgccgtggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgcgcccagcctaaaaccattttggggattttgaatagaaggagcggtgtgaagccaattccacaataaccaaaccattccatagtatccaggtgatatgaatatttcccaaagtctatagttgaaaaaccacctaatgttacctaattaaattgcgaagcatctacctaaaattaaactagtggtgccatgagtagagtgtccactagttgaggttttgtttattctagggtgaacaaggtaataataataacaataacaataataataaggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaacgtcggcttcaacttccacgaagagcggatcttccgaagctgcagcgtctacacgaccaatggaaaagaaaaggcttttactctaataaactccatataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcgtatttattgcgtcacccgagggaaggggcacgcgggccggatccacgggggtggggcccacgcggcagccccacgg

SEQ ID NO: 57505 - DNA, 1210 bp, Oryza sativa
cctcctctcccgggcctctcctcctcctcccggcccacctcttccctccccctcccggcccagctccctcccctcccctctctctcccgggcctgcctctccctcctctcctcctgggccgcctccgggcccaagccgagcggcgccctcccacccgtgccgcgcacgtgcgtgcgctgaccgcgcgcctggccgcgtggggcccacgcgccggtcgtcttcctcctcccgcacgggctcttctctctcccgtgcaaacctagcgccgttcctcctccaaatccgccccaatcaagccggctctttccaaattaattggggggttttaatccccattgattcctcttcaattccccccaatttcccccttgaatcgtgcccccaatcgccgggaacggacgcgccaaccccggtcaccttgcaaggccgccgggcgcctattccgccgccgttccccgcctctcccatggccggctccctctcctcccctataaaatggaatccccatcctccgttctatcgttttagccccctcccgcgttctcccgtggcctcaccacccctccccgccgccgcccttctctttcccccgcgccggcctcctccagccgcctctccctcctcgcccgagcgccgtccggccatgccgtcgccttccccggcgtcgcagccgcctcctcttccccggcgctgcctccgattcgtggggaaatcatcggagacgcgcccccgccggcgtccagtggcgtcgccgccactacaccgtctctggccggctgctgttcgtcgccggtacgccgaccgacgtcgccgtctcctccgtcgacgtcgcagcgtcgtcctctcctccggctgctcctcagtttcgccggaacaccgccgccgccgcgccggcctctcgtttctcctcgtcgacgtcgccttcggtagccccttccgccgtgcccgtgcgccggccgacgtcgccatctccacctccggcatcacagcggcaaggtcgccctcggcctcgcctcccctccacccgaacaccgccggtgtctgtcgtcgttttcaccgttcatcctcgccggctcgtcgtctcgcggcgccgcctccgtcctcgtctccgtgcagccgctgccggctgccatcgtcgtctcctcgccgtccccggtcgtcgtcgtcgtcgtcctctcgtcgatcccggttttgctcgtcgtggcgttcg

SEQ ID NO: 57506 - DNA, 904 bp, Oryza sativa
caacatgctaaattatgttgcaacatgataaaaagaaaggttgtaaaatttctgctgaaaagaaagataaaaaatgggccattagtacagtaatagatgtacagtactaacaacacaaaataatgagtaaattttgaatgagaacaaataaagggactataaactgcatatgccattagcttggtttaattaaaagagaaagagaggagaacagttctactttttcaatatttttagagggcttctataggtaaccgtttggcataacctagggtcaaggaggctctgataccaacttgtcacgcccggaatttctatccaaaattccaaacgcttacatgtgtgtaaaccctcgtccaggaatcagccgaggcacacaataacaaattgataatagagtgcaatcattactctaattaataagcgaatataaagtcattacagaggtagatagttcctctcaaacaataaaaatccaagcagtggaaaaataagatgaacggcgcagacgactctatcccacaagcagcttgaccagggctacgcctaatccttcacaccttcagcatcactgtagaactcttcctttgatgaataattaaaaggtgagtatatgacatacccaacaagccacgcagcaaatatgcaaatgcagggaataacaaagaatggcataatatagtctcatttgcataaatggcatttaataaatactccagaatttaataaaattgcaaagtatttaattaaacaatattaatccaacgctatacaacatacccgttgcataggcccaaccattctgaacaaccaaacccggctgcacagttctacctccaaaccaggaatataccattctaaaccaggagctaaacaaattattatcatcgtcatttaatatggt

SEQ ID NO: 57507 - DNA, 4373 bp, Oryza sativa
agggctcgtgcccaagtcccagtcctcgaatggctcgggtcggggctagtgcctggggagatccacatgtcgagactggccagcccgggaacgtggtgaccgaggggtatgggtgacccgattgtgggtttttgtcgattcccccccggagttcaccacgccccggggcacggctcggttctgggccccgtttggcgattttagctgaccggaccgaacccccgatggcaaggttgagtacgagtgaccttattttaagccaagattcttcaaaaggaaagaacagcacagacacaacctttaggaaattgaaactgcttctattgaaatgttgaaaaaagagaaataagaatgtaatgcatgtgtggtagcccccggccaaccctacacacccgaggggggtgcggggttggcctgagccaaaacctgacacccgaccccccctcctcaggggtagaagcgacgaaggtgttcgatgttccatgggttaggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgctcttctaagtagtcgaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcaatcgccctcatggatgtcaacaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgtacttggcgcacgtaggcgtccatctgcgggtcagagcaccggtactccttacagacttggttaacaaccagctgagagtcgcctaacaccaggaggcggcggatccccagcccggctgccaccctgagtccggcaaggagtccctcgtactctgccatattattggtcgctcgaaagtcgaggcggaccagatatctaaggacgtctccggtcggggaggtcaacgtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaactcagaaagctcgattgcccattttaccacccgtcctataccctctcgattatgcaagatttgaccgagggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggctgatcctctctgctaggggccgtacccccggggggttcttcgttcaagtggcctttgggggcgcacttgttttctgtgccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcaaagggcgttaagtgtggccttcccgcagtggccttggggccctcctgagggtcgggggcacctagcaccgtctgacaagcgggcagagggccggctccggtcgtcaggggccgtaggccaccgtccgactcgggggcctctcctccccgctcgctcccgggccaagttagcacagagtgggggtgcacgaaatgaggattgtcttcatcgcgtccacaaccaatgctgcactaactacttgggggttcgccgctaagtaaagtagcaggggctcatttggctccggggcgactagaaccggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcaatagctcgaatcttctcggggttggcctcaatgcctcgggcagagaccaagaacccgagaagcttgcccgcaggtataccaaacacacacttatcggggttcagctttatgcgggcggagcggaggttctcaaaagtttccgctagatctaaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtccacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaagtgccaagcctctcgtcaccaccctcgggcttggtcgccgcagcgaggtggtccgcacgctgctccatgcaagcg

SEQ ID NO: 57508 - DNA, 2509 bp, Oryza sativa
ccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaactgaaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccttgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagtacgccgatcactacgtcggcgctcaatgtcgaggcgggcatccggctcttcatgctgatcctcccgagtcggaggcgccgacgagggagtggtagccgaatggcgtgcagcggccgccgctcgccgcgctctccgtcttgacgacgcggaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgcagtcgccgtagacgaggaggcgacgctccccatctcgccgttctcctgcaccacccgcgactggcgatgctgcggatttttcgactctctcgagcgcctccccccgcttgggactttggcgtggaggaggtgggggagtacgagctcgacggcgcgggtttggctccccgtcgtcgccgctcacactcggagagaggtcgtgcgcctttgcttgctcggccattaggctgaacaagggaaacttggtgcacacggaagagtatgagagctcagaaaacacacgctgagccccttacctggcgcgccagatgacggagctcgttgcccctcaccgggagactgcgcaagcccccctttgccggttcgaccaggggcttagggtgcaatcccaagctctctctctctctctgtatgtggaaagatcacccgcccgcaagacacacgagacacggcgatgtatacaggttcgggccgctgcgaagcgtaataccctactcctgtgtttttgtggatttgtgtatggaccagttacaaaggattaacttcctttcccctcagccttccaaaagggaaaagtcccctctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgctttgaccagactgcaataaatgctgttaggtgagcacagctgtgctcacttatcccatatatgtggcgcagacttccttaaggggtcggggtgcctcggccctcggggccggggcaagcgcaacccgaccccccc

SEQ ID NO: 57509 - DNA, 2826 bp, Oryza sativa
agctatttgacaatgcacatgatggtcagacatgggtccgaagagatatagaaggaacaactgtcgataacatggtaactaattaaaggtgaggttatgaaggttgttctctgtctatctgtccattatcactgatttccttatatcgttgatatcctcacttggcgagctctttatttttatggcagtaattttggatggagatttactgggatcgaggcttcttcaccacaatagctttactgtgtcgttcgtagatttcattggattgtccaagtgattgagccagatggatgcattttttttatttgcatatatgctttgtgtaataatgttgtacattagttatatacagaattggtggttagatcttatttttcaatatataagatatcatattgtttatatgatgagaaaatggaatggccgactatattttttgcatctatctgtgttgtgttattctatttccatcttatacaaattcctcgagaaaactatttacattgtcaatggcacctaacgtgaataaataaataaaacagacttctccaatgtgaagtggacatagcctagtggtacttggctgtttctactgaattgaggactccagttcaaatactagcaaatgcatattttttttcatttcttctctagtggcgattcctaaaactttttaaattctgtctgctcagatttttttaaatttcttgaacttttttatttctaaattttaaaataaaccattcaaaaatatatttttagaatatgtggtttttcgctcgtcctaacataatttaaataactattaagaaaaaaaatatgttacgtccaaatttcacgcggtctatcctaatcgggtcgacaacgaaataacacgtggcttttttgtggtgctaacataatttaaataactattattttaagacaaaaaatatgttacgtctagatttaatccgcggtgtctggaccacaagtgttttttcggtagcgctaacataatttaaataactataattttaagacaaaaaaatatattacgtccggaatttattcggaatgtccggaccggattgacaatgaaaaaacaggtgattgtttggtagtgctaacataatttaaataactataattttaagacaaaaaattatgttacatccggaatttatccggtctgtccggaccgggtcgacaatgaaaaaataggtgattgtttggtcgtgctaacataatttaaataactatatttttaagaccaaaagtatattacgtctgtttttcatgaggtatgtccggaccaggtcgatgacgaaaaaacgcatgctttttcggtcgtgctaagataaattaaataatgattattttaggacaaaaaattgttacgtcttgatttcatccggtctgtccggaccagattgacaaaaaaaaacgttttttcggtcgtgctaagataaattgaataactactattttaagacaaaaatatgttctgggccgagtcaacaatgtaaaataaagtggttttttttcgtactaggataaattaactaactacttttttattaagacagcaatatgttacgtctggatttcatccagtctttctagaccgggtctacaatgaaaaaacacgtgatttttcggtcgtgctaagataaattaactaactactattttaagaaaacaatatgttacttttggattttatccggtctctcaggaccgagtcggcaacgacgcggtttgtattagtagaaaataatttttactagtgcatttatgaagttttataactagttcttattgatccgcacaaaaataaattagctgaactagattagataactggaggttaaatctgccctaaaaaaatcgagcttaaatttacttgatgtgaatttaacattttgtgtatttgcgcaaattattttgctctccctccattctttccctcttttttcagtcttattccaaatcattccctccgaaaaattgagcttaaatctactcagtcagaatttaacattatttttatctccgacagaacgtttgctctcgctccgttctttccctctttttttttttcagtctcacgttattttccaaatctttccttcgaaaaaaatgagcttaaattattttgctctccctccagtattttcggtctcaatattttttttctcacgtctttcgttgtcgcgccatttattccctccattttatccctccaagaaaatctaactgcccgtgaaaaactctatctcctctctctccattctccaacaaagagctcgtgggtgggttttcttctccaacgaaactctatcccctctcttcttctctctgcactgctcctcccctcaggcctaagccaggcaccaatctgaaggtaaggcaccatggtgatttgctggccagccgctccgcgtgtccacacctctcccaatctgtgttggctgccatcctctgcacctacgcctccccgccgaccaacaaccctgagtaggcgagctcccccacggccgctgagggccacgcggcgacgcctcatgcccggtggctgtgcgctgcaccgctagtgcggttttgcctccccagcgcctacgtttacaccgcgcgcgcagcccacggccctgccgccatgctcctgcatctccgcctcccttcctagttcctacacgtttcactgctcagctgtgttgccaaatcacactcgggcctaattccatttcagcactatactacattactaatttgatatatatgttctctgtatgcaggttttggatcagatgcagtgatcaatcctaggtgacagagcctatt

SEQ ID NO: 57510 - DNA, 1331 bp, Oryza sativa
aattgttcattagctaacagaggtatctaataacctgtaggctagcacctttctcatcaatacaaaccatagtggtacttttttggacaacagtagagtaaaatgcctaaagttttagccaattctgaaattattcttctagagcagtagagaaaagtggtactcagactgcaatacataggtttatgctatttttgttttggtgcagcagatatggcaaggagtagaaggcggtgcattgttcaaagccatgaggaatatttgtcagaggaacacattgcagaagaaaatgcccctaaacagcttgccacaccatctgaagagaaacaatatgcagtgatgttcaagagggtaatgaagatactgatgacgatgttggagaagtcaatgaagatactgatgacgatgctagtatgaatgctggagaaggcaatgaagaatctgatgatgatgttaaaattaatgttcgaggtaaatactaaatcttgatggtaagaaataatgaaattattcttcttatcctggactgttgagcatcacttttatctttgcaatttaacattgaacagatgaaaatggaacaattgaaacacgtgggaagacaaaactgaaagatatttggaaccttccgaaaggtcttaggattgtggttcagtgcaatgatctcaatcaggcagtaggagatgaagctggaattttgtctaaatttcttggaatggtagctaggaatggtactttgtgtagcttaagctacacagactggagatttctaataggaaagagagagagaaaaaaaatgaattaaaagttaaaaaggacattcttaaacaaatatccatgttcaggacaaggttttgcaactaccaaccaagcaatctactgtagataaggtcattctcttcctatttgttatgtcgaactcactacatagcattatatgatctcaatattgtttgcaactgtcaacgtttattgtagctgttcattacaatcttatgtcttatcttattacacagcaatcaaacttatggccaaaatcaccttgagaaacagaggaagattatttgtgtgaaggctagtcttcacttttttattgattggaactgacagtgtttgattataaaaataactagattattgtagtttgtgccaatattttgatattccgtgcagaataaaggaaacatgaaccagaatgatcacatgcaacaagggaagaataattctaatgcttataaggtaaattttcacttctggagccacctaatataaagataagctatagaattctatttggtataatatgtttgtactttatagttaaattattg

SEQ ID NO: 57511 - DNA, 737 bp, Oryza sativa
tcctgcagcccccaatgagcaattaaagctatttgaggaataacaattcaacaaagcatatatatatagagcatttataaatcaaaccatatgctagcatcaacattgcatattttcttaattcaagtatagaatttaagtgtcatgcatcatctcccttaaaagcaaaatctaaatctcatgaaagactagaatacatacaagctatgctagagacaaataaaccttcaaagtattgctagcatgcacaagaaaataccatttgcataaacaaagctctattttctcaatttttctcattgtcatattatcgcttgataaaaccatgaggtacaaactccccctcaaaccatgccaaaaggatgaactatgcccaattcaccacgaagaaaagcaaagcgattagaatccaaaggcttagtgaaaatatcagcaagttgcaactttgtgtccaaaaactgcaattcaacatatcccttctcaacatgatctctcaaaaagtgaaagcgaatatcaatgtgctttgtgcgtgagtgttgaacaggattcttagcaatgttagtagcacttgtgttataaaaaaagagaggtactttctcaaaagtaagaccataatatttcaaagtagataaaagccaaagaatctgtgaacaacaactagcagcagcaacacattcaaattcagcagttgattgagcaacactagattgtttcctagaagaccatgcatcaatgat

SEQ ID NO: 57512 - DNA, 736 bp, Oryza sativa
ttcctgcagcccgtttatgtgtgtgaaagtctggtttgcacttgaaagtgaggaacccgaaagaataagaacctcaagggatggaattgtgttcaccacaagaggtgatcaatatatcatttactgcgcttaggtttacgctgctcatgtcaaggtacttaagttgatgtagattggttaaccatgaatatctactgagtacatatcagtatccatgaaaccgaggttaaggtgttgtagatttgaaaggttaccaagctgaggaggcactctaccaaacaatatggatgtttcagacacatcaagatatcttatgttcttcattgaaccaaagtactctgggacatggctggcttcaactggatagccaaacttgttaatagagacatcaagctccacaagttttgcgaggtttcgttgtgtcaatgactgagttttgcctggaagcgaggagcaagaaatatggagggccaccaaagatacccaagtatcacaatggtggagcgacaaggaatcagggtagtacaacctacacgaattagtgcgactactgggtaggtccgtcggtttggcacgcaaaccgaggccaagcaagttaacgtgtgattctaataaagcaagttgcaaacaaaataataatgattttctaattataggggcaattggtcaaagggtgacttgccttgctcaaggtcttcacgaagcttcacgaatcttcgagaaatccacgattgac

SEQ ID NO: 57513 - DNA, 1027 bp, Oryza sativa
aagggagcacactggtgtgaagagggatacgagaggaatcaatccgaaggctctaattcgccggaaggagtttgacggcggaggatttcgacggtgatcgtcggcggtgagcaaaggggatacagcggaggggagacgaggattcaatccaaggcgacgaaagcatctccagggttcgagggactcgttcccgggctcggatggagcgaggggactacgagggaggctggcgaccagcggcgacctccgggagcgggcggcgacggcggccatgccgatcggtggcgccgctaggaattagctcctacgcgatcggggcgacaatgccgagctatctagcgagctaggagaggtcaagggatgggaacggagggactaccgtgtcgggaagaggcgccggaagatggccgacggcacggggcgtcggcctcaggccggggaagaggaaggagatcgagggcgcccggagtcctcgtctcgcattcacgcatgcaccggcctccgacgcgtgcgacgggcgaagagacgaagacaagaggtgggagcggcggcaaggcgtcaacaatggcgcgacgggtgtgaggcgagcgaaaacgagagaggaaggggtttggggtggcctgggttttacactgtttcaattaagagcgaaatgcaaaagttctatcttgttagtattgcaagtttatgcagcagatgttgcagtcatggcatagaacaaataaatgtatatatgactatatgagcacagagctcttctagacttatggtaatatacactgttagcctcttgcctttagttcaggaagctcagaaaaaacaaatcaagaggataccttatctggaacaagaaaacaatatatgctagctctgatcacggctgattattacaaattatccagtaatattgcgtgcattacagctgggttcttttttagggaaaacaacaacatcatgagcaggttcaaaggagccctgacaagaaatcctatcttactactataaagttatcctcactaactcctta

SEQ ID NO: 57514 - DNA, 714 bp, Oryza sativa
agccgtatagcgtattagctaaaaaattaataatttataggtaaaacttttatatatatgtcattagtgatgtaaaagtatatctaaaaataaaaattaataaaaaaacttcaaaatcaatttcaaaatctagttttaaaatttgaattttaacggcggctaattttatataggcaaacgataagaaccttattggttggcaagatgtactgataattaatctaacatacataccgacagacatatctttccccattgcggaacaagggtggcgccaccatgtgatatgatccaggcgtgtcctctagctaattgctcattgcttggctcctcgccgataagtctcagggtgacatagtttaagcatgtggcaaacatcgtgcttgatcccaagattagcatgccccatcccccgtcctcgttctgcacatgtaaatataaaaaatgcaatgtttctgtacaacaatatttaattattactccttccaattataaatatttaatattaataagatctggtcgaactgactacaataatttctcaaatacttagtttaaaaaaaattatatgagtagattgacctagaaaattataccacaatatcataaatttattatattttataaactcattttaacataaaactggtagtcaaattaagtttcaaaagtttttgatcgaaacttgtcctatgcgtcaaacatttatgccta

SEQ ID NO: 57515 - DNA, 1415 bp, Oryza sativa
ctgttggatgagtcatcgtcatctgacgatgaactcatcgctgcagcagcaatagttacacaagatgaatatgagcattcgaatgctccacgacatggttttgctgttcctggtagtcaggttgttcgtcgtgatcgtcgagcgggccatatgataggctgcaccacaactacatctcggagcatcctacgtacaacccagtcttattccaatgaaggtatgcaattaatctacatattttggttggtcccgttttgtgtgccacttctcttaattcacataatcttaaaaacaatattctttaagaaagctagacgctaactcaattaaatgattacataatcttgaaccgttattctactttaaggtctattaagaatttgctcataatacccatagaacttgtgaacttactcttgaatggtaccccaatgattgttaattgaattatggttacgatctgaaagataattactaaatttataatagatgaagtacttttcacaacaaatctacatgtactgtcttcataaattcagtctaggcatcataaaaatactgatgctaaactttgaaaaaaaaatggccacacatgtgctgccgtgctctgaaagatacttgtgggtcgagttagtgaaactctaataaaacagcaaaacaaagaaacaacacatgtatgcttgatcacttatttctataaacagaagaatataccgtggatatcattttgtcgaagtccaaaactaacaacttgatccgactaaaattaatgtatcaatccctggatcagtagatgttgatacatacaatataactagttcttcattgcatacgttaaagttttataatactaagggttttacaataataggtactcacctatttgattaactagaattaatatacagcggaagtttttatacattctgactagggaggtaaaacctttagggattctctaaattatcgtggtcatcgtagtaatagtcataggggtcctcctcttgacccaaatcttaaaaggggttatgagagcaagaatgagtattcacaatactcagcaagttatcatggaaatatgttatgcattagcatatagcagggttctttgcaaaaagcaataataaatattctggaagagttatagcaagaatttataatcatatagattttagatttctaaccagggtaccatatgagtcctggtactcaactccatgagtacggctattcgaatagtttcaaagatattctactgcagcagatgtacgctttacctgcagtccacgacttgctgataatcatcggctttagtcaaggcccagtattaagttattaacaattgtggcacctgttccatgaacttgtatcctcatatgccctgaacgtaatgttaatagcagcaagaggagttg

SEQ ID NO: 57516 - DNA, 1203 bp, Oryza sativa
tcatcgccatggatgagctcaaactttggatacggctggggcggtagaggctgtgagagggtgggcaagatcaatttgagtggcgggaggccacgttcgaatacttaccggcgaaggattggcttgaccgcggttgaaattggctggcgacgtgttggcgccaatccaggcgcgacgcgcggcggcggcgagggtgaaaatggctggctcaggggtgaatggtttgaattgtgagaggggaaaccaccgtctatcttcaattcaaccgtgcggcaaaaattggcgcgattcaccccggatagaaacaaaatcgcactcggcggcggcttggatgggagcgcacggcgtcgagtgtcgattccttgcggcggaggtcgtcccggctttgtcgtcgtcaagattggtgtggcaacggcgacttgaaggcgttggacgggtgacggcgcgccaagacgatcgggcacgcgcaagcggccccgaggctgacgcgcggcggctcggcgcgcggcgaagtcggacgccagggcggcgcgcgcaaggggaggagaaggtcaactaaaccacggtttttgagtgggatgtggtccccaaggatccaacatagactttgcacaagattgggtggtaattgggctgctctagctgggctgggcattttgtcgagcaccttcagtgcaatgaacagtgttttcaggaatttttgaatattttcctagaaaagaatgaatttaatctatgaatttggaagagtttcactagggtttgaagtatagcaaatcctcactaatattggagtaaactaagaaaatattctatagtttgagatttgagagaatttgttcaaattcactaaagtttggaataaagggaataattatggtaaattagtagggctctaaggaagtaatacttgaaccaattaaaaaatcaaataaatttttaaaacacactaaattaatcaaaagccagcatgctgcagtcaaattttaatttaaaatttgaggatgttacacatttctagatctctgagcttttttttttcatcgctaatggctaccggctgtgacgtataaaagctcaaaataagttttagaaacaccagcagttctgtatacgcaggttttcctaatgattcaaatgcatgttttttcctattagaagtctgttgacgtgataaacaacataaaggcggggctgcaggaa

SEQ ID NO: 57517 - DNA, 8943 bp, Oryza sativa
  unsure (1)..(8943): unsure at all n locations
tgatgttgataacgcattctctctagggagggctttgtttgcagttaaatcctatttatgctgtcatggtgccacggtgggattcagatggttcaggattgttgaaagttgctgatgaagactatacaatccacgtctcaagacacttaactttctctaagtaatatcgtgaagtcttctggcttcatcattttatgacttcttgctacgagaaaatttgtaatgcaaaacatttcctattgttgtctgtagggaaattaagacatcaaatatatatatattttgcataggtctgtcctgtggggaaattgtcttgtttctattgacccactatcgggaagttggggtagtctctctgttgtagattagaatattcttatatgttatgctaagtgtaaaataattcaatgtagggctgacatgctggtgtgtggggtctcaacccagattacaatgagcatattatggtcatgttgagaaaaataaggaattgctgtagcgcatgctttttttcattacaactttctttttttcctactcatatatgtttgaatatgcttttttactattaggaattgctgtagcttatgtttgaatatgtttcaacaagagaagcgtatgtaaaatgtgaggaaaagaattggtactatttcttagcttatcaaaagccagtggatctttgttaaccctcacaatttattctgaatccctgcctactccatcaaaccttttatttctttcccgaggatgtatatgcaattaatgttggaaagtgtgtatgaaagtactttgttttctgctctatatgaattctcgctgatggcagcgatctacttctttcgtctcaaattagttatcttaccatttaaattttatcccataatattttgtcacttgaaaatattacttgttccatcaatcacatcttatttaaatttaaccactcttctattctcaactatattgtcggaggagtgggagagggtccccacttcatcggatgcttgggatgccatggaacccaccatgaaaaaatagaaaatgatgtaggactccaagtgttacttgagctgacgaagacggtccgtgggcagcagtagctcgggagcatgtctttcctacctcggtggcccaatgactactgcaggtgggaccaaggcccagaggacagtgctaggacccgaggtcttctagggaaatctcttttatgaaggggatttgactcggtcctatgcgcatctgtattaattatggggtgttacacatcttgtgagtagatcatggatgacatggggaacatggttatgcatgctatgtcgccccgaagaaaaagatgggctacgcgacgcactctcagcaagcattccacaggccctctcttaaaagcatcgatggctaatgagtgggcccatcgacaattgggatgaagactttggtagatctacttcacatgttagctggtagggagccaatcacatccgactagtctgtttggagagacagtgataagatcaagtatatcaatccctgtggggttggaccctgctctggtatacatgcatgaatgctgtggactccctttcacgtataaaagacggattcatgccacatagaaaatggttagattgtctggattaggctaagttagattcaaccctcagactcaatgaagaagggttcattatctccttgttgaagtaaaggtttatcctctcccacttagcacatcacaccaacatccattgtaaacttgatcatcatcacatagtgaaagaacatggagtaggttgttacatttcttaggggccctaacctgtataaaaccacctgttttcgcttactcattcacgtgccccaaccacgagcttggaacttataccctgacgaactctcaaggatggtatcttactttcccgctagaggagcttcttgcttcgacacacacattatttgataagggcattacagtcttttatttcaagccttagtatattatgccaaataatacagaaagaaataatttggaacgaaagtagtacgtaaattcgctgatctagctatgcaactacaagtacaataacttaatcattgcatcaaacctaatattgtcatcaattgtgtcaagccgtcattttgaatttttttttactaggcgaataaagcacgtggcaagacagagataaaaacaattcgattattggataggtaatttctgcaaagggattataattgggctgtgttcttttggaggtgttgggaacctctctcctccacacatgaaacagagtgatggattaacacataattaattaaatattagttatgaaaaacttgacaaatagattaatatgtttttaaagctactgttttatataattttttaaattaaaaaacgcattgtttagcagttttggaaatgtgtgcacagaaaacaagagtggtgagttgagaaattaggataaagaacacatgtcttgtacattaaaaaaagatgaggatgctggttgtggctacgactcacgatactggtatatatgattaaaaatatggtacacatgacaaatgacataacaaatcaattaaagcaagttgagcatccacccaaatagcatctgcagactgacatgtgggcccgaggtcctggacccacatgtcagtgagcagtaggaccgccgtcccttgctaatacatcaaacttggttgtgatttccttgccccatctaccaccgtaaaaggacagctattttgccttgctattatcagcggcatcaaggatgtaaagcatgtgccctatggggatgacatcaatgatgcgctactacaaagatgccaccgcctgaattcatcatcgttctagaaggctttgaaagcaaactgacatggttaagattgaaacgacatagcttagctatgtcttaaaacctatgacatgaaaggtttcgcatatggtttgcataggtttaatctggctagccgtcaatgctttttatgttgatcttattttcctattcatgctgtcttaatttgattacattaatcatccctttatcttttcataaaatctgtttggcatttgttgctgattcgttttggctaggagaaagaatatgagatgatacatttcgcttagactttagatgtccgaatctacgcattatcgtattatcatcattttagttggtactctgaaagttttacaatacatctctaaaatcggtaaaatgtttgtgctgcggaaggaattctttcgaaaattactgccatcggatctggatgtcgcgctgaggtgtgggtaggccaattcgggcgctggatccatcagcagccccctgagcagatttacgtcgcggtcgcggtgattgccgtgacgattgtgttgctgctagcaggtgatgtatcgattcatgccctagttactctagtttttcttgctttcaaattcaatcccttcgtccgatcctagatggctaggtggttgttggcaattttttgtgacaagttgacaactacgatcgtagcaccttatgccttgcggtgatcctagggtcgccaaccaccttgatctagcaaagagctagacctagatgggttttgacaaataaaccggctagcggagccgattctagataactacccgtctcgtgggcaaaacggaaggttttcaggacaaacctacaaagagatgttgcactctcgcaacggcggcagacggtttacggcgcaaaccgacaaagatggacaaactaagagaaaactaaaagcaatatgaaaaatgattcgattgattgattgtagattggttgttacaatagaaccggccatgtcccttatataggggttggtcttgccctcgacaggcccttctccatgtccaactcgggataaaagccaaagaaaacccgaaacatgtcttcccgagcaaggaaacctcgagacccgatgaaagacagtcggactcggacctgccggtcagaccggtcacacaccgccggtctgaccagccctcaaccggcggtctgaccgcccaatacacgatggtcagactgtcccactcgaaggaaaccggtagattttcaaattttagcaatctttcctattttaatcctaggtgccaaatttgggtgtaaacacatgccccccctgcctttttgatgaacaacgtgaatctaaaagcatagaacatgtttttggtcttagggcgataatccaattaccggccatagtacctcctaagcgtcttgctaaacgctcgggaagtatttcttcaagtatttcccgttgattactcgctgaaaatgctccccttgaagtgtctccaaaaaatatgcgtttcctcgaacaatgccgcatactcgataaggaccctcctaactaggagaccacttaccgaactccctagatcgagtacccaaaggcaaaattgtctttcaaaccaagtctccaacttgaaacaactttgctttcacccttttgttgtacgccttggccaccctcttcttctctttctctatctcttccaaagccttcaagtgcttgttgatgacttcatgaaagttgtctcccatcaacgtcttgtaatcttcacttgacaaatcatcttgcttgatataacgaagagaaccaagatttatctcaaccggtaaaacgacttcttgaccataaaccaactcaaaaggagtgactttagtggcaccatgtttagatatcctatgcgcccacaatgcttcggaaaccacttcatgccacctttttgggtgttcctcaatcttttttttcactagtttcaacaatgtcttgttacttgactcggcttgtccattagcctgagcgtagtaaggagaagaactcaacaatttaataccataagattcggcaaaattcttcacttccttaaacataaaagaagcaccttgatccgtagttaatgtttgcggaataccgaatctatggataatatgcttcaaaataaagtcaattacctccgtatgagtcgtattcatcagcggcacggcttcggcccacttggtgaagtaatccgtagaacctagcacgaacctatgcccctttgatgacgaaggataaatttgaccaatgaaatccaaagcccaacctcggaacggctatggtttgattatgggattcaacacggcggcgggcgccaattgaacattgccgaaccgttgacaagcttcgcatcccctataatatttgaagcaatcctcaatcatcctcggccaatagaaccccgctctcctaagcaaccaattcatcttgtgggccgattgatgagttccacaaattccttcatgtacctctcccatagctactttagattgatcttcatctagacacttcaacaagactctatctatattttggtgatataaatcttcatcaagcaatgtgtatttgaacgcttgccgctgaattttccgatcaaccttaagtgtgggatctttcagatatctaatcaaaggaattctccaatcctcctctgtttcctaggcacaaatgtccgaattcacaattaattcggcctctaaattgattgaagcgtgccccccaacgctctgcccagaaccggtcagactggccatacaaggccggtcagaccgctcggggtcgccggtcagaccggcgggatgtggccggtcagaccgcccctagtcaccagtgaactgcagagatatagcctagagggggggtgcataggnnctttcctgaaattttctcaacaatcgcagcggttaaattacagggcccggaacctcctggtgaagaacaccggaacttcctagcaatgatgagcagcccggaacttccggagttcttgcgtcaggaacttccaggcaacagagaaaaatgaaatcagggaagtaaaacaggtcctagctagagatgatcaggcacagagttgcacaagatgtaaatcacaagataccagcagattcaaacacagatcatgcacaagagagacaaaggcgattttttcccgaagttcggatcacacggatcctactctcctttgaggtgctcaaagagccgggtctcgattaaccccttgcctcacttatgcaaagatccgagaagaagtccacagccttcaactcaacacttctaggtcattttctagaattgagtgaccaccaagatccaactcacaattccttctagaaaagaccacaagtgcaagttgctctacctaggacaacctctgaaaactcagcacaagaatctttactcacttacctcgtttccttgcggaggtgaggaaaaccttcacaaactttcccgggacatccacaagatccttggaagctcacgggcgacacctaaccatctaggagaagatctccaagagtaataagcccaggtgatagcccacaaggtatccaaagtgctcaaacaaacctaatcttcaagctatctccaaaacactcctacactctaatctaatctctcaatctcacaagataggctctagatttgagtggaggaagcaaaggaagcttgggagtggctagaaaaccctagaacatgaaagagctgaagtggaatggccaaagggtgacctggggacgaaatccatatatataacggctaggtgacgtcatctagccgttactcacaagtttaaactggaaacctgccaggaggttccgggcaaaagtgccaggaacttccgggcaacacttaggaaattttttgcaatgaaacggtgcccggaagttccggccagaacctccgggtagccctctttgtcccggggagaaaaaacatttttcaaaaaatgattccaaaaatattttgactcatggatatgactaagagcactttgtataccctagaaccacacttgaaacccctcttaatagtacggtttttcctaaactcaatttcgaaagtgaaaaacctagtctaatcaccttcggtgtttttcgcacttaggaacattcaaattggggggtctccttgcattcttagccatcacaacttgctttgggactaaacttctgtgaataaacttgataaacacgttagtcccctttaaccaccttgtcattaatcaccaaaacccactagggggtttaagtgcatcttcaaccagtcagaccggccacgcaatgccggttagaccgcccctattccccaattttgccaatttcgcacaaagatttgaaattaagcaccggctcttctaataccagaaataatcccttcttcacactatagccagatgcctattgtgccaagtcatttgctctagaattatcatgcctagcaatatgtctaatagcaaaattatcaaaattggcaataatatccaagcatgaatcgatatacctatttagtgatccgtccaagcatttataaactccgacgacttgttgcaccaccaatttcgaatcaccaaaagcttccacgtacttagctccaaccatctccatgacttgtgtaagccgaataataaagcattgtattcggcttgattatgtgtacaataatattccaaacgaaccgatgcttcataacacatgccattaggtgaaaacaaaactaccctatgccttgaccttctttgcaagaagaaccatcaaaataaatcttccaaggtataacttcaactaggcaaacctcttcctcataagcaatatctacatgatggtctactataaaatcacatacaatttggcctctcatagatttcaatggttcataagccaaatcatattctatcaaagcatatgcccacttgccaattctcccacttagaattggcctttgcaacatgtgtttaataacatcggcttgacaagcaactatgcatgtactagataacaaataatgcctcaatttggtacaagcatagtataagcatagacaaagtctctctataaagacatacctcgtttcggcatccaaaagacggcggctcaaatatgtaataatatattccttgccatcctcctcttgcgtcaaaacggcaccaatgactttgtcttcggaggcaatatataaccaaaaaggctttccggctttaggcgcccacacaaggggtggagtagataaatacctcttcaactcctcaaacgcttcttgttgttttgccccccaagtaaaatcggcttcccttttcaaacgaagtataggaacataagcatcgattttacctgctaggttagaaataaatcttctcaaataattcaccttacctagcaacttttgaactcccttcttgcatgtcggtgctttgaaatcacgaattttttctatcttcttaggatcaatctcaactcttctctcatgcaccatgaatcctaagaacttccccgctgacacaccaaaagcacatttaagtgggttcatcttcaaactataccggcacatcctctcaaaggctaacatcaaatcggctatatgtccctccataccatccgatttgacaacaatatcatcaatgtagatttctaagataatacctagtaaatcatggaagatcaaattcattgccctttgatatgttgcaccggcattcttcaatccaaaagtcatgacaacccactcaaacaaaccaacaaatcccaggcacctaaaagccgttttgtgcatatcctcctccgccataaagatttgattgtagccgtcattaccatataaaaaactaatcaccttatgacccgaggcatcatttatcatcatgtcggctataggcatatgatattcatctttgggagtagctttatttaaatctctaaagtctatgcaaactctaatcttaccactccccttcttctccaccgggactatgctagaaacccactccgcataacgacatggcataataaaccccgccttcaacaaccgatcaatttcctctttgactcggtcatatagcaaaggattaaaacgacgaggtggttgcttataaggcctaacacccgg

SEQ ID NO: 57518 - DNA, 10635 bp, Oryza sativa
cacctctgatcagagtaaaactattcgaatagccgtgcccgcggttatgggcggtcaaccagattcaccgtgattagtctcaccctagcttatttgaatggaattgattagttcaagtggatggttggcctgttgcaacgtggtgtagcgttcaacagtggatggttaatattgattaattacttattactacaactgttttactgctttcaactactgtttataaatgctcgctttatgcaaatgaaccgctctagctatcctttggttatatcctgcatcataccccctgttccggtatgacttgctgagtacagtgggtagtactcagtcttgctctattttccccaaaaccccagagtttgagtatgcatcagatggtggcttttgcgaggagtaggcttcgtccgtgccgtcgaggatgcctgtggagtggtgttcccgttgcagtccaagtcaatgcttagcttcagttatctttttttttccgctgcatttatgtaagacttttataatgtttgtaagacatggatttgtatgtcaactttgtcgtttgtgtaccccggccggtcctggacgggggttttaatgcacattctgcttggaattctattcgggaatttctgggcgtgacacaagatcatctcctagggagcgatttggtcattcaccaagacggctgggatcgcctacctataatcatcctcaagccatgtcatggggatcttatccaatgccgccatcgggttatctttttccttactacatgccgtggggggcagcaccgccaatgttcaatcatatgcctccaatgcaatttaatcaaggatggggaggaccaaggaggccaacacgtgagtgtttgtcttcaccaaacaatggccggttttatgctaaaaatcgggtcaatgaaggaaggagggaaggaaagcgcatcaaggtggagactaggacttcggaggtgattactatcaaagtggggtctcatgatgagccaataccctctagagatgaagttggagagtcttcaagcaacaaatccgaagccaggactagctcgtcgcagtcggccggtctgaccaaccctcctggccggtctgaccgcggccctacggccggtctgaccaggccaacaggccggtctgaccaccggtctcaggccggtcggaccggggcctccgtccggtctgaccgttggtctccgtccagtctaaccgggctccagtgccggtttgatagttgatttgcaaagggtagctcgggggcttcgtcgtcttcaaataaaatcaacaggggacattatttacctcctggaatagagccaaaacaaagatggatgcctaaggattagacggctacccaaaagaggaggttgcaatgtctgcgggcccaagaattaaaagagaaaggggctgaagaacggagagataggagattcaatgagttgcgaccgccacctacaaagatgtggaggcgtaagtccatagaagttgaagaatcggttgttgtgcaaagggaaaaggaagaacaatcggttgctaaagatgaaacatctccaaaagaagacatggatatcaacatggtatgtatgttgcctatggagctttgtgctatggatgaagccgaggttgctcaactttcattaggtcctaaagatgcggtttttgaaaagcccgatcaatcaaaccgtcatatgaagcctctttatctcaaaggtcatattgatgggaagccagtctctaggatgttggtggatggaggtgccaccgtgaatttgatgtcatactcgttgttcaagaacttggggcgtggagatgatgagttgaagaagactaacatgattcttaatggcttcaatggtgaaccaacggaagcgaagggtatcttttcggtggagcttaccatgggaaacaagacgttgccaaccgctttcttcatcgtcaatgtgcaaggtaattataatgttattttgggtcgttgttggatccatgccaattgttgtgtgccttctaccttgcatcaatgtttaattcaatgggacggcaatgatattgaaattgtttaagcggatacatcggccgaggttgcaatggccgatgcaacatttgagtggcgtcatgggaatattcagtgcttatcggggatggatctttctagttatgatttcattagtatttccaatggaaaatttgtacctatctctgtaaagccggctagcttagcacggctaggccatatcactttgtacaatgagtaaagaagctaatttggagtggtcgcaaaagagggtgcaagaatatcggtctacaaagaacgatattggtgaaactattgaagattttgatgaagtagaaaagcttggtcaagggttgtcacgcccggaaattcactagtaatttccgaactaatttgtgcattaaatcctcgtccaggaatcagccgaggtacacaaactgacaatttaatatacatattcatcaatataataacgttacatacttacaaaagaaaaggaaactgcagcggaattacggtctagcgaagcaccggctccactcccacaggcagctcaactggggtataagccaaacgtcttctccttcgcaacttgtcttcaactgaggtttgattgattattgcaaggtgagcatatgatatattcagcaagccacacagcaaatatacaagtgcacaaggatatcaaagaatggtataatatagggctcatttgcaaaagcagcatttagcaaacaattgaggattgtaaaactgtaaagcaattaatcatcaatattaatcaacactgaacagcacacccatgctgcacaggcccaaccatcctgaataaccatacccagctgcacagatctatctccaaactagaaatataccattccaaaccaggagctaaattaattaccatcaattaccacattattattaatgagtagtgtgggactaatcacgaaagacattgttcgacccgcctatgaccgcgggcacggctattcgaatagttttactctggccaaaggtgtaccactgtacccacaagacacaacccaccagcatgttaccgtgcccggccagacatgtcaccatgttgagtgattgtgacaagacccctcgcatgactcaacccaaagcagtgcaccgttcctggatcgtagtcaccccctcaaaaaccaaaggcatggactccccagcgacccccgtgggcttatctccgccacttctcagtctggtgctccgcaatgagccttgttatgcaaactgtccagccgttgcccattctggcttgtggttggcacggttaatgtttcacaaccgaaactcgtgaaccagtccttaattgtcatgagcactaccatcaaaaccatgtgctcacaacccaccattatcaagttttagttggcacattaattaataaaccaatcacgattgaccatcgtgagctatcattaaatatccataattaagtaatagtgaaacattagttatcccaattgtgtgctaatgtttctaagcatggctaagcaattatgtctaacctctagctgaaccaatatataaagctcaactagtcaaattataataacccaaggtatcaaggaatagagtaatcaatgcaaactggctctaacaaaggaataagttcacaccacccggtgacattcgaaaataaatgcacaattgaaataaatagagaatttaaatataggatcaacatgttcaaaggaattgtgtttgggatctgtgtgacttgccttgtaataacgggtcttcaattaatcttcttaaacacttccagcacactcgcgaaccttcgaaacgacggaaacgacaagctaacacgcaaaacgaggaaaaagactaataaaacccaaataaacagtacataaaagtaaacaaacatgtagatcatgattttagatgaatttagagacttaaacggcctcattccgatttcatatgaattaattatgatttttacaagatgtaattccaattaaacctattaaagaaaagactattccaaattaattaaaccaattacagatgatttataactgagataaaagattaaagcaacctccgaaaaagattagatcatatttggtagatgatatatattaaaaaggaataatatgccattgaaaagaggaggggatttatatcgattttgggcggctgagattaatctcgactgagtcgaccaagatcggatggcttgaattgatctggcaagcgagccttacaagataccaactcaacgagtcaattcgaaaccagcgaacgaaaccggcggctctgaacggctctaaactaaaggacgactccacacggacgaacgaacgaagcacggggaacacctcgttcgaacgaacgagcgaacgactcaacaaaggttgcggctaaaccggtgggctaaacacgattcacggtaaagccccggtacggcaaacgataggccggtaggaacctagggttgcacctacggctagacaactcgactactgagcaacgggctaaagcggcggctaggtttaagtggcacacagctgcgacacggcggcactaaggcgacttggctcggctaggtggcggctcggcggaggcacgcggctagggttaggatgacggcacagcgatgactactcgacgacaaaaacgagagattaaaaactaaaccgagggaacacggatagaagtttcaccgaaccaaagcgatcggagaggaagggtcgacgatgacggtccggcggcaacacacaaagacgacgacgatgctagacaaacaacggattagattgaatttgatctagggtttaggtagacgtggcaatgataagacatccaagcgagatcaccggataacggacaggggaacgacgatcaccggcgaactacggagcgacgataaaagggaggataccgggagaaagagcgcaaggcgacggtccttaccaacacttatgcaacgacagaccgcgacggaagatggccagcgacaagcttcgaaaggcgacgaggtactgtccacggcggcgacgactttccggcgatgagtggcaacaacggaagggtggctgggcttcacttcgcagctgcgaacccaatggagtcaacggcgaccgaaagcggcggctaaggcgggtgcttgctgcggctggaggcacagcgacgacggcggcgctccggttcacgatgacgggctaccttcggtgggatttggcgcaaaagaaccaatggccggggtagagctcgactttgcggagccgagggaggcgacggcgcaggtcggggacgaccgaggagacggcgcgacgtggctggagcggcggccggcataggagagagaaagcgagctcggggaggggcggctagggcacttcgaaggacgggacttgaggggataggtagaggacgacgagggggtcctttatataggcacgcgagctcgggtccgggcccaaatcgacgggaaaaaactcgggaaagtctagggttctcgccggagtaaggaaagattgaaccgcgaaattggaaaggatttccatagaaacttttggggatttcttgggaaaattgtagaggagattgagaggattccattctcgcaactaatttggaaagaggagcaacgaggaggttggatttgggaaggagatcggcgcggctgcacaggctcggctctgtctcgaggtgtctggaggaggaagatgatactgtagcgacaggaaattagacttttggctgggctattacacaacccgacagaaggagagagaaggggagggaatgggctgaattcggcccaatactaggaaggatgattttattgcttttccaaataaattaaccaatgagatgatctttcaattgttaaaaatacttccaatgctcaaataattccaataaaaatattgaacatacttggacactcaaagtatttaatataataatatccaaataatttaatgattaatttattatttaaataattactgaaatgttctttgtattattaaaattaataattgagctctgaaaaattcgagaacattccagagagtataattaatcatggagaatttaataaaaattaaatccaaccatgctttaaatttaggaaattttatttcccacatttaacttcacttgtaaattaatgaacatttaatataaattctattaataatttattaaataatttataaatcctaaaatgaaaatcaggctgtgacaagggtttacatcggccgatccattggaggaagtagacataggtgatggaactaagccaaaggcaacttttgtaaacaaaaatattaaagccgattataagattaaaataatcgagctacttaaggagtatgttgattgctttgcatgggagtatcatgagatgtcgggtcttagccgtgatcttgttgagcattggcttccaatcaaaccgggttttaggccttataaacaaccacctcgtcgtttcaatcctttgttatatgaccgggtcaaggaggaaattgatcggttattgaaagcggggtttattaggccatatcattatacggagtggatatctagtatagtcccagtggagaagaaggggagtggtaagattagagtttgcatagattttagagatttaaataaagctacttcaaaagttgaatatcctatgcctatagccgacatgatgattaatgatgcctcgagtcataaggtgattagcttcttggatggtgttaacagtgaaatttggtaagcccggagtagtcatcggcttagagtcagcatcggcttcgaagtcctgagattagccgatgagagttgtcaaatcgtcagttgtcggattcttgctatattcggttaaggaaattgatctactaaaggaagcttatccaaaagagaccgagttcaaagagaatgcggcatggcaagttatctattaattaggaatagtttgttagtttccttttatctttaggaaagtgtgttatcttttccttttatctttaggaaggtttctttcttgtccgacaaggacttgtatcaacccatgggtataattatgtacacccggggtctatgtaatctatcttcacgatcaatacaattcggcgcatcgccaccttttaccctttctactttatttttatcgtccggcgggacttggcacctgacgcggggctgcatcggtgtttgatctccggctaaggggtaagtccaatgttccgccggcccgggcaattgtatcgtttacgtcggagtcgttcaaggctacatcagtacattcgacctcttggattgctctggtttggatgatatatttgcctacctatttatcatatgtctctattaatctagtcttagcatatcaatttagctctatcggctgcttctcgttttagggtttctgccggtatcggctaaatcgtgttgctagattagattagcttagacatctaccaccctgaaaactcaatcaacagcttgattgtctagatattatgtttcttttcatacttagtgctgcatcagttaagtttgatctactaagtcgtgcttagaaccataatctctagcctgcttcttgattgccaataagggtttcatcggggtttcagtcggtgagttatctggacgttgcatcggctcataaggattgcatatacatataagttggatttagccgatgacaacaaaggtttcactgtttaatctaatattgtggatttcatgacatcggacctccagccaatgtgtgctgtaaccttcggatagatgcttaattatcatatcattagccgattggtttatactggattatattgttattttattacatcatcatcagccaattgcctttatatcatcatctacattggacatatagccgattgcttaaaccatattgctatcggctggtatcggcatcggctattatcggctatcggctggaactagtccatcggcttgtcagccgatcgactgtttaatctactatttgcatatcttgtcagttgcaggatcaaactgattggcacgcctacatctcatcaagatttggacctgcacaggagctaagcagatctcccaggccgatgtgttcaattttttcgtcaacagatggtaatgccggctacaatcaaatctttatggcagaggaggatatgtacaagacggcttttaggtgcccaggatttgtttgtttatttgagtgggtggttatgactttcggattgaagaacgccggtgcaacatatcaaagggcaatgaatttgatcttccatgatttgctaggtattatcttagaaatctatattgataatattgttgtcaaatcggatgacatagagggacatatagccaatttgaggttagcttttgagaggatgcgtccgtatgtattgaagatgaacccactcaagtgtgcttttggtgtatcggcggcgaagtttttaggattcatagtgcatgagagaggagttgagattgatcctaagaagatagaaaagattcgtgatttcaaagcaccgacatgcaagaaagaagttcaaaagttgctaggtaaggtgaattatttgagcagatttatatctaacctagtgggtaaaatcgatgcttttgtccctataattcgtttgaaaagagaagccgattttacttggggggcaaaacaacaagaggcgtttgaaggattgaagaagtatttatctactccacccttgatgcgagcgcctaaagccggaatgccgtttcggttatatattgccgccgaagacaaagtcattggtgccgttttgacgcaagagaaagatggcaaggaatatatcattacatatttgagccgccatctttcggatgccgaaacgaggtatgtctttatagagagactttgtttatgtctatactatccttgtaccaaattgcggcattatttgttatctagtgcatgcatagttgcttgtcaagccgatgttattaaacacattgttgcaaaggccaattttaagtgggagaattggcaagtaggcatatgctttgattgaatatgatttggcttatgaaccattgaatctatgaaaggccaaattgtagttgattttatagtagaccatcatgtagatattgcttatgaggaagaggtttgcttgattgaagttataccatggaagatttattttgatggtttttcttgtaaagaaggtcaaggtataggtgtagttttgttttcatctagtggcatgtgttatgaggcatcggttcgtttggaatattattgtacaaataatcaagccgaatacaatgctttattattcggcttacaagtgatggagatgattggagctaaacacgtggaagcatttggtgattcggaattggtggtgcaacaagttatcggagcttacaaatgtttggacgggtcactaaatacgtatcttgatcaatgcttgaatattattgctaattttgataattttgctattagacaaatgacttagcacaacaagcatctggctataatgttaagaggggagtatttctgatattagaacagccagtgcttgattttaaacctttgagtgaaattagcaaaatcgtagaccaggggtggtcggaccgacgttgcacggccagtctgaccggtgactaggggcggtctgactggccgtataccgtcggtctgaccggccaccccgagcggtctgactggccttgcatggccggtctgaccggttttgggcagagagctggggggcacgttataattgattcaaaggccaaattaattgtaaattcggacatttgtgtccaggagacagaagaagattggagaattcctttgattagatatttgaaagatcctacgcttaaggttgattgaaagattcggcggcaagcgttcaaatgtacattgcttgatggggatttatatcgccgaaacatagatgaagtgttattgaagtgcttagatgatgatcaatctaaagttgctatgggaaaggtacatgaaggaatttgtggaactcatcaatcggcccataagatgaattggttgcttaggagagaagggttctattggccgaggatgatcgaagattgtttcaaatattatagaagatgtgaagcttgtcaacggcttggcaatgttcaattggcgcctgccgccatactgaatcctatcatcaaaccatggccgttccgaggttgggctttgaatttcattggtcaaatttatccttcgtcatcaaaggggcataggttcatgctagttgctacggattacttcaccaagtgggccgaagccgtgccgctcaagaatatgactcatacggaggtaattgactttattttgaagcatattgtccatagattcggtatcccgcaaacattgactacgaatcaaggagcttcttttatgtctaaggaagtgaagagttttgttgaatcttatggtattaaattgttgagttcttctccttacaacgctcaggctaatggacaagcagagtcgagtaataagacgttgttgaagctagtcaaaaagaagattgaggaacacccaaagaagtggcatgaagtgctttctgaagcattgtgggcgcataggatatccaaacatgg

SEQ ID NO: 57519 - DNA, 12125 bp, Oryza sativa
cgcccaaagaccaaaacatgtactatgcttttatattcacgttggtcatcaaaaaggcacggggcatgtgcttacacccaaatttggcacctaggattaaaatagggaaattgccaaaatttggacgatctaccgatttcctctgagagggccagtctgaccaccgtgtgttggccggtcaaaccgctgccggtgggccagtcagaccgccggcatgtggccggtctgaccggcagagtccgagtcagactccgtattcgtcgggtctcgggtttccttgctcgggaaggtatgtttcgtgtttccatctgtttctagctcgagttggacatggaggagggcctgtagagggcaaaaccaacccctatataagggacaaggccggttcaattgtaaacaaacaatcaactatcaatcaatcgaatcgttattttgcttttgtttctagttctagtttagtttgtccatctttgtcgatttgcgccgtaaatcgtccgccgccactgcgagagtgcgacacctctttgtaggtttgtcctgaaaaccttccgttttgctcacgagacgggtatttatccatagttctatctatatcggctccgctagctggtttagtttatcaaaacccatcttgatttagctttggctagattgaggtggttggagactctaagatcaccgcaaggcgtttaggtgctgcgatcgtgcttgtcaacttgttacaaaaagttgccaacatgttggtttaaccttatctaggtcttaagtggaaaattttaggatttctaaataggaaaaaagattcaaaagttttagatgcaaattttgttgtccaatattttgggtatgttacaaacctatcccccttaaaacaaatgtaatccccgagaattggtttaggttgtggttggaaaggacggccgcagtgtatgtcagctcactaaaggcaccattctactcgtgaggtccttgccgttggtcccccggtaggtttgtctttggtggagatggtttgggagccaatccgcacccagatgatggaaagctacctaaggtttcgtggctatgttactttctgataacatgatatgatttattgatttataagtcttttcaaacataccagatatagtatatctaacaaacaaattctacctaatgttgctactagctgatcttcccacagtccctccttctcctaaaggaatgggagatggtgataccccttttaagttgtattatttaacttactgcaataaaacaacagaaagcccttgcttggtcgagggcggagcggtttctacttggtagtgtcatgtacagtccgtgaaacatgcaattgatggaaaagtagcactaaagcagcgaagtaattgattgttaggtttcacatcttctctaacatttaaagagtgctcaatcacctctctaggaataccaggcatatcagatggttttcacccatctttgtcaacttgatattgcgaaccactgggtctagtaccgggggtaccgccccgggtggaccactcggtcaggatgatccgagtggtcgaacatgattgatacatcagaccaccattgatattgggtacttcgagctgaactgcattgatttctctgtcgattagcttctgcttcctcttggactcgtaggcgagtgaattgcgagagtgtagatggtaagccctgactcggtttcagtcttaccgtcatacttctcaatcccagtgggtttgaaaccactcggccaattcactcgatgcatgtatctggtgaaggctacaactccctcatcaccgctgtcgggagagtgtcggggtcaatagcggttgacattgttttctctctcgtggtagtgctgattgagagtgttccttaggttgctaggagctagtgccctgaagtgctctgatagtcggaatcagccctgcgatccctgttgtaataaggggctggttgtggtgaccagtcggcgtgtcggccgactggtcttgacgccacgtatgttcatggcattgatgagagttggccctactactctcaggctctcggtaatttgtaggtcgtaatggcggtaggcggctgccgataggggtctgtgttgtagattcgttgccttgccaactgcttccggagctgcgtgggatggaggccgcgaccatggtcttcaccttgttcaagattggcgcgacgttgactggagcggcatctaagacaatcaaggtaacaaccatgacggcattctgttgaggtgtaaggaacacattggtgtcgtcaatgcgtgtttgacctataacctggcaaactctttgcccggcggcggccaactcccgcagtctacaatcttcttcctccttgcgcttgcgctcttcctcttctctcaacgctctaatctgaccctttccacctcagcaattctctaggccatctgtgtgtcggtctcgacattggccatgaaaacgttgaagaagacaggggtgtatagccatcgttaaactcggagctgtctacagtctctatgctggcgtcgtcgatcttgtcagaagagctgaagtagtcaacgatctcagtagacgagcaagatccaagtggctggagcaggacaccgacctccctgtagcctgatctgatttgagccgagactagattagatcgggaactacagggggaaacagatctagatccaaatgtcacttcgagaaggggtagaagtcgcaaggtgattgtatgccggcgtcctatcgaggaggccacgcgaaggagtttttgttgaagattcccccgagcgatttgaagccatctcgaagaaagaaactttggagtagatctcggctgcgtttgggagtccaaatggagccgagtggtttttccgtcccgactggttcgaatccgagtcaaggagaaaaatgttgccgaagtcgtccatgatgaacttgaggctaccgaagcgaaacacctgcccaggagagaagacgaagtcatcgatacccgaaggagaatccatcgcacttgtcagcgagaaaacttgatgcagcccctacctagcgcgccaactgtcaaaactagaattcggcaatacgaaaagtgggttgcgcaaagtatctaaggtggatgggtgatgagacaagggtttatataggttcaggccttctcgataagaagtaatgccctactcctgtttggggattgtatccgttggttgttgtattgatctgacgatcttagttccttatatagacggaggagacaggtttataagatagagatttaagttaatatggtttaaatctcctacaactactttacaatcttaccgaactaggactacacgtcatttccttgatacacaagtaaacataatacccaagtcttaattctttacatattctatatacataatctatcccttataactagtcggatagtgtagccgtgtaggtacatggtaaccataatcttcacaggtctactgggtcttcttcagcttgagagatgcgctgcaagtaagaaggataaaacagtgagcaaacaatctcatcgactaaagacggttccttcttttgtgtgtgtcgtggtgttgttggttatatgcactttgtgcagaagctgaatgctttcttttgcctagtgaaattaccattatctaggaaatataaattaaaaggcggttctatttcactggatgctactaaattttataaactaattcatggcaaccatgccctagtaaaatatttcatctgttgtaaaagaaaatgtgattctctttcaagcagtggtatacgtaaggacagttttttttttcctttttgaagatttggtcagagtgcattcagttgtaattggcacctatacacgtgtgggcctttggatccactgttggcaagctgcaactctgcagtcatgtatcaaccaaaagaacatgtatagaaaggtccttcggtgcaatgcaacacatatgagacagatattagctatggtactactatgtatatatgcacggaagtttacttagaaactaatctgggacttaccggagttgaacaatgggaaaaatgttagtgggaaaattaagcaaacagttaatttcgtagatacccctcaaaaaaaataatttcgtagatatgggagacaatgtttctgttcagatttcaaatgaggcctatgaacaattgataacaagtgaagaaaatctcacatatacctattgatacagtatcttttccctgttggtcgtggcccatcatcaaacacgtgccccagatgagcgtcacagacagcacacagcacctcagtccgaggcatgaatatgatggacatatcaagcttgcactttacattatctccaatgggttgataatatgacggccacccagtaccactatcaaatttggtcgatgacctaagaccaccagaaagcagtaatgcagaataatgagcagactataatactattgttttggtgcaaatcgaaactactatctctagcttatatgaaagaacaatcttctgctctgacatgacaatcaggaggagtgcttactcaaaaagaggggtgtcacagcagacacaatggtagatgcccggggttttggtgttccagtattccctgattacataacaaaaaacacaagaccaaaatgacatggtgtgcaactacacattatacttggattagagtgtaaagcaatcgtacccagtaaatgctctttctgtgcccttctgccgagtaatgtaatactgatcttttgtcaggcgcttcctccactcctcatcagtcagagatgtactgtagttcggtttacctgcctcagaagaaatgaatatttggctattagtgagaattgaaacaattgttggaacctggctacatacagatctggagtacttcagagttaagagcgtatgataaaaaaatatcttcaagccaggcggcattctaagcatttgctccataagaaagcagaacatcaatgcattattctcttaaagatttgctccacattgtgaaccctgaagatcaattgttctaacaaactataaaagaaggagctgctggcatagacaaaatcgatactagtcagctcagtgactcactgcatacaaatgcttgtaaggctctaccaggatatagcaagaatgcacaattctcttaagattaccttagatttgtaactgatgtgtgtttatactatatgttctgtactctgaactaaaacacagaattcttttctttctttctttctttttttttttttgtctttgaggtacacagtccgaaattcacacctataaagaatgtccgcactattgactggtgaatacacttgtgagtaacatataactgtttgaatgaaaatagctaaaaccactcaggatctatgtagctaacttataaaaatgtcttagttgcaaacttgagcgggcaataggggcttcactcccgaattacggtctagtaattttctaaaatgttcttaaatgcggaaagaattagacatagaaacggcctacagcagatcttttaagatcaatcaaactccctccttgtttgcatcgaatgcacatacaaactaatcaccattaattcaatttctatttccactcgcgaataattcccttgcatccaaaggaagcaggcaacaacgggctcccactaggtaggtaaagaagttagaaggtgaagcaccacacggcaccttgggcttgggcttgggcttgaccctgcggcgacggagacgacgacgacgacgacgaagacgatgaagcggcacccatggcacgaacggaggctcgcctgtagctagcacggctccacgccacaccacagcaaggcgccaaggcaggcggcggctgggaggcaggaggggcgcgcccgtggacgtgctctgaaactggaggaggcagcggtagcagccgcgtattgccgcatggccattttcttcggctcgagaggagtcgcgtcgtttggcggacggaccgaccagccgggcggatttgcctctgcgagacagagggattccgtggctggcgatgccgagacgtgggtgaactggatcggcacacgcagaagctgcagcaggcacgagcgttccagtctgcacttcactggaccagtccgtttcaattgccaaacaggggtcgcaactcgcacgcccacgccgccacgatccatcatccggccacccgggctatggattgtgtggcgtatcaaaatttctgtcaccaaattcctgcgtgagctagatgcaaatagaactctacgatcaagcatttatgtcaaaatttgtatggattaacagttttagctcaaaacatacgatcaagcatttctgcaaatgtgtgtgtactttgttcatagagtgaattgcaccagcggtccttaaactcataagcagatttcacctaggtctacgaacttacaaatcgcatatcaagatcctttaacttggtttattgtatcattccggtccaaaacttcattgaccgtggtcttgcccacgtggcatgccacggtggaccatcggtggtcacatacaagtgtagagaccaaccaataggtggggcccactaaaaaatcccttttcttttttctcctccttcctgttgctgacgatgatgagatcctagggccgcctctcccctcctctccaccaacaaccccctatccaccggtgagctagtgagttggctgtcgctaactcgacctgcgcccacgcagggtgagagaggaagcagccgcccggtggaggagaaatgctggaagatggggaattatttttctcatctactccactgacggcaacgacgacggagaggaggggaagaaagaggatccccggccgcttgaggagcctcctcggtggccgccattgttgacggtcgtcgtaaacaaatttcgactgtcaatataactaaaataatagagaattagcttatacttgcaatacatatttgttttcaaataatatagttccacttgtacaaggagaataacatgttgaaggaatttatcaaataaaataaagagaaagtggagagaacctcactcctaagcaagcaaatggataaggagggcccacatgacaggtgtaaccgccgaaaaccgcctaatctgccacaaccgtcattgggacccacatgtcaaccaccctgccaaacttgggggcctattgggctagctcaggttcggccaaaccctagcaattgcggctccagctggccttacacgtgggcgtctaggatcacatgctgatgacggttacgagggtaaaatcgacatttcgcatgccagtaaccgtcataccgaccctataaaaagaggagctcactttacttcacaacacactcaagcaagcttaaattcctcttcatacgttagtattagtattttagtgctaagtggagtagaatataatagtattcggagtcctcggagtcttcggaagagttttggtatggctcaagcaacttttgtattctcttctataatactttcgatattaatgaaatactcttctatatatatgttgggttcttactttatatctgtggttaccaattgtgtgggtagcctactagagaggtgcaatggtgcgggtttaatgtctaatttatcaattgctctatgtcatgtgcacgggtgtagagtagtatttagtaatgtaagcatcgtgcttagattattaaatatcattaattgggcatatatcctacgggacagtagagatgggccgttgatagtgacagctcagtacggatattccttcacgttagtatataatcctaagacaaattattggggaggatactcctccgtatttagccccagttggacggccatgacgggttatcgtaaggaactcggcaacccgaggtggtctctcgaagtaccaggagggcactgttagggggtattggccacacgattgtatactagcagatgtaaactaggatttgagtggatactagaagtataggaattgaatgctttctctttcttctttcacttagttagaattactttattatgaggatttgatcagcttcgtgtcactctacccctaacttaacccctgcctagactttgacaattacaagtaatatatgtataaagtgcattagcaaagttcactcttattatcttcccttgggattaaaaatatgttaccttggaatacttctgggcgaaatgctacaatggtatatccgtgcacttgcagattacttctgtaatcataaatataccaggactatttctggtgtcattgctgggaatgaatatttctagtaatgtcgttaagaaataccaacagtgtggctgtaccgggatagtgtaggtggcgaccggaaggccgctgctacgccgcaagtgatcgccggtgaccccttcaggatcaagctggcgttcttactgctacgactacttcccctacgccaatgatcgctggagcagttcgagggacttcactagggatggcaatcgagcgcgacaggcacaggtagtgcctacccatacccgtgcccgtgagattatttgtacccatgagtatgcccattactacattacgggtaaggattgttgcccatgcccatcgcccgtgggcgtgcccgtttacccgccacaacaaaagcagtggaacaaaaagtctacaagcttctaagttcgaatcgaacttaaaacatcaaatattctctgccttggtgtagtgtctctcctctggtggcgatagaggaacggggagagaaataaaagggaaaccgtagaaaacaaagaacgtggcttatgtatcctagtggattttgctcctagcctacatgtaagttagatttcgcgggtaaacgagcaaagcgggcatgggtagtgattacccatacccatgcccatttacccatcgggcatagcttttgacccaataagaaacccatgggtataaaatggagaacaaacccaaccctaatagggtttttatccacgggtaaacgggcaaatgggcacaattgccatccctagactgtgccctctatttccactccggctgacggcattgcagggggtacaaggaaaagcgcatcaatggcttcaaacaacggttagtaaccctaagaattccgtataagggtgatcatatttagacttagcactcatgttagtagattgcaaaatttacatttaggagtacacatttctggttgtatagttaagggacctaaaaaaatctcgctaataagtgaggacctccggtgaacttatttccacgcaatatactaggaagcgggccaggctgttccggcaggcccagccgcccaggcgtgccgatgcctccggggtccgggccaccgtaagcgggtacgtgtccactgtccagattcatccacacctgacccaggcacgcagacaagtctaggttcgccgtcgtcctcttcttcccgacgcttcatatagttgcctcgtcggcgtgcacgatcccccgccgatcaagctagccggccagccagcgaagcagctccggtgctacttcttgcctatacctcgcaacttctctcatggcggcggcggggaaggagccgagcagggttctggtcatcggcggcacgggctacatcggccggtacatcgtcgccgccagcgcccgggaggaccacctcacctccgtcctcgtccgtgaccggcgccggcggaccctgccaaggctgccgtcctccagggcttccgggactccggagccaccctcgtcaaggtcagctgccgccgctccttcctcgttctttcttttccccatttcgtttcctgttcatatgatgaattctgcattgtattatccatggtgaggaagtagtaatgggacaagtgatttggtttcttctatctgtcaacgaggattgattttttaatagatttgtgaaagggaaggaatgggagttccaaaagtcatccaacaaccttttcaacctgttcatttcagtaaataagataagaaaaccagtgtggtgatacgtggattagtagaatactatctccatttttaatagataacgccattaactaatgtccatttaaaaagattacgtaatacaaaaattttaaataagacgcatggtgaaacatgtccaaaagttaatgacgtcaactattaaaaaacagggggaatagtaaaatgttcagaaccaagtagaggttatggggtttaaatcattgctttgaaacatgactcaaagtaacacttttaaaaagaaactgcttggactttcaagatttcgtcagtgttcaagccacaaactaattgtctcagatgcagacagatgttcaagttaaagcttgaattctggttttaactgggttgtctcactgcgtagtgtgttatgatgtactaatgtgcaaaaaagatcttctgaaagctcgtggtctagtacaggtaaaatgtcatagagctgattgtttatatgcccttcttgatagtaagtgcagttgtcagattaaacagcaatgatatatctcaggttccacaatgattagtttatgcctcatggtatgatttgatttgatgctgacatataaaagttattcctttgctggataattagggagatctttatggccatcaaagtttggtggcagccatcaaatctgctgatgtggttatctcggctgtgggttacgcgcaactagcagatcaaacccgtattatttctgctattaaagaagcagggaatgtgaaggtgaccacctaaacttacattacaaacatttcatggctgttatacttcaaatttctgtatgcattgaagagtatgtcgttcatctatcatgacttgtgatgttgctttgtgcattaagatagccttcatggatgattttgaatattaagttgtgatatcactagccttgtttggtacaaataaccctgattctaattaatagaggttaatatctgttttctcttcccacacaataaagctctcacatgcaaacaatttaatgctggatgtatttttttatattttctcgaaactgtggtgagcttgctcatttgaagaatccttgaaaggtggcttaactatctagtttccatcattccttttgattaatgtggatagtattgtgcagagattcttcccttcagagtatggtaatgatgtggaccatgtacatgcagttgagcctgtgaaatcagtgtatgctacaaaagctcgtataaggcgtgtaattgaggctgaggggatcccatacacatatgtctcctcgaacttctttgctggtcgtttcttgccaagtctggcacaggcctggatcaagggccttccaaccgacaaggttatcatccttggtgatggaaatgtaaaaggtaaaactgatcatgtgtgcttattatgcttaccgtgtgttgttttactgcagaagatctctcttttttcaacgagatataaattgaacaagaaaaaaatacggacacattgcaatgcatatattattttttttattttgtcaaaaacaggagtctttgccacagaggaggatgtgggtacctacactattaaagctgtcgatgatccaagaaccctgaacaagatcttgtatctcaggccatcaagcaacattttgtctcacaacgagctcgtctcactctgggagaagaaggttggcaagacatttgatagggtgtacatcccagaagatgaagtcctgaagaagattcaaggtgagaatcagccatgttctctcaagtgcaatacttatgttcagtagatgcttatccctattttttcctgacatttgactttaattcagaatccccagcaccgttgaatgtcgtactgtcaatcaaccattctgtctgggtgaagggggatcacaccaactttgagatcgagccttcatttggagttgaagctactgaactttaccccgatgtgaagtacaccactgtggatgaatacctgaacaggttcctttgaaatctgtacaaatcctacaaggctcgaatatataaaatatggaatagatattagacagtgaaagttgtgtttttcaataagcaaaatttaattttgtacaaaacgctctagagtgtaacttattgagaacagtgatgctggtgctgtctttgctgccaccgccagat

SEQ ID NO: 57520 - DNA, 15152 bp, Oryza sativa
  unsure (1)..(15152): unsure at all n locations
gattgggttttttatgggacggagggagtatgcaagaaggtggttctttcaaagctcagctgagggaatatatgcaagaagatggttctttcaaagctcagttgaggggacctctcagttctggagagggctccacgaagtgaaaaatttagtgtaatatatgtgttgtgagaggaatgtgaacaatggggaggcacaattctaggaatatgtgtggatgggagagttgcttctttcggtaggcttgttcatgaatttctgtagtccaatcaatattttctttttagaaaaaggtatttgaagtaagaatgtcttatttgaagcatgctatactaactaactaattaatggcatgtggccttattgctgatggtcatgtactcatacgtgttagctgcttcagagaaagatccagaaatgaagtgaaaccacaatgatttggcacacaacttttttgaatcagatgtagatgttcaaaattgagagtgtactgatgcctcaatcatgttgataggtaccctaaaaaatactgttaatagtttgatacactggaaagcgagtataattgaggttaccgtatttgtaatttgtgatatattggcatatgcatctggtgagaaacaaagagaaaatatgtatgcctcaagctagaacacgataaagtaccagaagacaatcaccttattagaagagagatgtccttgcacttagtaaaattcatcgagtgttgttatgtagtgggtagtattccgatgtaccaataaatcttcagagccatctatatatacagcaaaccgattaacattgtgcgtgctctcgcgatagcctaaacgagtgacccctcctttaatcaactagatggataccccgcacgttactgcgggaggattgtgtgataatatagtagatatgagttctaaaattttctctttttttttacctttatacaactgttggtatttcttaacgatattactagaaatataattcctagcaatggtgcagaaatatttctggtatattatggttacagagttcatccgcaagcgcacggatataccattctagcatttcactttagagtatttcaagggtatcgtatttgtttaatcccgtggtaagattataatagagagaaccgtactaataatttatatattacttgtaacaaccaaaagtctaagcatgggttaatataatttagagggtagagtggtactaagtagaagcatttatactcttattcacaattatctaagctaactggaaagaatatagaaagatcttattcctatacttcatattatacatacatattatacatacatcctagttatatccttacttatctaataccatctttccgatgctctcctggtgcttcgagaagccatccctgattgctgagttccttacgacaatccgtcatgaccatccaaccggagctaaatacagaggagtaccctccccaggaaattaacttaggactatatacacgcgcggaggaatacccgtattgagctgtcaccatcagcggcccacttcgcttccacagcatataatcctaaatgatgatatccagtaatttaaacactacgcttaaattaccaaatactactataatatcatcgtcatgacatagagtcatcgtatacacgatcattatacccacaccattgcatctcccagataagctagcattataataaatataacttgcatatataataaagttggtattcatatactcggaaagtagtacaataccaaagtagtataaagaagaatattctaaataaagtacaagtcttacatccataagtctgattctcgacatcgtccgattgattgatcgtctattttgatgtcgattctcctccattctaggttcattctttgcaagaggttagtaatcctaaagctagtggaatatttattattaaacgtaaatatgcattgcaagcataactagttctcctttattttggtagtattgatggtcaaaactaatcgctaatgaccgtcaacaacaaccgtcctaaaattttctttcttacctactatacaattatttttttcatgtgtttatctattcttatacttttatcaattatcttgaggttataaatgattacgttgtatggtgtgccttttgggggaagagacgcaatttacacccttgatgaatcatccaaaggctaaaaacaattaaggtgatgtggcttcatgagagaagagagaattagcattaactacacttggtggggatgaactttatagatatataggatcagtgcacatacgaccacaagctcctttctaaaaaggtcaccgcgcaacaagaaaatggacatttggccacattcaaaaagtggtttcgctagaatgccattccgaaaacgtgtttcgctaaaatgacaatatgaagcgcgcaatcacagccactttgccattttctccattttcatcattttcaattccattttcactggaattcggcttggagggagcgggggaggcggaggtggtgggagattggggcggcggtgacgacttcgtcggtggtagtgctggtgaggaaggccgccgcggagagccaccacggtcttgggcagccgcatccgccgccggacggcgccgtcctctgccgaccacttctccgacaacgggcacaggcgacggcgcgacctctggtgcccgctgccaccaccttccccgatgatgacgagcttcggctaagttgataaggggcaattttgtctcatcacctagtagaggagagaaaatctttttgaaaatgaataaaatgataaaaatggcaaagtggcggtagacgcacgctccatattggcattttatcgaatcgcgtttttgagatgatattatagtgaaaccacgttttaaacatggccaaatgtccattttctgccgcgcaaccctccccagtccccgcacacgccttctcgtgagaatgaaccgtgtgttgtgtgtgcttttcctactgggccgatatgaagcccataaacaccacgagaggaaaaaaacatatggggagctagggttccacctcgatccaaaatccaatggacaaaataatattcataaaaaaagaagtacaaacaagagtcaaaagcaaataaataagctccatcctgagacctaaaaatgcctcctagtttcaagcttatgtacattccatcacaaatttcatctccttttctgatactaaaaaaaatggtgggaaaaaggcaagttatatagggagaaagttatttctaaattatgtaaaagttactccctagaaatatataagttacttttcaaactagtttaactgacttccaaaagccctgaaaagactgcatcttctaacatgaaaaaaaaaggttatgttactcgttttgcatctcttcatgtttatttgtttatactggcaaatactccctctgtctcataacgtaagactttatagtattccatatctatatagatgttaatgaatctagacacatatgtatgtccaaattcattaacatctatatgaatgtgggcaatactggaaagttttacgttatgaaacggaggaaatacatatctacggtagggataatagttacttcctagaatcatataagttacttttgaataacacatatttagcatcataatatcttgcttattacctatatagagtattagaaaagaaaatctgagataagtttactcaatgaaaaccatccatatctgtcgacgagtgatactagtagaccggatgattagggtattgggatacattggaacgaggatctaggtaacacgacatcaagcaagtagaagacaaggattatactggttcagaccccttatcaggtaatagccctactctaggggattgatgatggaaaactacagattacaatggaagtagacgaaatcgatgataccgataagatcgtagtcgaggtattcgacgagatctcctggcaacttggcttcgcgtactctggcttcgtaaactatggtgggtgtgttggcgatgagattcgatgccttgcacccctccttgggggtcccttttataccgtggattatcttgatctccaagtaagactcggagacattggatcttatacgatataacagaaactctatcctctccgagcaggactttggaaattgcttggctcgtagagatattttccataatctgtaacaaattcctacggcgtacacgggaacaatcgatgtacgtgaaggtatgccatatccgtatattttataactcataggatataaggtatgccttatccgtaactatgacaatatctttaacatattgacatcaaatcatgcacacaaagcgcaaaaaaaaatgcatcgtgagactccgatccttttattcctaaaatataaaggattttggaagaatatgatatatttgtaaactagatagtgtgtcacatccctccaaaatcttttatactctctccattaaaaaatataagggattttgggtagatgtggaatgagttggaacatacttcatgtctagatttattgtattagaatttgtcacatccatccaaaatttcttatataattggacggagggagtactttccatcaaaatcttcatttatttattttataggatcatactccctccgtttcatattataagtcatttgattttttttctagtcgaactttattccgttgaccgattttatagaaaaagttaacaatatcaaaaatataaaattagttttattaaatttaacagtaaatatagtttgataatatgtttattttatgttggaaaaagtattatatttttctataaactagaaaaatcgcccgtgcgttgcaacgggtaaagatgttttttcaatgatatactaagagctgagtaaaaaactgaaaatattgggatcactatacattataattgaaaaaggtaatgaaaattttaatattgggatcgctatatattacaattaaacaagttaatgaatatcttttctgggttttggccgaaagccttccttccttttagccctaggcaagtccgctacctccctccgtttggcctacttacctccatttggtctgcttccttcgacccatcaaatccctccctccatttggcctgcttcatttgactcatcaaatccggccgaatctttctcgatcacccaaaattggttgatgattttttatccactcgatctcctatttccctttttgtcccnnnnnnnnnnnnnnnnnnnnnnnnnaattaaaaacgataagggaaaatcgccgtcattatcgacaactgttagattaaatctgaccaaataaaataaagctgggaaaatcatggagaaaatgataaatgaggagtgggaatcgatttttttttgcaatcaaattagagtagaaaacacacgattgatatggcgtcggtgcagcgccagggttcaactcgggagacgtgcacagaataaattggattaaaaaactgagtgagaaaaaccaaaagggagaaaataaccggtgacaaaaaagttgacgaaaaaaccaaaaggtccgggaggggcggtgaacagatcggatgtaaaaaacggaaaaaaaataatagcacgtgcgggaaaaaaaaactctttcgcgtgaaagaaaaagtcagaaaaataccggtgaaaaaaaaccaaacggaattttttttactggcgagattttttttttcctttttttcaatggagtcggacgatttttttttttcaatttttactgacgcgcggcagaagcttttttatcgcttctgagtcggacattttcttttcctttttttacctttttagtcgcactattttttcctttttttgctcggccttttttttccttttttttttactcggaccttctattttaccggctatggaattttctcgtactttttaagtagagatagaaattaagaccgtaacataaaattaaaaccatatttgatataccaaagtaccggaaaaacatttttaatttttataatagtagagatttaagttaaacttaaaaaaattgactaataaaatacttcatccgttttataatataacactttttagtgttgtccatattcacttagatgctaatgaattgtatacatatagattcattaatatttatatagatgtgacagtgctagaaagtctttcgtcgtgaaaggtgtggggccagtgtcctgacacgagtgccctgggcctgcagctcctccgtctcaggcgacgtcggaggcagagctccagtcctcgatcgtctgctcgctgctccggcgggaggacgaagaggagcggcggggttgggggtgctcccgcctgcccgcccgccggccagccagtaccctatggcagcagcttccctactatgccatgttattgctagatccgcccctgctggccggagccgccgctgcctcctccactccgacccccacaccgcgcaccccctcctcgtcgccttctcccgcctctgcgcccacggcccgctccgcgacgcgctcgcgctgctcccggacctcgccgcggccgggctcacagcggaccccgtcgccgtctcccgcctcatcaagctctgcgtccgccacggcacacccagcgatggccgcctcatccaccgccacgttttcggcggcggcgatgtggcggcgccctcctgcagcagcctctttgtctccaactccctcgtctccttgtacgccaagttcggcctgctcgacgacgcactcaggctgttcgacggaatgccgcacaagaatgtcgtgtcctggacgaccgtcgtcgctgcgctggccaatgcccgcgggaggaaggaggacgcgctgcggctttttgtggccatgctcagggacggagtggctcccaacatgtacactttctcgtccattctgggtgcttgcagcacgcccagggtgctcgcggcgatgcacgggagcatcgttaaggttgggttggattcggatgtgtttgtgcggagctccttgattgatgcgtatatgaagtttggagatttggacggtgggcgtcgtgtctttgacgagatggtaacacgtgatttgatcgtgtggaattcgatcattgcaggattcgcgcagagcggggatggtgtcggggcgatagagctttttatgaggatgaaggaggctgggttcttgtccaaccagggaaccttgaccagtgttctccgggcatgcactggtttggtcacacttgaggtggggaggcaggttcatgctcatgttctcaagtatgacaaggacctgattttgcataatgcacttcttgacatgtattgcaagtgcggtagcctgcaggatgcagatgccttgtttggcaggatgcctcagagggacgtgatctcttggagtaccatgatctctggtttggcacagaatgggagaagcattgaggcattgaaggtttttgacatgatgaaatctgaagggcctagaccaaaccacataactatggttggagttctctttgcatgcagccacgccggtctagtggaagatggttggtactactttagttcaatggagaaactcttcggtattcaacctgagagagaacactgcaactgcatggtcgatctacttggtcgggcagggaagcttgatgatgctgtgaagttcatccatgagatgaactttcagccggactcagttatatggaggactcttcttggggcttgcaggatgcacaaaaacgccgatcttgcagcatatgcagcaaaagagatccttagactggagcctgacgaccaaggtgcccgcatattattgtcaaacacgtatgctgatttgcgacaatgggcagatgctgagaagtcgtggaagatgatgagagacagaggggtaaagaaagatcctgggcgaagctggatcgagctgggtaagcaggtccatgttttcattgctggtgacttgtctcacccatgttcagagagtataattcaagagctgagccgacttttcagcagggtcacaaacctcggttataccccccagacagagtttgtgttgcaggatctggcaactgagcagaaggaagatctattgaaatatcatagtgagaagctggcaatagcatttggaacgatgaacgcgatggaacggaagcacataatgatcatgaagaacctcaggatctgtggtgactgtcatgcatttgcgaagctcgtctccaagagcgaaggcaaggtgatcatcatcagggaccctgttcgtttccaccatttccaggatggagtttgctcctgcaatgattactggtagggatgaccggcactgtcccccattcgcaaggtgcaacgaaggttagcagtgagtagtgaccacatcaaaggtctgatttgaaaatgtctccaaaaatgtcctgtccgtgtgctattggctggatgcacatacatgtcagcatacagcactggacaacatgtacggttgtacatgttactcctatcacatcaactccatatgttctcctacagctgatcctgagccacatctagatttcagtggaagtctgaaagaggagcgtgagaaagaaagagctaagctagtcgaaaggaggaaaaagaacaaggacggaatgcaaaaaaagggagaggagaaagagaaaggcaggaatagaaaccgcagccatagaaaagagaaggcctgctggccagccttcttcccccctcttccagctcatccaagccagcagttgtcaatcattttccccccgacttggaatctctgcaaaacacatgcacctataggcaagtcaaaagacatttcattatctactgtatgtatgttcttggaaagaaagtttgctttggatatacatgctaataatatcttgatgcttagcaaacaataatatttggtactccattttttcattcttgccatatgtttgtattcagccaagttaggtcaatatgcttgaattctgggtggagattattgtgggtaaaaaaaaaatgtcaaatgcatgtgatgtatgggtatctccacagttagcctagggggctcatataatttgacaatgagtatggtttccaggaatagctcatgttgtcaaattgattcaaagtacctatcctaatatcctatatgcataaagcctcttgacatgttggttaattattttcctaatctaggggagagcattatgatgtaatgtaaactctataaggtaaagcaactcagagcatcaattatcttggagttgacgggacaccagcagtttttggtgaagttgacaaccaatatgccatgatggttatttatctgaaccagctgaagggctacagagtccaccccagtagcagaaaatgtgccctttgtccaaagatgataggactcctgttagggatctttcaagtagaattgctgggatgtgttagattgaacaaataacagttgatagcgtaaaagaacaaaaataaagaagtttgcctgtggcctaggggattcaaatactttagtccatgtttaatctcttccctcttcccatcaggcttgaatgcttgatcctctgagaaccacaacacaaatgtctccgtgccatcctatttagctttgcatatgcttcttaacatcccaagatctacgatagatgagagaaccaccatcaagcataccatttcagtacagcaaagccctggaattatattaccaagttgtcaagttaaatacgctatgtgttcctgccattttttttttacttctttgaagttagtgttcattttatgtttttgtatttctaccataattcatctgaattctctttgacaggttcaagggaagtggctgtaaggtcatacatggtgcgtataatgatccatgtgtaccctgctatgtagttgttatgacttctgagatgtgcttgggtatcggacatggttaatggcttgtttcaagtttcatataatttcaagtttcaagttatgataaaacagtgataagatcattgccagttaagactgaaataatgtgctgaaagtttgtctaatttttgtgaaaactgaatcccgagggctcttcttcctctgctattgattttgaaggttattgtaaccatctgttgatgaacaacgacatcatgaagttaacagagtatcagtctcctaacaaaaccagtaaaatgagttctgttatttgccttttctttctaacgcagagcctgtttatgagccaacttcataaattactaggctttcctggatgatcggcctgttacgaatttgtgttgcgcagcatgattctatcacttggtagttctttccttcgtgaaggtgtctacttgacttgttggagtctgcttctgtggatttagataactttcacccgcatccagattccatttcttcctgttatgatagcatgcatatcacatgtactcccttgtccctcctcataaagtctgttgttctagcaagtcaaaagcgaattaaacaagagattcaaaaaatcagagcaacaagaagaacagagtattattgattcggttactgaaacgagggggaaaaaaagttgaactgacactatagataaacaaacaagattctctctacaaacaaaataataatgtgatctacagaatcctcccccaacgaggcgatcaggatccctctgatccagtgaatagtgaattccattccatgtgatgcgacgtggtaacgcggggaaaaccgcgctacgaaatccagcaagcggtccacagtgcgactgtgcgagcccgcgagtccccttcattccaaatcaaacgatgcaactgcaacggagacagatttatctattaataactgaagtctcaatctcaactctcctctctctgtctttctctctacccacccgctaccaatccccttcgctccgctccactcctccggatctccgccccgccccttccatctccggcgccggcgagaatggagctgctctgcatcgggacggcggacaccaagctggacgagctgctcttcctcgccgcccgcctccgctccaccctcgccgccacctcctccgcgcaggtgggctggcgctgctctctcgcccttctgctctgctactcaatttggttcccgcgcgagatgtagactcctagggaaataggggaatagggagtaggagctctatatcggtcccctcactttgttaatgaatctctattaggggggaatgagttagtgctggatgttacgggatgtgatcgtctaggatttgcggcttatacagtgattggggagaattatcatggtaattagcatgttcataggttatgcaatcattatatattacttttgtgcttagtattgagaaatgataatgcctcctcactagtcttgaaaagatgtttattattgtagaattatgcgttatttaagggtgtttagttttgggatttttactcataataatttaatcaatccatagtgttgtattaattgtttttcatttctctatatccttgcttagtcggttaagcgttatctacacttacaatgtaccatcccttttggaccaaccagaaaaccatgtaccgtcccatgcacaataccgaacataactcatcatgtaccatcttatagaacttctaaggaatgtgattgttcaacattgttgtaagaacacatttctgaaaaacttccagctatgatatacacaaagcaaagtttcagaagtaagaaaagctggtgaggaattttaagaaacaatttttttgccactgaaaacagcaggttgatagaaaaaaaattacaaagtatcttacaaatcgggactaaacattatttggatatatgaattagcaaaatgccacaattcatttaatggaggctgtagtgttttttttttttttgaaatagatggcaggagctctgcttattcattaaagaggagtagaatcaacaacattacacaaataacacttatcctgggctgcagacttagttgaaaaccgcaaagatacccttaacacactatcacttctctcacaacgcacactgccccaaccatgccatgccacgcgacagctgtactagcccaaggaaatgtgcatgcttgtgatagtgagtgcctgcttatagatcaaagtggtgactttgagggtgaatggctatggtgactcttagactggtggtggcagcatcagcatggcctccatagcaatgtgggactgccatgccctgcttgagcatattgtttgccatcaccatggccttctcaagcataaccctcatctcaattggcagcaatggctctattaaatggaggatcttgggtatcttggcagcgagatcatggatgattaattgctctgataccgaatactatgattactagattcatgaaaggtactcttcgctgggatgatagctaggcgacgttggggaagaattagttcctttgttgctttttcctggataatgagaggtggccaccataatgccatatatagtgagcctcttgattattttatataatagataaggattataacataaggtagctaattcttataaaatggaaattagagataatagagccaatcctttctttgtgccatatgcctggccttgtcttgcacatgctgtacggataaccattgttgtgttacatatcggaatggaaaattgtctgcacatgtggcatttttgtgcacagtttaaattgcttggctacttgcagaattttttcaattcaacaattttcttatgaaaagttacatgctccttggatatactgtagatttcttattttcctttgatatagtggtgcatcatatggtgtaatgacataacaggttcaagtaagccttgtggatgtctccacaactaagaaggtgacatcacaagattttaagggcaccacatttatctcaagagatgcagttctttcgtgtcatttaggtgtcgatcaacatgaacttcctagtgacagaggtgaagcaatcacactcatgtcagaggctctccagagctttctaaaaagaagatatgaaagtggtactctgctaggtgctgttggattaggaggcagtggaggaactgccctaattgctcctgctctaagatccctgccactcggagtgcctaagcttattgtatctactgttgctagtggccaaacggcaccatatgttggaacatcggacttggtgttgtttccttcagttgttgacatatgtggcataaacagtgtcagccgtgttatattatctaatgctgctgcagctgttgctggaatggtgcacggaatattaatggaatccaatgaatctgatgaaactgccacaaaaccaactattggtattacaatgtttggtgtgacaacaacatgtgtaaatatggtcaaagaaagactgagcaaagaaggttatgagacacttgtattccatgccacaggtgtaggaggaaaagcgatggaagaactagttaagggaggtttcatacaggtaccactttctggtaaattgtgatgataactcataatctcagttatcaactccttatgtaactggtagttgcagagttttttctttctcacatttatttggttgcatatagggtgtattagatataacgacaacagaagttgcagaccacattgttggcggtgttatggcatgtgatgatacaaggtttgatgcaattatcgacaacaaaatccctcttgttctcagtgttggagccttggatatggtcaactttggagctcgagatacgatacctcctgatttcacaggaagaaagatacatgtgcataatgagcaggttaagtataacaacactttccaatggtttttattcatttttgaccaaaatatgcttgcatgattattgctgaacttgtttcttcaggtgtattttcccttgtaatgcactatgaaggtataatcacattagatggttatgtcaactcagtgctacaacattggagaattatcagtaaatatgttattaaatttttagataaacattatacataatttactacatataatgctattaaggtttcaggatgatttattgttgtacagaatttgtatgggggtattttttttgttgcaaggatatgaaaatttccatctccttattctgtatgctgggtgcatttttttaaaatgtatcattgcagggcatttgcacaagcgttgtgttgtctaaaatgactctttagaagtccaatttcaagaaatattctcttatctcctgtaccattgtttgcgagtgctacatacatttcctctttgttacaatcagtaacaactctcttatcttacaggtttcactgatgcgaactacagtagaagagaacaaaaaaattgctgagtttatagctgataaaataaacaaatcttcatcgaaggttattgtttgcctgccacaaaagggcatctctgcaatagatgcacctaaaatgccattttacgatctggaggctacatctacgctgctggatgaattatgtagccgtatagagaaaactgacaacagagaggtttcctcatatttcataaattattgccttttatttttatctcttcaagtgaactaagctgttttagattattgacaggtcaagatgcttccatatcatataaatgatccggaatttgctaatgttttggtggacgcattcttgagtatggatgtaaaggcatctaatacaataagtccagaaaacagcatggtccaaactaatcaagatgtaaatacaaaagaatattgttcaacacagagaacttcagatagttctatcatatggagatctccagtagattttcctgatgcaagaccaggttagttcttatttgatctgcatatcatgagctaaaaacatttttatgctcacaaaggaaactgtagaggttatcaaatatctacatattctgattccatctacatgttcgtcgtttttatcatagaaattgctgcatgaggttattgaagttatctgatgctcactttggtattttctgttcagcgttactgaaacatctagtcggttgtgagagaatggttatctattaatttatttatgtttcttatagaatctgcagccaacatcatggtgctttcctcttttgttttatttacttgatttcctgatgaactactgt

SEQ ID NO: 57521 - DNA, 7569 bp, Oryza sativa
ccccactgttggccttttcgatggcaattttcgacagaacttggaagaaactggaatgggctacaggtgtgattaatcatgtttggattagtaaaatatattatcatcctggcttgaagttctgatataattcattgtttagttaattttctaggaaagatccaaattagctgcccatgagatcattaatccttgttctttagcatacacagcaattttctcaatggcttagcactgaattttccctcccacatctggggagaatttgcgttggattgtgtttaacctttttcatcatatgacagcttggaagtggagatgatctcaagagctcacagcatgggttttttgacgactccatatgctttcaatcctgaagaagctgctgccatggccaaggctggagctcatataatagtggcacatatgggtctaacaacagctgggtctattggggcaaagactgctgtcactttagatgacagtgtcaaacgtgttcaagccattgctgatgcagcacttgggattaatcctgacattattgttctgtgtcatggaggtacactttctatttttgataagtcgatggtcacttctcttttgcaatataggattggtctcattctagtacttgaatatggatatacccctatccacattcgtagtatccccacactaggttgttatattttatgacggaggtagtagctatcaacttatcattggatattttcatcaggtcccatatcagggccgcaggaggcagagtttatcctaaagcgcactaacagggtccatggattctatggtgcatcaagcatggagcggctaccagttgagcaagctatcacaaacaccatgagggagtataaacggatttccataaaataagaatgatagttcagacttcaaatatgtcctttgctctacatggtactgatcttcatactgattcaaagaacaataatggaagaggaagccaggtgtttgtgcattgttgtaccatatgcggcacatgtactcgtgtatttcagtcggaataaagaatgataagcgaatgatttcgtgcttacttaataactatccatactaagacgataagttactgtaaccatgacaaaatctgtgataaagaccgaaattttacggaccaaatggaagttcggacttagacgataagcgaatctgtgatttagattttggccaaaatttaataggctcgactttttgacgtgatcttgtcttcttgcggccccatcatttggcttcttccctaataaatgaataaaaataaatttgtaggtaaaattcttatatatgtgtccttgatgaattaaaagtcaatgctgaaaaaaaaactacgttgaaaatatctcaaaatcaatcttaaaattaattttaaaaatttaaattttggttttttttagggctgattaggccatcggatgggagccttagttttagcatttgagttagatgtgggtgggcactgaagtaggagtaggcagcaaacatttggggaactgctattctgcaccgagctgatgaggcacgaacatcggaagctaggccgacggcccgtaggtcggcctcggagtccacacggtcccttccgactgcgatgggtagcgctgcagtggctactgatggtggcccgtgcgaggaggagcctgcccaggtcgccctcacccgaaaaaggagcgggttagggccttaggggggacgaacaaggtcgacgtcttgggtttctcctgcggcaaccgcactgtccttgtcgatcgcccctccttgcataccctagtgacattccaccgcatccacacctgcttcgacgcgtcagtaccatcgcacttgatacctccatgcgcttgcggtgcccaacacacattgttcggctgtgggtggcgtggataggccaagccgccgtcctcctcatcgcccaccgccgaccttatcctcactgctcgccaccctggtgagataggaactgaggggagagagataggtgaggatagataagggtcactaacacgtgagactcacgctaactcaacgttgttaactatagtcaactaaccacgtcggataaaaccagccgctatactacccaaggatctaattcggttttgtgagttgagatgggctatacctggtattgcggttcaggaacgaatttcaaactccacagcaaattgaggtagctaaagtgaccttattccttagggttaattggatccataccactgcaactttgcgaaattaaaaaaaaatgccactgattcactgtgtttcttcgaatggatcgatgggttgcttcattggaccaaagcaagcacatataggtagaaaacagtaaacgggctattgagcccatacccaacccaataaggagaagcagatctgcagatgtgcacgctcgcgaggctggtgagagagatgtcgacaagtgtgacgtccacagtcagaaatttgagtgaaataaaaaaaaaatcagttgagtgacacattgatccccagtctacatgtacctgctgaaatcaatgttgtagcttgtcactagaacattttggtaccgaaatttagtacatggattttttacatgaaaattcgatacatgttacatttccgtcattccgtggctagaataaaaatgcactctctccgtccacaaatatatgaacatctatttagatgtatggaagagtttgtctgatgttcggtcaatgatctatgcgtgctgcgtatatatactatttatatctttaaagttataatccacaacattctaaaacttaacaagtaaagatgcacatcatcatccattagtaattattatatcttaatcctcattcaaacatactatgtcatctatattttattatattctaaatcttaaaaatacgagcatgttaaatcatcattgcatataattccaataatattttaacatatatcttcatcattttctacaatatcctatatacttcatccccacttagttaatgttttctatctctcattaaatcacatcacctcaattgtttctagccgttagttgattaatatatagttcaaattatttccctcattttttttctcatgaagtcacatcaccttacttttttacttttggattatcaatctatatactatttaaattatcacaaaccacatcaacttaagtggtttatagtttttttctccaatgatcattaaaaaaatacaacttttataatcttaatgttagctacataacaagatttcaccgaagtatcaagaacaacgcaagaacatgagaagttccaccaatccgacaggattggggtcgccgtcgccttcgccaccttaatcattgatattgaatattcaaagtttacagtatacctcaacgcacttctctctctctcacgcaataccagtctgacctagaacggtgctcattcggcccattccggcccatacatcatgggattagcaacctggttcgagcaggctagcccgttcctccagacgaggcttctgctttactttgtagttcatccggcactgtcaggttgctgataactgttgatattgcttaatgtcatcactagaaacataattcccagcaataaagccgaaatattctcgttacatctcacggtcacagatataatccacaagcgcacggatataccattgtagcatttcactcggacgtatgccaaggtgtcgtatttataaaatcccaagggaagatatgataagagagtactatactaataatttacatcacttgtatagatcaaaatctatgcaggggttaacaatattcaagggtagaataagttgacacacataaggaattaaccacaatactctcattaaaatataatctagattaagtggagaaaaaaaataagaaaagaatcattttttgtacttctaatatatagtcattttaatatacacttgctagtatacaatcatgcagccaatacccattaactacaccctctggtgtatcgcgagaccacccctggttgtcgagttccttacgacaacccgtcatgaccatccaaccggtaatgaatacggaggagtacccacaccaagaaattgtcttagtattatatacgcaagtggaggaatacccatactgagctgtcaccatcagcggcccacctttacaaacccgcggcatataacatcatttaatggtacctaataatctaagcaccgcgcttacattactaaatactactccacatcgctgcagctgacatagagcaatcatggtaatgaacattaaacccacaccattgcatatctctggtaagctagctacataattatatcgagacaagtacaaactaaagtcggccctcgaataattatataaatgaagtaaaggaccgaaactaaataaagaagaatatttcattaatgaattaagtcttaaaaaagaagaaaaagctactagagccatacccgaaatatcctgaagacttaaaaaactaaagaaaatattctattcctactccactagtgctagaacaatataagtaaactagagtgcactttggaatggagggagtgaggtccttaaatatgttgccaatgacggttatggcggttggaaatgtcaaaaatgccccacaaccgtcattggggagtgatcaggagcgtctacgtgaaaggccaggatgagagaccgcagagagggtttggccgaaccaacctgggttggcccttctggcctgttgcttcctcctgtgcatcctctcacgacttcttagccagtggttgggcccttttacagtggtttaattgagtttataggcccatccaaccataagtctgccacttgacggacgttgagtgattgttcggttattttccatcgattctcctccatttatgcgaagatctctatattcaaataaaattccaagtacaagtggagatagattatttctaataaaatatgcattgcaagtattgctagttctcctttattttggatatattgactgtcgaaattggtctataacgaccttcaacaacagcccccactccttgagctttggcttgcccccaagccaaatgcatttggaaaacattgacgcaaatccacatcatcctcccatgtctcctgcccagcaatgtctctggaccaaagtacaaaacttgattaactagagatgtacctttcctgacttgacgggtatccaagatagccattggaattttcagatgaggtgagatggaagctgaggctgtattgcttggttgaatccagtgatatatttgagttgagaaacatgaatactggatgtatggcactgtcagctagaagttgcaagcgataagctgccttgctcaccttagccacaatctggaatggcccaaaataacaaaaagacaacttgtgattaatgaacatagggctgcaacttcaaataaacccaatcaccttcaacaaattctcttaaacttcccttcttgtcagcataggccttcatctgctgttgagctctattgaggtgctggtgcagtaagctaaccataagttttctctcctttaaccactcatcaagattagggatggaacaagcatcctctccgatgccaaagtggctgagtgggtaaccatacaaacacttcaaaaggagtcttcactcaggcataatgataagaatgttaaaccaaaactcagccaaatacatccaataaccccacttggcaagcatgggatcaacattacatcacacatgatttgtacacactgattcactctttcagtttgacctagaaaacaattggtccctgagttggcttgtaaaattttatccctattagatatgatgcaagcaggaaggccatgtaacttataaacattgcacatgaaagagttggcaacatcaccagtagagaatggatgagatagaggaataataaaatgggaatacatggaaaaagttatcaaccaccaccaaaatgcaattgaacttgccatatttgggtaaccttcaataaaatccatagtattcccttgccatgcactatcaggaacatgcaggtgttgtaacaagccaggatacttgagtctatcaggtttggcctgcaaacagatggagcaagctttgaggatagagtgtatagtttgtttcatttttgggccaaacaaacaaagccttgattctgctataagtaacatgtatgccagaatgacctcccattggactgctatgcaaagcatgaattactttgagttgtaagtcagtgttgtttcccaaccaaactcttcctttatacttaagaacaccattgcacgaggtaaaattgggtctagaatcaggtttgatgatcaatttagacaagagctttttagagaaaccatcatattgatagccatcacagacttcctagagccaaacaggagtatagcttgagatcaggttaaactctcccgaatccacattatgcttcctggacaaagcatcagcagcaacattactgaggcccttcctgtaacagattttgaactgaagacccaacaacttagtgaaagctttatgctgccaagggatatgcagcctctgctcattcaggagcattaaactgtggtggtcaatgataatgataaattccccatggggggagtaggatctccactgatcaactgctaacagaatagctaaatactccttttcatatgaaaacaatcctctggttttaatacccaaagctttgctgacataagcaatagggcgaccttcctaagaaagaacatctcctatcccaccatcactggcattagtctcaatagtgaattatttagacatatcaggtaaggctaacacagatgttttgactaaagcttgtttgagggtaacaaaagcttgattagcttcatatctacgcacaaaaggcacattcttcctcaacaattgagttaatggtttgctaatcaatccaaaaattttaacaaacttcctgtagtacccagctaacccaagaaaaccctttaacttcttgattgtcatgggaatctgccaattaaccacttcttccaccttagaaggattggtagtaaccccttgagcactaatgatgtggcccagataagatagtttgttttgggcaaaagaacatttactgagcttcaccttcatcgatgcaacgtcaataatgtcaacacttggtgaagatggttgagatgggattgaaaatcagagctataaatgagaatatcatcaaaatacacaagagcaaactttctaagaactgggacaagagtgtcattgatggcactttgaaaaatagcaggagctccagtcaaaccaaatgacataactctatattcataatgactagagtatgtttggaaagcagttttatgttcttcctcttctaccaaacaaatctggtgatatcctgccctcaaatcaagctcggaaaagaatttagctcctgataattcatccaagagctaatcgaatactggcattggaaaattttcccctttacagtaatagcattcaattgtttgttatctataccaatgtgtttagtgcaatccttctt

SEQ ID NO: 57522 - DNA, 5597 bp, Oryza sativa
acatcatacttcttaagactaacaggtttggaaccttccaagatttcttcctgcaaaaatgctaaagagaaaactgcatctagatcctggggtttttgcatcaaaaaagcagatctgatatcatcccttaacccttcaacaaatttagtgacaaaataattgagaggtagagcactactgtaagccaacagttggtgcataacactataaaacttctcaacatactcagacatagaagattcttgagacatatgaaactactgccgaataagaacttcctgtctatccttagtgaatctgagacaaacttgttcagcaaattctgaccaactgacgcctaccaacttagatcatacccattgaagccagaacgctacattactagtgaaattaagaccagctacccgcacccaattccgaggatgaacaccatacacctcaaaatattcttcataattactcttccagagttgtcggctgtcaccatcaaactgaggacaaagcataggtggaacactgcctcacaaactagttaatccaaccgaattcaccaaatttgcaggagtgtgatgcaagccatgagactcaggggaaaaatgggtgggaaacagaggaccagatttctgacataaagagtcgagatctggagaagtgtcatgtgaggatttctgaaccacagtttgcagcttctccactttctcctgtaactccaccaccgaatcctgaagaagatcagcatgcttctcgacttccggaagccaagattcaaccaccagcttgagagttccttctgccctgctctgctcttcagtttgttccctcttattctcacttgcctcatgtttcttctctgcttcctccatcttccgtaggagcagatccaacttgccatcttggtccatgatcttagctgcttgcttagtcacgtagtgaggcttctcgtagagtgttgtggtggaagatgcgctcgagatcttgcgaacctagtcgagggagccaaagctcttgtggaatccgttgccgagacaacgattcccacctcttccaggaggtttttactgcaaaatcacaagagcaagagtgagaaagggggagaattttcagtgaggctctgataccagattgttagctacctaacgagatttcaccgaagtatatagaacagatcaagaacataagaaatttcaccaatccgataggattggggctgccgccgccttcgccaccttaatcattgatactgaatattcagcgtttacagtatataactacctcaacacacttctctctctctctctctcatgcaatacaaatctgacctggaatggtgctcatttggcccattccggcccatacatcctgggattagcaacccagtttcgagcaggctggcccgctcctctagacgactcttctcctttgctctgtagttcatctggcattgtcaggttgctgatacttacgtcatttactattatcatactaaactcctgcaccaacacacgggtttaatacactattatacatcacttgccctgcaagtgtgttgtgctagctaattgttcatgaatatatgcgaacaaggtcaagtagtttgttaccaacatttggatctcaagctgccgttttctttatatattcatcactcataaaagtagatgactgagatgtgatgccaatgatcttaaaattttgataaatataatactccctccgttttcaaatatatatgctctgtttttaaatgattatttgtcttatttaaaaatttagtacaaatataaaaaatataaatcacatttagaatactttaaatgataagaacaaatcataacaaaacaaatgaaaattacatacttcccccattttcatattatttggtactcttttgttgaacttagactttgaagccgaccttttgacttatatgggttattagccggtgaaagtttgttgtgaagtcctacctccatgttaataaaaaaatcactccaaccttgacttgacaatataataatgacttatggttttaaaaaagccaaacgaaaatgccgagtgtttgtttaggcggcttaggctttttggcttataaaggtggcttaaaagctttaacaaaagagggccttagtcgttttagacataatcttaaagatcaagaagtcattgaacaaagtttctattttctactatgcccttgttaaactccagcaacaattgctctctgttggttcatgcatcttataacgattgctctctgttggttcatgcatcttacaacgattgctctctgttggtttatgcatcttactccgtatgagagtttgtagggcctgaatttgattcccactaggatgcacgtattatttattgtcctagcaactattcatgttagcatgcagctagcgcatccataggtcatacgaaaattaaaccagccaattttacttttctattcacaggttttgtagccgaaaaaagtttgtgcttatgcgcgcgctttgccgctaggaaattaaataaaaaaaatcgttagtgcttatgcacgcgtttttccactaatttgctgtgcaatttgtatacaaagcgttgatttgagaacaataacaccatttaatacgcaagagcaatatctgttccatatctgacaaaagaaaggttccaacgaagtttcccatccatagctgattgagctaaaacgactaataatatcaacatgaaggaagtaacttttataaataaaaaaaaaatcaaatatcatatctaaaagtaaaaaagcatcatatgtatatttaaaagtggaggtagtacattggtaggttaaatttgtacttccataggaaaacctccacgtttagttcccaaaaagtttttctcaaaaacatcacatcgaatctttaaacacatgcatggaacattaaatgtagattaaaagaaaaactaattgcacagttagagaggaaatcgcgagacgaatcttttgtgtctaattagtccatgattagccataagtgctacagtaatccacatgtgctaatggcggattaattagactcaaaaaattcgtctcgcggtttccaggcgagttataaaattagtttcttcattcgtgtccgaaaaccccttccgacatccggtcaaacatccgatgtaatacccaaaacttttcttttcgcgacctaaacaggcccagcttcctcaaagtcaaaacgatcaccaggtactgggtttctgacacctccgaatcaagaagcctcagcattcactgtcgtcagagcttgactcaccatcactgtcgtcaggcagctcccccgcgcggagaagaatgcacgggcggatgggagaggccagaaccctccgccggcggctagccggatagcactcctgctcatcagaaaccggcaaacggtgtgtgctcgcgccttccgagggagatccagttggcattgcgctccacggcttcatccctgcaccggcataccacggcgttgcacggcctgcgttgtacctgcagcgatccgggttgccaccacgatgtccgtgtgccagcagatagctgacacacccagggacccgaccgcgcttggctctgccatgaccattgcagaacggcggcagcatgatggtatcaatgttgtctgagaaccaaagaggcgacctgtttgttccacagcaatgctggaggtccaactcatttgtcctttgatctccaggttggcgagggtcacagcagcttcctccatcaacaccaaactgtgcattttcgcaggcagatgatcgcccgcctagatgtaaaaaagaaacagatgcacgagcatcagattctgacaactatgagaggattcaaaggctgccagtgaaagtaaaagtatcaggtaggtaaaattctccaccgcacaagctgtggataaacccatgcaacattactatacactgtttttattgagcctgtttgcagcagctgctacagcttctaaagcagctagctagcagtggctacagcaccaaacggctaggacgcattctagattgacagccgaacggctgggctgttcagatcagccctaacagctggaaaaacagactaccaaacagtctcattatcatagacaagtaaacgtctttctgtggcacacagaagtttctgctatctgcagcaacatgtcaccacccagttcatcaatgacttgtcaagattcagtgtgcaagtaatattaaaaatatagggtcaattaaatatatggcactggttttcaagagagtgtgttaacaatgtagacaataagaaaatgtttctcttgtgggttaatgagggatactaaaatttgcctttttactcccagagaagaggaagataactgagttacatatcatgaaagcttccatcggccatataactctaccagaaaaatatatgttatacacatgaaattgttcagtgacttcatgagaaaccaaatcagaagattcttcatgaggtacctttatagatggcataatacctctttttatggtaatatcaatctctttaccagcgccttcaactttatcagcagtcatttctttagcagcaacaactgtgtcaaacattcttgataggtcatgaatagaatttaaaagagacaagacaaataagcagaacatggtgttttctttaccatcttgaagaacacctgatgtatagacctgcaacgaatgcaaatatagaggttaagcagaaatcatttgcaaaatttatatagtacagataaccacgtcattacctcttcagagcactgacagatctagtcacacactcactgatcattcttaagaacatgggtaatcttgctatattaacattcttgaatgaaatgagtttctctcttttttgaggggaaacttgtaagtctttattcactcaacacagattggaaacatgctttttgtgcataaatagtatatgcaaataataaaataacaaactttgataaaaatatcaattgatgtatccaacattttccattagagtataactatatacatggtaattaaatagcaagcacttcaatatgcagataaatgtgaccaaaaggaagacagtttcccaattaacatgaaaataataaggaagaacggtaatcctgacatagaattaactccagagaccaacattacaagattacagtgaagggctacacagggttataacttaaaaggactgcttaatatatttgaaagatagaaattgcaccttcacacaattcaagaatgactctgcatcacaaggctgtgggaaacgtacagcaaacttctcaatctgtggacaaaataagagtaacaaatattttttggcatcggaactttgttcgtgaaggtaatcaaatggatagaaataacacataagaacaactgctacctattaggaagacttgtgatcatattataaacactgaaaaactgagcatgaagaggaaactggacatgttcgaataaggtaaaggtgctggcctgaactcatgacctctaccattacacgatcagagcacacgccatttcccacattgcaatagtgaaatcatgacactcaacaaattggtgagtagaatcaactttgacca

SEQ ID NO: 57523 - DNA, 11288 bp, Oryza sativa
aaggggttttgttggggaattttggtgtggaatagtggagtggatgtagtagtggctgcgtcccacagtactactttattgttttttaagtaaatttcttagtgtacaacttaagaaatgagcatactacttaacaagtgggtataacttagtacaagaacttaataaataagcatatgggtacaaataattaaaaggtgggtatggttttagcacataacttgattgagaagtggtgtaaaaacttaattattttgagcatttttggctatatgtcatcattttttttaatgtactcagttgttaatatacttatgtagatttgtacaagcatactttttttttcattctagtaattaaaagtcaaacaaattttactgtgtagaaattttaagttggtatttgagatggtgaaaataatatctaaatcaatggtgcaaattgagtaatatattcttacaaattacatcaaacattgtaagataatatctacgggattgctatgtgatgacatattaacattgtgaaaaaacttacatagcactcattaaccaaaatagcatatctagttaagttattgcaccaaaatactaaatacccactttccatgttattgtacttaaacgtctcattctcaagttcgtgtactacatcgtacccacctatcaacttgttatactgtgggtataatttacacttcttaaaaagttataaaaatgaggagcactcatacaaagataggactgcgaatgctcaccatatttttttatgaatgctcccaataaaaaatatattgtcatattaaattttaaataaaaattttattttattacatttgttttatttttaagatttatgtcaaaattttccgcactaattatttagtctcattttctacctaaaatgcatatattgtgcactcaaacaaaatttacaatagttttcaaggtcatatttaaacctaaatcatcaagcacattaaaagatatttgccaccaacttaattggtgaaatgaaggaaaatgtgacggcaggggcatggaagggatcaagttaaaaattcatgagtatagaagggatcaggtaaatttgagtggtataaaagagattgcgtgagttttcaagggtatacagaaaatttactcttcagatttagatgatctctcttttggtagatgatctctcttttggtatctcgtcaccttgtctgccctgggctgggctggtcacttcatcatcacaatctctatcgcctcctaaaaggcaatcctttagacttcgtctctgagcgaagatttatctcctcggcacatcatggacctttgtgcgttttttaacctcaatattttcatcttactagcatcacgtgaatacggatgaatggtttatagcgttcaatatattttaaccccaatggttttattggtggtcaatttttacgtagaagcactagttcttttgtgtgtgtgtttttatatagagatgtgttcggcactcccttttcccaacactcctctctcgttttccgcacgcacgcttttcaaactaataaacggtgcgtttttagcaaaaaaaattctatacgaaagttgcttaaaaaaataaattaatctatttttttaaaaaaatatagctaatacttaattaatcacgcactaacgaaccactccgttttccgtgcgcacttatagtgctgggaacgaggggcgccgaacacagccaccaaagtgtagcagagatagacacgatctttgatgaaccttaaaccgccagcatagaaaggactgataattcccaaacaaacttctcattacaaaagtgggggaaaagaaggaaaaagaaaaggtgcataagaataaacgattcctcgagcagactgaaatcatagaaaagacatcaaagaggacagaaccacatacataggtactatgcagatttaaatttgttgataatccttgcagataacacaatgcacagttctactcaagtcaactgacagtgaaagcatgttaatataaaaagtggatctcctatgatccttatcttcacttcagttcacagctaatccccctagttaacaagtctatgcgaaaccactcttatgcatcaacaaggtatctacagtccaaataatgcatggctcctcgccgccacatcaccctcagttgaagcagttaacccagaagacggcgaggatttcatagagtggatcggctgttgttggtgacccgcattggaagcatgcttaatcatcacactctctgctgatttggggtcactggagagaccagatggaccaaccgcggtcttggtcttcttggcccggcgcttgggcggtggcgctggcagcatttcatgggaagaattgctgccgctcatcaagctctttctgtgcaaagagcagaaatccatgccccattttgcactcgtggcacatccttgaaacttgcagcgcctgccgccaccatgtttgatgcagtaatcactccgcccttgtgcactcttaccacatccttcaaacttgcagcgtcttcccccaccatgtccaatgcaaaagtctgtgttcccttgggcacccttcacacaaccatcaaacctgcacctccttccaccaccatgccttacacagcggtcagtgaggccttgactgctgccacatgctgcattggggcatccagtgacagcgcagcgcttgcctccgccatgagcaatgcataaaggtgtgcccccatgtgcaccctttgtacaaccttgaaccatgcagccctttgaaccgccgcggtgaatcttacagtacattgcatttccctgggctcgcttgctgcaaccctggtacttgcacatcacaacatcaccatcaggattatagattcctgcactacccagatcattcccagcattttgggttactctgaacccactctctccttcgtacttgattgaaatttctgatttggagcaagctactgtactggaaccaggttcaccaagcgggcgacctccaccatgggacatacataatactgagccatctggtacaatatgagggcagccaagcatttggcatcgttgccctatactgtgacttttacagagcaatgtctggccttcaacaacattgttacacccaagtctctggcatcgttgtccaactgcttaataagaacaaaaaaacaaaaacccaagaaagatgtatgcattagacaaatattgaaacatattcaaatttatccaagaactaaagcttctccacacttatttctcagtcaactacattatggttaataggtaaactccagaaaggcatttaaatgggaaaaatcattgttacactatgttcccaacagactgtttaccatgtctacttctacattcagcaatgccaccagccgttgggtatcaactactgttcatcatggtcaaatagactttatctgtactcctttaaaagaaggcaatggaagtagtagcagttcatttgtcatccaaacaactatgcacaacattgatttacgaaatacttcttgaagttcttcaatattatacaatatccctaaaatatattcttctttgttatgttgtcctactaaggcatatggtgaccaaacagtcacatttatatgtagcatgaaagctaattttacaaatacagtatagcaaaaactgtcaagcactctgtaacaaaagcatgaaaggcgtaacagaaagaacttattcataaatttcaaacaatattaccatatctactattcatttttacccataataaacatccaggctttagccagtctttaaagaagtgcatacatggtacggaaaggtaggttccaaaaaaaaacataccaacagaacgaccatcagatgcacacatctgtagacaaaaggataaaggaagtgtcagaaaaagcttgctagactagacagcagaaaactgggagaggatagcttacatttaactgaatcatattgccacgctccccaaaaatgtggtgtttatcagcatccatgcctagaaaaagtacatggtcaggtctaccatatagatcagcttataatataagaaagttgtgaaaatggttgtgcagaatataccatgttgaaaagaatccatgaaatacacctgcatggagcatttaacaaattaaattaacaaaaaaggtaatcttaagaattaattaaattatttgtagactattcaaataataccctttgctgagaaaggatcaatatgtccaatcattaatatttgttgccataaatactaaaatactaaataccgtaaggatacagattgaaagaacattagtcaaaactcaaaaacataaacttcggtttgcatgccacaagtaaataacattttcctctaacctttaaggctatgacttgctgggctgtaaaatcagaaaaaagggggggagcagacattcccgtcatatcatctgaaacaggaggttacactccacttattcctcactataatcaaacacagatgtctgtattttaagctccaatgtagtcatcaaatgttggcagctcattaaatctagagaaagagtccgatataaccctctatgacagttctggagacagtttcaccaacgtggcaatctacatggaggatgacatggtgccagtcctgttccttatctatattactctctcttacagtgcagctccacctatcatttctttcacttacccactcctctcattttatccttaaccccatcgttcttaccctcagcaatcccccgttctacatcatctacctgtcacgtgaatcggttgctgtagtaagataggtgtggtggcagcagcttgagctcaatctgcggccagggctggatgagctgagttctagcacaggcagccaagctccgatgacccaatctcaggcggcagctggatgagatcaacaacagattgtaggagctcgagatgaaatggtagcaaccgaggttcagcttcccgatctccagcggcagtgtacgagactagcttgagctatagtggcgattctcttgttgccatagtggcactgtttgctagggttacagatcataagaatcgatttttacaagtttggtgacatagaaagaacccaagtgaggtcactgctactctctaatactccctccattcacaattgatcatcatattaggtatgcgcagcaataccaagggagaaataaatcacacaacagcagcgtggatcaaggagactgccgcagtgccggttcggcttccgcgtgtggtgcatggagctagaccaaccagaatcacggagggatttaactaatacggcaataatcactcttcattaaatctatgcatgcatgctaagcagtaaatctcaggagactctctcgcaatttaatccatacacgcatgcagcaataaaaaaaaaaggaaatctgctggctcaagacgttaggcgacgatcaaatatggatatttctgttttggtaatatgacaatcaattgtgaacggagggagtaccacccaaagttacaaatgtttaggaatacaccattgccgtcaactttaaggtcctggacattaactttctgctattcaaggcaacatttaacaagaagccgaattcatgtctaacgtagtaacattactaaaataaaattgttctagcacaatcagacctgcaaatcctctaaacgtgcacagtgatctagttccctatctatcttctccacgagctagctattcagggccaaaacgtacggattcatgctcaagattaatgattctttttactttacattcgtgctgcaggtatgtatgtaatctagtactaatcttgaacacatgtatatcacagtggagactaatgaaacaaatctctgctgcatgacatgaccacaccaaattacacagaccgtgtaattcaacacggtgaacagctcaagtttcagatccacggaaatgtagagctaaaagcacacattaagaaggcaatttgattaactataatcatgtaccacaggaaggaggagaattaaaaggggggaaaggcgttcgctgaccttggcactccggttgcactccgaccgatgctcgatgaggtacctgcggaggcggtaggcagcaccggctttcgtcctgctcccctcctggtggcgcgtcgatcgacggcggtagaggggaggggattgggggggagagaaacccactgttggggagggttggagcggcggtggcggcgggggagaagagccgccggcgctagggttagaggtggcctgggtaggagggcgaatcgggcgcgtgggtggtgcggatcgatcgatcgatcgatcgcacgaggcggcggggaggggatgggaggggatcggaggggggaaggggaggatggatgaacttggcaagtttggactttggtagagaagaaaggttctgtgcagcatgtattttagtacaactagggtttattttagtacaactagctagggtgctcactatcactggattgccagtggctggcagcattgctaatttgttgggtgggcatagtatttaggaaaaataaatctgtatctatgtcgtacatcatccgtttaaaagtatctctagaaagtttattcttttttacggaggaagtagatcattctcagagcatatagggcttatcggattcatggtgcgtgtcatacttatatatatataattaataaaatatacatgtaagtgagaaataaaatataattaattttaaagtgagtgagagatcgaagaaaaattatacatgtattcaataattattttctttaatggcagtgtgacaagtagttgttatttgtatgatttttttttgcatgctatgtaataaaataatccatcgcttttcattttgtgttattgtctctttccctagttggttgtcattatggacaagaaaatgggaagtaggcaatgacgtctggtagccccgaagcaatgccaaagccatcgttccaggtccgtggtgcgaggcattgccattgccaaaatctactcgcgaacactattgtcgtcgtcagatccacccgcgaatgccactgccatcggatgcatctacgagcgatgccactgccatcgttgtggatccatcatgcaagacaccgcggcatactcttcctgtgatgcaagtgtcgctaccattgtcagatccacccttaagtgtcactattgtcggtgctccgccagctgccaggaccacgacttcgaggtcaatttggcctgtggaggagttgatctgagtgccaaggagctcgatttgggcaaataaaaattgatacaactgaaaaaatgatggtagacgacaccacagaggaagggacgaggagcgatggcaaggagagagtgacaacagtagaaaaggaagcgattcgaggaagactggaagaggaaatgggaaaagggatgaacgcttgggcttctgcgattttttttttgctagtgaggcccattataaagtgagagaatcccttatataccactagaatttgaccagttcccttatatgccacttaaaattggcttctcccttatatgccactagtttaagtttttccacctttttatgccactcccatcacaatagtgttagttgacctttagtcaaaggttagtttttttcgtaaatgaccaatatgccctctcaactaaaaaatgtgtaaacttcaaaaaatcataactaatttattttaaatcctttttgagtgaacaaaattttgtcagaaccagtgaaaaatgctctttatattaaaaatattgttagaaaactgcatgtttcatgcttacattgaaaatttatttgtgatggtaatggctaaaattgcatgtgatgcagaaaaaaatcaattttcatatgttgtatccaatagctatattagtactaaaatgcctattattggttgtatactaattcttaagggaaaatgcatctttgtacaatgaagttaacggtcaactgacggtggactgacggcaatggcataaaagggaggagaaacttgaaccggtggcataaaagggagaagccaatttaaagtggcatataagggagccggttaatttagagtggcatataagggattctctcttataaagtccatctaggccttaagcattgtggtaatagaaacagctaaagtttactcacacacatgccctacctataaaagaccacttcatctatatacattgccaatgcccttagggttttagatagtctacaattcgtcgtcttccatatgtagacttgggtctattttctaatatggtgtttttttttcaaactctttctcaatcgttacttcatctgtgactatgtgaggttctcgataaagatctagaatggcttgtctcctgggttgttgaacatcttcacctagactgttagactccaattttattgttcgactcaagctttattctgttcactttcacttcaacaaagattaatcatcaacaacacgtgacttctcttatggactcaatcgatctgtctgcattcagccaagcatttgctccttcaccattgcgtcggtccttcagcaccatgcctctccttattcttctccaatgcatggtcctttgtttaatcaagtcttgccaacccttcaccccattttaccatctttagtcacatgtttccctatatcacaatgaaacttggttaaattccatcttcatcttcagtgccatcattggaccaatctcctacttattccttcaataagtgcattagtcccttaattgtttgtcatcaattagctaaaactcattaggggcctagatgctctttcagttatcactgacacctcgtctttcaggtaggttgcttcttgatgaggaagtaggatcccgatcttccgataggtattgataagtcgattatggaacttgaagttgatgatccaaaggctcagatcatgacaaccgaaccctcgaaatcactacaccactcatccattggttattaatcaagccgaaacatgattgaccttgtcgataaggctatctcctgcaagtgaatcgagaacacaagcaagagagtagaagaagcaatctgaactattattaatatatgatgaagctcacaaattgatgttccacaaactgaactaagcggtggaactacaacaacagaatctaagcaaaacccaactctaaacaatgacgactattaaataaataggattagggacgtactagggttagccctaggatacacaccccctatttaacttaacctatgacacaattataaagcccaaggcctaaatcaaactcggactagatgaggtacatgacttgtgttgcatattcccaacaacttgatatgaattttgatgtgagaccaaaaccatctgaaattaaactctataattttccccacaagtactcatgggccctgagagtcctttgggatcaatagctaagcccatttgaagttaatacaatcagaaggcctgaatccaaatccaaaacatgtaaaactgcatcttttgccttttatggaccaaaagtgacgtggtgatttgggactagacttggagaagatcttggtttggtccccaatcaatttctttgatcatccaagcacttcgtgagcatgttctcctttccttcacccatgcaagtatttatggaaacaagaagatacaaaactcatggtgtagtaatgtttgtttttttatggaaaacaacatgagaggttcctactgcgatcgtttgttaaaacatataataagtaaacctaatatagaacatatgcactttttacttgttaatatgtaacataagtatggttatatttgaaacagtgatgtcctcatcacctctagtcatttctagatgactttggagtagttagacttatatctttactgcaaacacctgattgttcggtcatgagtaggccaaatacaaagttgctaagtttggattcctgtggctagctatagatcaactttaccctaatgaaatatgagtcaagttatcatgtcgttaactagttgctcaaccataaaacttgttaggggtacgccagtagcaatcacaaagtaaaactagtcaatttctttttttttgcggggaaaaaagtgtattactcattcaaaacgtcctcacagactagctgtgaaatgaaattacaacttccttccggccaaagcccagaaattgaatcggccctagccctattagctaaaaggtggctaacaccgttttggctacgatggatcttggtaaccaacacttccctacgctctgataacaggcgtttaatctctggactaaattagctaattcagacagatccgtattcccttccttcagaagattgactagcgaaacacaatctgtttcaatcaagatagggcgcatagtccactgtagggccaaaatcaatccctccatgcaagctcggatttctgcctccagggcattcttgtagctatccagggacttacatgctgcaaaaactatactatcactgttgtcccgtagaatcataacgatacctcccttcccacaatcagcatcaaatgagccatctacattgagtttcatccagcccagcctcggcttctcccagtgcaaatgggtcgatgcagcaggaggaccatctggtcctcttcttctaagcgcacttataacagatctgctaacaacagttttacctttttccagatcagcgtgggggcattccctgatttggaatagagtagcaatataactttccaggaatcttttggagacttccagcggaggaggcggcttattatgtgtgatttcattacgcacataccagtttcgccagagagttaataaaaacatctcatgttcttcggttggtagatattccaaacaatcaaacagccagtaattgccgaattggaaattcaccaaatcaagcgacaagttacctgattgtaccatatccgacaacaaggcactggctcggggacatttgcagagagcgtgcacagaattctccacctctcggttgcagatgatacagatatcagagtttaccaacttccttttccttttgttgtccatggtagctaaacaattggaggccactttccaggcaaagattttatcttctgtgggagcttacacttccaaattaaatcccaggatttgcgggaatgcaaagcagaggaacttgaggatccttcagtatttgccagcctacaggcaagattataagcactccggactgagaaccgcccagacttgtcagggtgccaagctagaaagtcttcttcttgggctgcag

SEQ ID NO: 57524 - DNA, 6608 bp, Oryza sativa
taagtagtatcaatcagggatccattgggaaaatatttagccttcaacacccttgcacacagactatcagggaactctaacacacgccacgcctgacaagcgagaagagcttgattaaacaatctgtaatccctgaagcctagcccaccacaacactttggttttgtcaggcactcccacgctctccagtgagtctttcttctaccattctccgagccccaccaaaaattcctggtgagctttgttaggtcgtcacacatagaatccgggagcttaaataagcccattacatagaccggaatggcctggattacagccttaaccagaacttccttcccacccgaagagagaaaattttcaccccattggatcagccgcttccagattttactctgtaggctctgaaatctccccttgttcattctaccttctggggtgggaaaaccaagatatttatcttcaaagttgctcttttctatctagagaatctgttttattacctcagtgatctcgagggaggaagcatcatcgcacaaaattgagcatttagccgggttgatcaactggcccgttccctgcacataagtgtttaaaacatctttcaccgttgctgcctgtgcctgatttgctttgaagaatagaagggtgtcatcggcaaacagaaggtgtgatatgcccggcgcattgcgacagatactaagggggggtcagagaaccttgttggaccttctccttcagcaaaagagataacccatccgccacgaacaggaaagaaaaggcgacagggggtctccctatcttaatcctcgagagggagcaaatgatcgtagaagagttccattgaatttaacagaatatctcaccgtggttacgcaagtcattatccagttaacctagcggtgagcgaaacccacccgattcattgccatctcaaggaaacgccaatccaccttgtcataagctttggacagatcgagtttataagcacacgctgccttgttagctttcctgtttttctgaatatagtgaaaacactcaaaggctaggagtgcgttatctgttatcattcgccctcggacaaaagcgctctgttcctctgataccaattcatcgagcatcggtctgagcctgttaaccaggcacttggagacaactttgtaaagaacattgcacaagctaattggccgaaagtccttcaattccataggttgctcaatttttggaattagaactatagccgtattattgactccttctggcatacatctagtctgaaagaacttactaactgcactgatgatgtcctctttaatgatcccccaatttcgttgataaaagcgggcagggaaaccgtcagggcccggagctttcaatggtccaatctggaacaaagcctgagcgatctcttcatccttgaagtctgcacagagcaggtcattcattttagccgttaccttagcttggaataatctgctgacagattcagggttcaaggtcgggtctgcagcaaacatctcctggaaataatcagttgccattgattccattgctattgccgtacggggcacagtaccctgcaaatcttttagttttgtgattctattcttttttgctctccataccgccctactattaaaaaaatttggtattcttatctccttccttgagccaattcactctggaccgctgaagccaaagcatttcctctttgtataacagttcattcatttggttagtggcaaaacgaatttgggaattatcagcatctgaagcaatcaagtcccccagcttcttccttgccttttcaagttctctacctacatttttcacttttgttttgctccaggaacgcaaagccgccatgacttttgcgagagaccgatttatgtcccccaagtctgatttctcgctcgaactggaccaagaatctttaatcacctgtgctgagtcaatctctctttcccataggatctcgtagtgcagacatttctgtctaggctggttgttttccactgaaacaagcttgagaagcacagagcaatggtcagaacaaggtgagacaagatggacaatttgagcggagggaaagatgtctctccaaccattattggcaacagcacgatccaatctaacctttacattgttccatccatctctcctattgtcataagtatgaggcacaccttgaaaaccaaggtcgtgcaactcacaatcctgaaaaacatcccgaagggcttgcatttgagactcattcctctgggttcttgaaaagtgctcgaattgccacatagtctcattaaaatctcccataaccagccatggaaggtttgaggtttggctgatatttctaagcgcagtccatatctgatggggattttcaacccgaggttcaccatgcacaaaagtaacatgccacaagggatcatccggagacaagcgcacatacacatcaatgaaattctttcaaaactctgacatcgacggaaacatattcatgccaaaacaacgctaaaccaccactcatcccatcactactgacacccacaaaacctttaaaacccaatcttctacgcacacgacacactttttccaccttttgcctagtttcacacaggaagagcaaacgggcatcggcctccttaactaaggagcacatatcacgaactatcgcggtgttgcccataccacgacagttccaggctaaacaattcattgctcctggcgagacccagccataggtcttgccagtttaccagtagcccggggactggttgcttccatatccaccgctgtgttctcagccttctcatcctttttgaaacgctttgaggctcaagcaggaacccctgtcttcccctgccccgatccttcctgagattcactctgatcaaactccaacagagcctgttgcactttgcccattatcttcagttgagcattatcagaccctttcctcttgattgggctgatagtagcctcattggacacgtcctcagtagactcctgttgagtgcccaggttcctaatggccgggatcatctcgaatgatggaagtgatgctgactcatccccagctgaaaacttatttgtttggttcttacgggacaaagtactgtcagacatatgcagcgagccagccttttcagcaagttgagcgtcaactaactcatccccttcctcttctctcgaatcaaaaccatcgtaggcatcgattctgtttggtgggtcagtgtagaagcggtctccctgtttattccccgctgaagaagagctagcactacctgcgcctctgaacacaagcttcctctgaaccccagcactctgatttgccttaaccttgctgattttcctttcgaaagctttaagaggagagcagcgtagatcagcagagcacatgagtggttcagcctcattggctaatcttttctcgcactctttatctgagtgaccaatgaaaccacaaaagaagcagaagtgcggcaccctctcataacgaagattgaaccttctgatttcctcagcacctttgatcttgattttgattgcaatctgtcttttcaggggacgattaaccgggagatcaacacgaatgcggaagaaatcatgcttgttgctgccattttgctgcacatccacttccctgaccttgccgagtttactcccatacagctcacctctagctttgttcatcattactaagggcagatcatatatccttacccaaattggcactgactccaaggggaccatcgatggactcaaaaggccattgaaatctgctacaatcagagcatctcctctgtgaatccacgggccgccttgtagaacaaacttatggtctccctcagcattaaaggtgacgatgaaaagattgtcctttagagatttgtaactcatctccgctctgagtcgccaagctctacccatgtcctcaaataaggccacctggttggggaatttgagcgaatagaatctcgctaggatagtccatttcctgcacacttgacttcctcctcgtcaagttccacttcaattgcatcttcttcttcctccaaaactacaccctccatatgtgcttcagaacccaagttgacgcccgaactagattgcactaccacatccaccgcttgatcatctgccgggggtgccgccaccagatcttgcccagctttcaccagagccctggaatcctctacctctttgttccccagatccaatacggcgtcatccttcagcttcgggcaggtaaccatcgcattgatggtccctttgtcgcccccactgagagattttgccatgagatggatattgagagaacactgcccaaaacctagatcaaaacctgacaggagaatctccagagtttgcaaaggatgtatcgttgtggaaaccacaggtgtgtttttataggaggaggagacagagtccagatcggattcatacacatacgtctttccaaaggacaaaactgagacgaagttacgtagatgatcaaacctgccagaaccgattgtctcatgaacattccagaacttgatagccaacagagaaatacctaagaacgtggaccgcttccatagtgggacaggtctcttcccaccagatgagagaggattcccaaactgctgaagaccaccagagatatttccatgatctccagagatgcgaacagcagaatcaaacgtcacagaaccaaactttgttggtggaacagagacgaactccatccaaagaaccctcccaaaggagaagatggccgccacgccccagtcgcctgggcgccgccaaaaccctggcatctgtaaattacggagccaatttcggaatcaccatgaaagtagaaaaaaaaactagtcaatttcatcctctaggcgtgtacgtatttgcttcattgctttacactacatagatcgactcttcactgctttcgattttatgaatacacaagtcgaatgcatatacatgcgcacacataccacactcatgtatatacacacgcatgtagatgtgtcctagctagcacacatctaaagagattagaggcataggctcacatataaggatgtgtggggtacatccgtacatgcttatcattgaacacacccacatctacatgtattgcctcatgtggttaaacctaagaaaatttgagcatccatgcgaaccataatatttaaatttgggtgagcagtctaactaataattgagctattgctcgtagtcttcaatcgtatatcttgctagcttggttttgggtaggctcaaattaggcctgatcaaattaacggggctaggcaaaaaatagctctgagacaaaaatacaagcctgagctgacctgagcattctcgtttggtggctttttgggctttcgtgcttcaaaatgtagtcctgaccctgacccagtacaccattgagttgggccgggctcagtttgagcagccctagctcaaatgtgccaacggggttccaaggagaacttggagacgtttatgagctgtggcagcaacagccaggcaggcaggcaaattaaagcatacctttatcatacttattgcacatatttaagcctaaaagctactatagcttttgcaatgtgattatacatgcgagtacattaataatcctatcattgcattgaatactatcatccatggagagttgcattcatatcctgtacctttgtttatctaatactaccacccacggctaccttcggaacctataaggaaaggcatgtgagacattaaagaggtgtttatgttggttatctcactttgccatgtcacactttagttatgccacatgtgtttattttgttgtcgcacctatatcatcacatgccacacttttatactcttattaggatccatatgtcacattcttaaatttgtagctaaccatattacacatgtggccaattatttccgagccacagttatgctatcacctatcatgtcataacttatctaagcttagttatgataacgttagacatcaatcaaaaatctagtttctccttggaaagtgggcgggctggcattgcattgcctaatgttggcggacccccgcatgcagtgcaagtgaagcggctaaagaatgtgaggctacatttcgtctcgccaacgacttgccccgcatagctaggcagctagctaccgcgcgcatttaatttaagttgatatcgagcatgcatgggtacggtacgcgccggtcggactccggtggtgatcgatcaatggcgaggctctcaacagctgcgtggccgttcctggccgcagtggcggcggcgctgctgtgctccgtcgacgcggtgatcgtcgaaggcctccaggttgggttctacaaccagacgtgcccgtcggcggaggaggccgtccgtgacgtcgtcacctcggagatcggcttggaccgcaccatcgccgccggcatcatccgcatcttcttccacgactgcttcgtcacggtataacactaacagtacacatgtgtgttgtccgtacgtacgtgtgatcaatcaccttaatattggtattacgttgaagaatcgatcgatcgttgatggatggatatatagggatgcgacgcgtccatcctcctcgacgagacg

SEQ ID NO: 57525 - DNA, 7563 bp, Oryza sativa
gcggggatccctttttacgaagtggcggcgggccggatggacggcctgcgctccaacatggacgacctgccggggaacatgccgacgcccagccaccaagtcccgcggatgtcggagctcttcgtcaagcgcggcctgtcgcaggaggacctcgtcgtgctctccggcgcgcactccatcggcggcgcccactgcttcatgttctccaaccgcatctacggcttctcccagggcgccgacatcgacccggcgctggagccggcgttcgccgagaagctccggaaggtgtgcccgccgcggaaggacggcgacgacccggagcagtcgcccaaggtcagcttcgacggccgcacgtcggagaagctcgacaacgtctactactccgagctgctggccagccgcggcctcatgacctccgacgacgcgctcatcaaggaccccgagaccaagaccaccgtcgatctcttcgccggagacaacgccgtgtggcaggagaagttcgccgccgcgatgcagaagctcggcgccgtcgacgtgctcgtcggcgagggcaagggccagataaggaagcaatgccggctggtcaacaagccgtccaagcagtccaagcccacgtcgacgcggcagtccatgccggcgttgcggccaaagcgcaagaagcctcgcttgggcttgggcaatttcatccctggcttccacggcttcttctgacagaggtgaatgaaattaattaagaaaaacaagtactactccacttccctcccataggctcgctcctatggtttttctttttctttcttcttttttttttttgagagaggagcttttgctcctacggttactactacactctgctgcaactatatgttaaatttcttttcttaaaaaaaacatgttgaattgcctaactctctgcttgtaagatatctacattcattcatatcgttggtttcatagctataatggtgtatcaatgtttgtagtatgggttatatttctctctttacctaagaagaactggtggtttttttttccttttcacttcacgtgtcgcaggttgcaacaaaacatagcgtgaagctgtatttacgttttagttttgcaaatcttcgctggctgcctatgctttaattcctagtattctcctaggtcatgtgacagccaaacgtaccagaaaaatcatcgcaaatatctatctatctattactccctccgttttttaatagatgacaccgttgattttttctcacatgtttgaccattcgtcttatttaaaaattttatgcaaatctataagatataaatcacacttaaagtactacgagtaataaaacaactcatacaaaataaattataattacgtaaattttttaaataagacgaatggtcaaatatgtgagaaaaagtcaaaggcgtcatctattaaaaaacggaggtagtatatattaaaagtctattaaacttcctataaacgctcccaaaccgccaagcggcaccctataaatactcacaagtcgtcaagtggcacctaataaataagaaaaatctaaccatctatttttacatttatttttacttaaattgatggacccattattttaaatggttatatctattttgtaaaaagaaaaaaacacccgaagccaacatccgaaccaacgtacatactaatgaacgtacgtatatactacacgtacatcccatctgttcattccttattttctattttaagaagactaaaatcaaaattacttttacaggcaaaaaaaatcacaaatagaccaacaactaggcctagcagctctccctctgtcactttaaaaatcctatgaatgcttctaaatcgctgcgtggtgctattaaattagagaaattactagaactttttttttaaaaaaacacaaagcacctgcccatcagtttatacttaaatggatgcatttaggtggttatatttttttaataaaaaaatcccaaacctttttccttccttccttccctccccacccccgtgcggtgttaaaatttattaaacattttataaacacatctaagctactatatgacattcttaaattaaataaaatcttaaaaattttagaaaaagattattatatactaagagtccattaaacatcatataaatacttctaagcctccaagtaacaccttactgacgctctcagaccgccaagtgacactctaatccgaccgtcgatttttatttaaatcgttggatctattattttatttttgaaagttagatccttttttttaaaaaaacacacacatctaaaacctccccatcacgtacgtaccaacgagctatcttcatgagaaattaaaataaatattatttttacattgaaataccacaaaatagatctctactcgctaggtctatcaactctcgctctgtcattctaaacatcctacaaatgcttttaagcttctatgtggtgctattaaattaaagaaaatactagagaatcttaataagaaaaaactcttagctgctatatgacattcttaaattatagaaaaatcatagaaattttgggaaacaacatccaaccatcggatttgacataaattgatggacacattattttcaatcgatcgactcattattttaggatattagatctatttttttttcaaagaagaacacccaaacccctttccctcctcctttgcagcatccggtgttgaaaatccactacacatcttataaacgctcttaagatgttacatcattctcttaaatcagagaaaatcctaagaattctgataagaaaacaaaacatccaaccatcggtttcgacataaacatctgacacattattttagggtgttagattaatcatttagaaaaatattccaaacctccttcactcctgccagtgtacagcccgtgtacagcaagcaccattcttttctctctttttttatctcctaaacaattaaaattaaaattatctttataggcaaaaaaaaacataaatggacctccatctattacttatatcacgtcaggcatctaacgactttctaccaacttaattaatttctcttaacatgcatataagggctacgtgcctatataaattgaccttgatactttgttgttggatttaaaacccattcttaatagaaaagttcaaatatatttatgaggactgttagaatgaaaagtataaaattttaaaatacaatcaaataaaaaaaatgatattattggatttttttttggttgtaagatatccttctggcgagttaaaatactctaaattttctaatagcaacaagctccatttttttccagataaggaaccacctccattgtttcgacacaataatttcttattaattcaaaactgcatgatctcaagtaattttattttaaaatttacatgttgcaagagtaattataaaaaaatgccagcgttcgaagaacacaaaataagtttaattttagtttagaatataataaaaatatttcaataaaaaccccgcacataaatatccataataaaattttactcacattatataagaaggtgcctgcgcatgtacgcaggctacctttctagttgaagaaaagcttgacaacaagttgcaattagctgaaaaatcttgacgagaggcatggtgaccaagcagtcacaatgcagctatgctaaccgatgcatcagcatcaggctatgatgcaagatctgacggcgaggaagaacagaggaatacgcacaagatccgcaatccatcgcatattgtgtgtacaatctaggacaacccacacgcacagcggcaaaaacaacagaaacacatgaaaataacacatctggatatggggtagcatgctctcaacaattcagataacatgtatataaaacagaggacctgttctaaacagaggttggaaacgctgattaacaagtactacgcgaactctaaagtttcacacaagatagtcctcagatgtactacgcaatatgttagagacaagataaacttctcatcttgatggaagctttactggacaaaattctgtaggagcaaaagctgcaagggatagtaagtgaactacgacttcaatgcatataagatcataggcaaataaaggccttcccaccacagaggatgttactatctacagtgacaagtcgccacccagttcatcaataactctctcgagcttgaacaacatatctaagaaaagcaaaaagaccagatcagtagaagtgtgtggaattcgattagaaagtttctaaattagcatttagcaaaatggaatgctgagaaaaatgaattagtttcacgagttatgaaggaatagaagagcctgacaaatgtatctaagactagcaaaagcgctatagaagcatgtgaaaggcagattagtgagtttccagagtaatgtagcaaaaggaagtgttgagaaaaccgaggaatataaagcataccatggaaggcgccatcagatatatatgtctgcggcggaacaataatatatattagaaaatatagatttgcttatcaaatttacaagaaaacaaaacagtcaagccagacaattatcgattggatagatacctttatccttgtcataatatcacttgtttctctattaacatcaatttcgttagcagaagttgtggaaattgcaactgcacaaaatactgattggtcagggaaagaggacagacttttccagataaataagtgggaaatgagattgagactgtgtgtaccattatgggaagtatctaacatagacacctgcaaaatttaccaatataagcatcatttcttccaataataacattttgcaggatattcataaatatagtcacaaatacctcttgtggtgcatggtccgttgcagttactggatatggttcctcagcatctggtttaatatgtgtaaaaaatgttgccacaaatgaacaagtagaaataaacaaaaaatactgcaattgcaatgaatgtcaccaaacagaaagttgctaacctttctcagttttacatgaaaattgtgtcagcatatcagtgaaactgggggggaaaccagagaagacggtatcaatgttggtagcaaggagaggttgaagaagaggctcttctggtgcctcatggtggcgtaatgatggtgtctcaggctggcttaatgctggtgcctctgttctgtggataggctcatctggttctgcatggtagcctaatgctggtgtctctgttctgtggacaggctgatctggctcctcaaagcttgaagagtcgggtgttacttaatactcataacagaaatatattccacaactaaaacttgatacagttccactatttacctttggtgaattccactagaagcaatatattcagatgctgatgaatcttcacaaagatagtcacttccagatggtctgatatccatggtttcagttgagcattcctttgtaaacaaaccatatagaaatgcatttagtgcttcattaacattaaacagagcataagtcaagaaaatctcaaaattagtaaatagaataaacagaaaataccattactgtagtatcatgaattctatagctagcagtactgaaatttcaattgtatgaatagtaactttcaccactgtgatttcatatcagtaaactagggtctagggagctaacaaatttaagagaatcttgaagagaactggaatgtcaaaactcagaagcatcacaaatggttttatctaaccactataatatccagtagtcatgttcacacattgaacagaaaattacaatcaacattgatgaagattacaggttacaagatggaagtatatagtttaaaaatgggtagcgagtggtggtggactggtggtaaacacttgagcaaaacactattaggaatgatgagttaagagaataggcaagagaggtccatggaatattcatacaacataactatgaagaggtacacattgttggatgacagatataggaaattgcaccttaacacaatttaaaaatgattctgcatcactgagatgtgggaaacgtaaagcaaacttctggatctgtagagaaataaagtgcataaatattttggccattaaaaatgtgattataaaggttgtacaggttataataaatgcagtaaatatttgatggttcaagaaaacttgcctgtttggacttatcacaaaagctcacaaacaccactctgctcccacttattgggcattgtgtcacacatgtaacctgaggccacgaaaaattgagaatggacacaaaatgctcctcctgtgccacaagcaagaaaaataatgccaggttatgaaaagggagtatatagagaaacaacaaaaagtgtgcaaaagtcattctgcaatgtcacaaggtttgcaaggatagttgtggcaagataaaccaatttactgcccaggagtcgtttaggtggataacctttcccaaatacttggtttgaccatacattaaaatggaccactctaccaatccgttttcttgtttttgacaggaagtatcctataattctgcaacttctcaacataacacagtgtattaatcgtgtacagcttgtaatgaatacacatttagatgaacaatggaagagtgtagaaatgccaaggcctaatctaaacgtcccatccaaattacaaaacaatcagtacaattacaatcatttgctttcagttttcatggtagtaaaaagaaattaaaatcaaataaaaaagaatgaaccagcacagtccattttgtatcttctagtgaaaggaaatcgcattgttgattcctgtaataatacattaagggcacacaaagaaataagtatccactttgaattgcccaaagactaagtagcatatgccttccctgaagtatatttcatacttcttaataactagagatagataattcacagaatacacgatctagggcctgtttagataggaagtattggattcgatttccaagactaattcctcaagattataaaaagaatgaaatttcaaatctgatcaacaccagatataatcacaatgaagttacaaaactagttaaacagagtagaatgatccaaagttttatgtttcaaaaccaagggcaggagcttggaatagtccaaactacattagttggagcttgaatgccaaggaaaaaccaagatatgcagtaataattaaggaaaccatatgagcacaaatcactacctcccgcagatctaaatcttgcacggctaacatttgccacgtgacacatgccaaaagcatccattacttcatttgtgaagaaaaatacacatagcatgcgtagaccaaaataatatgataacatgcaatttgtcgcactgattgtttcatgaaagcattcatggatccccaaaacaagtggcggagggaggggggaagcaagcagggcatggcctccctccccacatgatttgatacctcctatgttaaaccagctccctcatatcaaataaattcaggatttccggctccgacacccacaatagaacacaatacacgctaattaagccactccaccaaaa

SEQ ID NO: 57526 - DNA, 7990 bp, Oryza sativa
gaggacggggaccgcgaaggactggctggggcaggaaatggagagcgcggcgggggaggcggccgggagccaggtgccgtggtggcggagcttgccccgggcgacaaggcggaggccgggcggcggcggcttggacggatcccgccgcggcgtcctgaagaagcgcgcgaactccaccgcccacttctgcctccgccgctgcggcgtcggtcgcgccgggagaagcgccccgctgcggacgtcggcgtccgccatggcgacgacgaggatgattgggagggttcagggcgttggggttttgatgcgcacttttggtgtggagctgttgagtggatgtaacaattacctgctaaactcagatgagtacaactctgtaaaaaaaaaaagacatacgctagctataaacatgtgtgtccatagttaggattgaattttttttttttaaagatgaaggggtagtaattagacctccttcaatgttcacactgttcccctgatgaggcatccataatgtactccaaacagcaatagtttaaccctgacgagtaaaaggagtatctatttaagtcatgtacaacgaggcttatttacggattttctccgttagtgtgtaagtaaatttggtaacatgaaaaaaaaagtggatgtgtgtttcatgtgaaaactttctatatgaaagttgttctaaaatattagattaatccatctttcaagtttgtattaattaaaactcaattaatcacacgttattaccacctcgttttgcgtgaaccacttaatctttatcttcaactttatcttcagaagattcaaacaccaccttaggctacattctatttttcaaacttcaacttcaacttcatcgttttctgttagcacgcttttcaaactgttaaatcgttttctgttagcacgcttttcaaactgttaaatgatgccttttttttgcaaaagttttctttgtagaagttatttaaaaaattcaaataaatccatttttttagtttatatttattaatacttattaatcatgtggtaatctgatttctcgttttgcgtgcgtcaaaaacctctctcaaaacacgagttgactcttaccttttttaaaagaaattttgttgcatggagtggagaaatggaaagaaaattaactaaatatattaggtgaattgatagttaagacatattgttgtcttaactattgtaggaggatagtctatgtttgaactaagagctcatgtcagactctatctttgtacagcctacgcctagatacctcaagagcacactataaaagggagtgcaatatatagatatcttgtgtattatctaattagaaaaacaaatggcatgttcctctcttttctgctactcttttctctctcccctaaagatcggttgctatccatcatacgtttttttaatatatgactatgttgacttttgacgtgatatttgactattcgtcttattaaaaaattatataaatgtcatttattctgtcgtgacttatttttatcatcgaataaagttacacttttacatatttacactaaattttgaataaaacgaatagtcaaacattatgtgaatagtacctactactccgtcccaaaaaaaacaaattcctagctacgaacctggacatacatttgtccaggttcgtaggtaggattggacttttttttgggacggatggggtacaatggataggaccggtactagcatgctctccccctctctctgtctctctctctcgtcttatgtcccctctaaaacccaaattatggatgctctaagcattgctgaaccagtaaataattaattcgcaccaagcaatagcactaaactggtagtaagatgaaaaaacattgacttttttctatgtattgatcctcactcctctctcttcatgctattggataatgcaaaactttatattatcataggacccatcttatagttagttagacattgtggaacttttaacaatagttgcctacttttattggatcccaccctatctaccggttggcaaagatatattggtgatacccttactcgtcattcacagtgtgatgacgtggcgagtgtttcacccactccatgtcgacggtacagtgccacgttggacaaattcgtgcttctgttgtgccacttgtatcgtctagagcacacgggtgcctcgtcagagcaagaggactcgtgggcgaaagcacgctcgtgtacatccagttaatatgtagaggccgggtttataatccattgtctagaaaaagaaaagagatttttctgcctcaaagctttgctgcaaacctatgcacagtccacggatctataaattaattttcagaaagcatgtatgataccaatcattatggatgaaaagaagatgctgatcttggctgaaactagtggggggcaacaaagccaagagtaatggaatttacccctcttatagatagaaggttgcctatcatccataacatattttctatcttagggaatgaaaactaagcaatatgttttatctggttcggaaagaaacaaatatacaattcagagctgataattccaatacaaatacgaataactctcctgatatgaatacgaatattgaaagatctagtcccctaaccttgtgttatgtgaagttttggtgattaatgacaacatattttgaatctaaccattgctatgagtttgaataataggttatgtcctggcatcaagcaagaagattgatggcttacatgttgaggatcaatgataagattttggcctaacagatagagatgatgcctcacatattatgaattaacgagatgcttgatgagatctatggacttgttgaaggacatacaccatggttgaacattgatagaaatgaagatgatgtgagaagctagaagatggactttatcgatggatgagattacctatgaaattgaagaaattgaagacgcggggtatgaattgattacctatggcaagaaggtaaagcgcaagcaacgctcaactatgacggaccatgcggtggtgaagggcaagcaaggggcttggcaccgatgaaccaaagccacggattattgacatcaatcatttgagaaatggaagatgaaatgccgaagatcaagaagatgtgatttgttagtaattaagaagagcattgatcaagagaaagatataactaatttaggaataatgtgcttattgagttataggaggatagtcccggtgatgaaatgactttgacgtaggtaccaaataaacaaagaaaatggtgtcaaggtattcctattggtatagcttttcctttttacatttaagtttaggatgacgtactattaagaggggatataattggtcgaatactagtgctcaaaatgatttatgtttgtgtgagttgaaaaacctaagccaaaattccaactccgggttgtttcacatgtcacaacacttacatcgggtttctttgcaagtttttcaacttattttgaaggttttggaccatcttttatgctggatttgatatcccatgaaacaagctttcagtagagtccaagattatcgtaattggattccgaagtaaaaatgttttgcctttttacttaagcaacatcagactacccgatttggaataaaactatctgatgtatcagaatatccgattttttacagaacttcactctctgtcttgatttgaaaaatcctctcaagtgagtttttgtaagtgtaaatcagagtatctgattatgggtcagataatccgatgacacagagacaccgaaatttcatggaacctgagtctccgtttgaggacaaagtttttgcttctaaagtatcggactgtctgattccacatcagatagtctgacgcctcagaaaatccaaaatttcatggaacttcgttctctgtctctcatcgccttggaggtatcatgtatcggatagttcaacgtaggtaaagattcccttccagcagtcaaattttgggggatctatataaaccccccaccaacccttttatagggttagccctttcattcaaatctttgtggcttgtggatttgagctttatgctaagtgctttggatttttataggagcatctgtttatattggattctatggcttagtagaaacgatatggtttttaacaagactccaactaaatcttatagtgcaagatatgcttcagttctagggctaacttcaaatgtgtcaagaggacagagaggtcatttgccctctagagtcatacgtcatgtagattttcactacatttgaatggagatttagtaataggcttgaactttaaataagttgctcatttactttgattggtgttgttgtatcgtcttttcatctcctttattttattatgttatgcttggatttcgaatcaaaactgagatagatagatagatagataaagagagagagagagagaggatgaattggtgtttgaatttatataaacattagacttgcaaaataagttatttcttccgctctccgcacaagcaacgcaaaaaatctatgatgaatatgacaagaagatatcactccagatgatgataacaatgtgtggaactacctataggaaaataacatttaccaatcgaagaaggtatatgctcattcctctttgcacattatcaaccagttgtccctttgcaactaatttggaagagcaaatgtagcatgaagttggaggtttgcatatgattgcttctaacagtttgactaaacacaaggaatatgctacaacaaataatgtttacaagacaatcagggccaggttgtgtcatttgcaatgagtcagacttcgaggatttcatacatctgttgttctttgtatgtgcctttgtgaggagcactagcaacttatcagaattaattggttaagcctgtttagatcccctggaaagttttttcaccctatcacatcgaatgtttggacacatgcatgaagtattaaggccctgtttagttcccccacaaaaattttacaccttatcacatcgaacgtttgaacacctgcatgaaatattaaatataggctaaaaaataactaattgcacagattgcgactaatttgcgagacgaatcttttgagctaagagcaggtacaatagtcctattcaggaggctccaaaaagttttatatcattaaattcatgcataaatgagagagaattgaaaagagagaatgaaacgggcgactaatctatcgcccggcggtagcacagttgcacaggtgattccgtgataaataaaaaactagctttgtggggccacaccgaaccctatcaatcccgtgtgacttttttccttgtatcggctctcacctctcttgctctagatcgcttctttccgcacaaatcgcctactcctccacctgagccccaccaccattcatcggagtcaatttccacagccatcagaaaccgcgtatgccacggaagctccgccaccgttgccggattaaagcccacgcaccttatgatcctgttcctctcatgctcagccatcagatcgaagccagatcgatgctctccttatgaagaacgtgttgttgccatgcgagatctcctaccgccttgtggctgtttccgttgattgaagcaaacaagtagctaggagaaccacgagaagtggttctgagttttgttgtgtcagtggatttggggatcttttttctctgttccttttcccttctgctctcgatatatgcatgttgtttatttacacaaagtagatggatttttttaggagtgatgtagttgtgataagatttggatcttcccatcaacatttcactagcagtaattatgtaaagcctaatcaattcttttactagttcttgttgatatcacaagttcacaacatacagatggctacacaggtatagtttagttttgatcgtacacatttatgtggacatgcataactaattatgattaatgaggtgcagtctacataaaagctaatctattgtactagttgtctttagcattagctacaaaataatataaaggtaagtggagccagctgttggctacattattgatcttgctctaattgctctatgatttgacaatgtggtgctacagtaaatatttgctaatggcggattaattaggcttaataaagttatcttgcagtgtagaggcggaatctgtaatttgttttgttattagactacgtttaatacttcaaatgtgtgtccgtatatccgatgtgtgacacggcaaaaattttcaccactggatctaaacacagcctaactatgatggaatttatgaatatgttcacacatgccaagtcccaattttcacaacctttttcgttgaagtggttgtaaaagcaacaatggaatatttggatgcgcaggaaatagttagccaaggttcttggtgtggaaataaaaagtttaagttcaattttggctctccatatgcactagccagtaaagtcgcttgttcgcacgactatgccttcctacctattaaatgtaatatgatgattataattatattgtaaataagctattaaagaataaatcttaactattgaaaggtaaaactcaaaatgaaacgaggatgagccacatcattcgataaatattagccgttggattcactacaaaacaaaagaggataaatgaatcttgaccgttggattagatggacagtgaaaataataatttaagaggtttccggagatgaaactactagaaggaaagaaagaaaggaagggcaaagctaaagaataaccatatgaaggtataatgttatacatataatttatttacgatttgcatctattgtaaaaactattttgctaataaaccctcatcaaaatgtatattcatttgattaattttgtttctaacaattaattttaatatatttgagaaaaaaattactattaggacatgcacagttatggttgcccatataattttaatgattttcacaggattttaaatgaaatcaaacacattccttaaaaacctacaaaatatttatgcataaggtataaaaagcacgtgccaaaaaaaaagtaagggggtcatgcagccacaaagacctacaagacaataacttataaaatctgtaacaaatattaagctatttagtgtattatcataatattagttagcctgacctatgtttttttacgagcaacgagaaacccataaataaaaaagattaccactcccacataccacataatagaaggcctagagtcgcgcgattgagcgacatcataggctagttttgtaggaagttcagttacatcttttatttataataaacaatattttcatgatcataaataattaacatacctagcatgtaaaatttatcgtaaatatttatattagcatatgttctcaactttgtatatattattagcaggtattatattttattatcaatccaggtaatttttgaacaattattttaaagcattaatttctgaacctttgaagaaccttgttctgtactgttgaaagggagcacaccacgcttggaaaaaacattagttttttttttctaatattctttttcgagcttaactccagatgctctcccttttctgatcaaagttaaattactatgtttttattactcccatgttttcttccaatccttccataggaaatgtcatgaatctcctcctgccctctatatttctacagaaaatctactgtacggtgtttcgtcggtacgggataaattaaatgagtggataacgtttcgatcttatcccttctctttctactccctccgccccataatataagggattttgagtttttacttgcaacgtttgactactcgtcttattcatttttttaaaaattattatttattttatttgtgacttactttgttatccacagtactttaagcgcaacttttcggtttttatatttgcaaaaaaaatttgaataagatgagtgggcaaacgttgca

SEQ ID NO: 57527 - DNA, 8469 bp, Oryza sativa
tcccttatattatgggacgggagtattctctatccaagctttcatcatcctcttcctccacctctcctccttcgtccttcttttttccccttctcgtcctctcagctacagagagctatgtgtaggcatgacgacggtggagcaagccacgaaaaatggatgtagaggcctaaaccctcctcactgctggatctggcccaggtgcatgttggctacaagggtggcggccggcaccactcatgtggcctcctccttcgcctcatgcttttgaggtatggtggcacccactggatctagctctcatggccaaaaagggcaaccaagaagaggggaggccgtcgggaaggttgctggccggcatggggtccttagcctccttctaggcatgttgttgatgatgatgaaggggcgcgaccaatgaagcttgtggatctagagctttcatttggcagcgacatgatgacgacttggtgagccatcatgttcctcgctggagtgtgtgaaggtatgccgtgcaatgcatcatctgcagtcgatacccataggtatcatgtctggtacctttggtataatggctaatacttaggtatcatggctgatacccatgtatcagacccggtacctgcgggtatcatggctggtacccacgggtgccaagtttagtacatgcggtatcatggctggtactcacggatatgagacctgataccttaggtactagggtcgatgcctacaaagtatcaagtagcaacgtttcctctcattttcttcctttccctcggttcgatcccttgctgctactgttgtgaccagtgttggtacctacattgttgtaggcgctagctccagacgtgggggcgccaaacatgtggagtaggagcaggatggctctaaatttataggaagaaagcaaatacgtgggatgacgtcagccttcttaaagtgtcccgtttggacggaatcccgttctctaccagccctcaatcttcctttctcctagcatgcatggcaacatatcaaaattataaataaatttcaaaattttccatggtagttcccattcagttttaaacccaatattatatcattatataggtgcttctaacctatatcaattgattaaaaatttgaaggaaaaaaatcgagacattcggtataatgctactccatctcatcctgcaaacattcagtacaaagtatagtggatcgattttaaaagactaggaggtaaaagtgacctacaaggtcatatgccctgttggaatagttggagggaccgagagagtaaaatgacaccattgcaatttgcaagaggaaaagctggatctatggaaaagactgcctccctccatccctaagtgcagttttaatataagaattcatcattaaagatagtagtctactttcagatctctttaatgcagctacatctttttcttcttatttttagccattgaacctccctcctcattctcttcatattattattttttttagggaactgttctcttcatattattgaaggacatggtaattcttaacctcttccttaacatgtcaaaatctagggatggatggagtagaaagtctgatccattaaaagttcagggaaggattaacagaactgaactttttatacttgttatgccatgaatccgtgtgtgccaggagttagcaaacggtcagcgcaacctatgagtgaccagatacacatgacgaaggtttttccttcttagcatcaggaaaatcaatatccgcttagataacaattttgaagaaccacaaactctactctgtaatggttcaactctaaggcctaagctttcacatattcacgaatgaattgctcaactgctgaaacattaccagtcagaccagcccctccgcgactgtcaccctgttctggcattgattgaagtaaaatgtttctccagggttcccaagcttcacttcatcagtggtgtcagcagatgatatgtcttttcttgattctcggagcttgtttctacaaagtaataaatcaagacttgttagaagccttgtggactacagatttacttcaattattgaacatgtttgtggcaagctcttatataggtggttcaagtatgttaccctatgtactccagatagtacttgtgtacacagtaaagttgcaacgttacttatagcaaaacacaccaaaatcttagtgattgattatagatgacatcacaagttgatgcactagttatgctagtatgatacgtcaaaaagaaaaccatacatttctttttccaattgcttcttgatgaattcttttgagtgagccgtaactttatctgttttgttgcagaatatcagaacatgaatcctcttcttcactacagttgcctttgtcagaatgtcatacaggtacctgtgataagggaataaatttgagacaataccaattgcaacaataaattgacacaacacacaatttaatacttgtcctggcatgaaagaaggtcctagtcatactcctaaattcaatccagtaagagatgtagactgtagttcaattttagctaaataaacaccactacactcatttttagtaataacatggattacgtcagcaaaattactctgcaacgacttgcatggtggacaagaaatcttgagcatcaacagcaaaaactatcccagctgcttgaggcaggacttcatcaagcttgggtttgagccctgcatgaccaggaacatcaacaacatgaacaggctttattttgcttttctgcagagaacaagaacagagatcaagccatctgttcaattgcactttagtcagcaaatacatgtttctacataaccagatagtcttcctttcgctgaaaatatttctctgtaatgagtcgtcttaccctctccagctctgaatgaagcacaaacgtatcattgttttgttccattgaaatcacagttccttgatgtgattatccatcccgaagctaagggaaaagcaaaattagcacagagacaaccagaagaatctttctctctattcactaccattccgcgtattcgacttctattagtttcttttcttctttaatgcaatagctatagtttgatatagaatccatttctcaaagtaatggaaacctttctcttataggaaatggttcgaaaatcgctattccaccttttaggtatcgtgaaaagtgatacctgtgaagatcgtgcagatagtctcaaggcaaattaactcgaaagggcaaaaatgtgctctgtctgatgttgccatacaatatatatcacagacgaattcagatcggagcatattaagtcgaatcaaggaaacaagaaaagtcaacatagatgcccaatagactacaacataacaagcagaatgggtagttcattcggaatagtaatttactgaattacactggagttccaaattggtggccattaaatgtttagtcattattcatcaatttgacaaaattccatcttcccacttcaatccaccagaagttgaataggatgcctctcagggaataagaaacacaaacacaaaaatgccacacatagtcatacactgaaatagcatgattgaaatagaaatttacctggtagaaaagaatacttttgccaccaccaccgagcccagataggcagatagcacgaaactgcacacacaaaagcagccagacattgctcattaatttatgtgcttgtagcaccagcaaaataacatagcacaggtgcaactttagatttagaagttccacttgttggtgacggtgacttcaactatacccattgagaattttctgtgttcttaagccaggaatcaaatacgtgcaatgcagctgatcagataaattaaagtcaaactaggcagtacgagttactcaaacattatatcaacatgttcccgtgacaagggtgtaaaaagataaactcgggctacgaacagtcttcgcatcatatacataagcttaattgatcatagttgttaatataaatagctatagagctcagctacccaatcagatcaacagctagttcattcatggaattgcaggggagacaacttcagcaagtttttaactccggaaacctgatttgagttttgattacagggacagaagcacagcgtacaggatgcaacaccactatttacacccaaatttggcacctaggattaaaataggaaagattgccaaaatttggaagtctaccggtttccttcgagtgggccggtctgaccgccgtgtgttgggtggtcagaccgccagttgagggccggtcagaccggcggtgtgtggccggtataaccggcaggtccgagtccgactgtgtttcgtcgggtctcgaggtttccttgcttgggaaggcatgtttcgggtttcctttggtttctgtcccgagttggacgtggagaagggcttgtagagggcaagaccaacccctatataagggacatggccggtttttcatattgcttttagtgatctcttagtttgtccatctttgtcggtttgcgccgtaaaccgtctgccgccgttgcgagagtgcgacatctctttgtaggtttgtcctgaaaaccttccattttgcccacgagacgggtagttatttagaatcggctccgctagccagtttatttgtcaaaacccatctaggtctagctcttgctagatcgaggtggttggcgactctagggtcaccgcaaggcataaggtgctacgatcgtagttgtcaacttgtcaaaaaaagttgccaacacgatttttggcgactccattggggagatccgttcagcgtcaactcaactttgacttcgccatgacgaagcagtcatcatccaaggcagaggtggagccgaccaatgtgataccaatcacattggatgacttcgaaggggaagatcgcaagtccatggaggagtacattaaggagatcacacaggaggcgttgatgagggtgtgcactaggacttgtcaaggcgtgatcatcaagcccgggccacgtcctaagctcactcccgatttggtaagcaatgaagaggtaacacaatctatccaacaacaagttgcatctacaatagattcatccatgattatttttaaaagtaagttagatgcaactattgaaggtcgatttgatgagtttttaagaactaaattcggccctctcatggccaattttatgttaaaagataaagcctctaccagtgctagccaagctcctatagatcaaacaagtaatggaaccgatggagcggcgcagacagccggtccgaccgggcctgatggccggtcagaccgcaacttcgccgtcggtccgaccggccaaacggccggtccgaccaggtattatcctggcggtcagaccaggactcatgccggtctgaccgcacctctggacgtcggtcagaccgggccctggaccggtcagaccggcgcaattatttcgattcaggggatagatccaatgactaatgctagttatttgtatcatcttagaacatttgatcctcctgtatctactgctgcaattaatccccaagttcccccacatgttcctaatgcttataatgatgttgctaggggatttcctcccgatactaggcaaggccaatataatcatattgcgccacaaacacaacctattaggccaccaaatccaccaccaaatcaatataggcctgataatatggaggaaataattagtgggattattagggataaattcgggattgaagctaggaatcgtgctaaggtataccaaaagccatatcctgattattatgataatgtaccatttcctcgtggttatagagttcccgaatttaccaagtttagtggtgaagatagtaggcccacatgggagtatgtaggtcaatttttagcgcaatgtggtgaggctaatagtgatagttttaaattgcgcttgttttctttatctttgtccggtaccgcttttacatggtttacttctttaccggcaaattctattcatacttgggctcaattagaacaaagatttcatgattatttctatactggaaaaactgagcttaggttatgtgatttgacatcgattaagcaaaaatataatgagcctgtcattgattatattaagagatttagggatgttagaaaccgatgttatagcttgaatataactgatagagatttggcttgtcttgcttttaatggtttaattgctcctcttagagaaagattagatggccaacaatttcttgatgttagtcaacttatgcaaaaggctctggctcaggaaagccgggttaaggataataaaaaatttattagaccatatgagaaaaagcctaatgttaatttgattgattaccctgaggctagtgatagtgaagatgagggtgatcatgatatgtatgttgctgagtggtcatggactaacaaaaataagccctttctttgttctaatctaatgccaactcctcgtaaagatcggcaaagtgagattaaatatagttttgatgtggccaagtgtgataagattttttattatcttttacaagaaaaacaaattagattacctacaggccatatcataccatctcaagaagaattgaaatgtcgagcttattgtaaatggcatgattcccactctcattctactaatgattgcaatgtgtttcgacgacaggttcaatcggccatagatgaaggacgattgaagtttaccgatggttctaagatgaagcttgatcatgattcttttccagtgaatacaattaatttcaatgataagaaggtgttgatttggctggagcaagccgaatctactaagggaaaaggagtaatcattggtgaaccgaggccaaagatgatagtgccaaagaagccggaggttggtgtttggaaggaaaataagagtgaagcttcaacttttaaagctcctaggaagaccaaagtgacccttgatatgcttttggaaaagtatgaaaagcaaggtggtgagagagctcgcaacaaagggaaaagaccaagatcacctcctagggagcaatttggtcactcaccaagacggtcgcattcacctccataccatcattcacaagacatgtcatggggtccttatccaatgccgccgccgggttatccttatccttattacatgccatggggggcaacaccgccaatgttcaaccatgtgcctccaatgcaattcaaccaagggtggggaggactaaggaggccaatctatgagcgtttgtcttcgccaaacaatggccggttttatggtaggaaccgggccaatgaagagaagagggaaggaaagcgtattaaggtggaggcaaggacttcggaagtgattaccatcaaagtggggtctcatgatgtgccaataccttctggagatgaagttggagagtcttcaagcaacaaacccgaagccggtaccagcttatcgcagttggccggtctgaccgggccttctggccggtctgaccgcagccatacggccggtctgaccgggccatctggccggtctgaccgccgacccgacaatagtccgaccgacgcctcaggccggtctgaccgcccaccaaatgtcggtctgaccggcgcatctggccggtctgaccgatggtctacgtccggtctgaccaagctccagcgccagtttgacaggaggtttgcaaaggacaatgcgggggcttcatcgtcatcaagtaaactcaatagggggtactatttacctcctggaacagagccgaaacctaggtggatgcctaaggatttaacggctactcaaagaagaaggttgcaacttcttcgggcccaagaattgagagaaaagaaggccgaagaggaaagagatagaaagttcaatgagttgcgaccgccaccggtttggagacgtaaatccgtagagaaggaagaaccggttgttgtagagaagaaggaagaacaatcggttgataaagatgagtcatctccaaaagaagacatggatatcaacatggtatgtatgttgtctatggagttttgtgctatggataaagccgaggttgcttagttttctctaggtcctaaagatgcggtttttgagaagcccgatgaatcaaaccgtcatatgaagcctctctatctcaaaggtcatattgatgggaagccggtctctagaatgcttgtggatggaggtgcccccgtgaatttgatgccgtactcgttgttcaaaaagttggggcgtggagatgatgagttgaagaagaccaacatgattctcaatggcttcattggtgaaccaacggaggcgaagggtatcttttcagtggagcttaccgtgggaaacaagacgctaccaacagctttttcatcgtcgatgtgcaaggtaactacaatgtaattttagggcgttgttggatccatgccaattgttatgtgccttctaccttccattaatgtttaattcaatgggacggcaatgatgttgaaattg

SEQ ID NO: 57528 - DNA, 988 bp, Oryza sativa
tccgcgttaccggccacatccaatacggataactgcaaaaaaaaaaaaatgctaaccgattgggagaggcaatgatggaattttttggtattccgggtcgttgttgtgttcaatatgtgaagcatcccgttcctctcaggcaaagaaagttccaattcaactggcaagcactgcaggtgactgctgaaacccccatatgttggtgtgtgccgtgctcatggttatcttgtgccgctttaagtttctgtagaaggtttgcgtgatgtcattgcatgcactgggggctgtacttatactgatctaattgtaagtttgtatattataccatattcatcaggctatgttcaagtttgtaccacttagggtgtgtttgaggattggggagattggggagattggggagattgggaagatacgcaaaacgaggtgagccattagcacatgattaattgagtattaactattttaaacttcaaaaatggattaatatgattttttaaagcaactttcctatagaatttttttgcaaaaaacgcaccgtttagtagtttgggaagcgtgcgcgcggaaaacgaggtgttttctctctcaatctccctcaatgtcctccaaacgaacgctgccttaggttgtatttctcattgatcagtatattgacatcgaagtatgattctttgtatttggtaaccctgtgcacatgtaacagcgcggcgtgcttatacttcttgtaatataaatgcttgactccgcccgccccaatcgatcccgagctcgagcaccttggtcacccatcccgttgtttccccactctgttccaagctggtccttccggagcttcgagtctctgccttggcttgggccaccactccataatttttttttagataatggaatgaaacattcctacctttgctcattagagctaaagccaaccactttctccctacattccattttccacatttatttaactggccgattgcaccat

SEQ ID NO: 57529 - DNA, 1419 bp, Oryza sativa
aggagaagaacacacaggcatattatttattaacaagattcgttgtgttttattgtactccattaaaggcccaaaattaaaccagcacatcaaacatgtatgtgaaataagcaaatgcatgatttattatgaccaataatttacttctttacacaaaagcttaagaaacagtataagccatactccccaagattgccaatttattccgaaagatccttctgcgcctcttggttttgcactatgaaggggaaaaagaaaagggacaaatggtatacaggttatactgcattgtttcccgggaatttactctttccagttatcacacttgcggagggtaaacccccaaaaaggtgctaaaaatgcttgtaagttgatcctcctaattcccactataattggaccgaaacaaccaaccaaaaaaaaaaaagataaacagaaaaagcttttaatccaaaaaacaggtcattctgtctatggttatgtgctcttggttttcgggtcctccttgacagaacaccgtgccggtattatacaaaatgagatagcaccactctgcgttattcgagcacatgagaagaatagttttgctgatctttaacttcacagtaacattgagtttggattctcgatatagcccttgaatgctttcagaaattctgcgccgatagcacctagagaaagcacacatgaacaaagttattttctagcctatggtccgtagaactatcatgtattcagataaggcttaagagtataccatcaataaccctgtgatcacagctcattgttgccgacatgaaggaaccaaactcatactggccgtctacgctgccaggtatcaccctcttctcagctgtccaaacaaaaaaaaggccattaagtaaataatgacaccctatgtaatcatcacaagaacactgcaacgtgaatggaccttcttagcagaagtttatctagaatgtagaaacgtagaatacagaagcgaaaggatactactctactacaccttgaattctatgcttaagccctgtttataaaaggctaaatgctactaagcagttggcactctgtaacatcatgccaaatttctgagtagaagcccgacttaaaaataataggatggggcaacaaagataatatgcttctcaaaagatactagaaagaaatgcagataatacaggatgctaccgttattattacacaaacatattagcatgacttaccagtaccaatggccaagagtgctgactgaggaggatttatgatgcacagaattgtttgattccgaaaggaacctcctaggttttgatatggtgaatgtgcctccctgaaaagcaccagaattttcaaggaaaaatgatgttgtctcatgcttatattagctaccatgcgatccatatacctcatatcggaggtttt

SEQ ID NO: 57530 - DNA, 12565 bp, Oryza sativa
ccttcaactacaaacccatcaggttgatcaatataaatctcctcatccagctcttcaataaaaaaagctgtcttaacgtccatttgatgaaaaagaagtccatgtgagactgctagggaaagtagcacacgaattgtggtcaatctagcaacaggtgaatgtcaaagaaatcatcgccttctttctgagtataacccttagcaacaagccgagccttatgcttttcaatagtaccatcaggcctaagcttcttgttgaacacccacttgcaccccacaagtttacacccatagagtcgctctgtcacctctgaagtcccgttagcaataatggaatccatttcactacggacagccttctcacagtagtctgcatcaggagatgcatatgcttctgaaattgacttaggagtgtcatacacgaggtacacagtgaaatcatcgctaaaagacttagctgttctttatctcttactcctccgaggagcttcattgtcatcctcctcaatgacatgttcatgcatatgtttatttgttctgatggtgtggtgtgattgaacagggaattatttcagaggattggctagaagtactatgtgtatccttcattggaaaaaaaactctcaaagaagatagcgtcacaagactaattgtaccaacatgtatgtcaggtaccacagatttaactattaaaaatctataagcaatgctataatgagcatatcctagaaagacacagtccacagtcttatatttaagtttgtgattcttcgttactggtacattgactttcgccaagcaccccttgtgcgcaagtaagaaagtgatggttttctcccaatccatatcttatgattcgaggtcaacaatgtctcctcgcaccatgccttagatagtctcgcggtgtccaacatgacattcttcttttaagttcaaacatttttatcccattgtcacgcacatgcattttttctatttaatattaaatgacccatgcaacgctcaggttgacagccagaggaagtacctgcttacttcctccgtttcacaatatataagtcattctactatttctcacattcatatttatgttaatgaatctaaatagatatatatgtctagattcattaacatcaatataaatataggaaatggtagaatgacttacattgtgaaacgaagggaatacatcattagcaaaatattagacacactacttgacattgaagatagcctctaatttacctcaaaaaatagagaaaaagaaggtagtagctgctagataaggtgatgtacttccgagggacagagtcagcactaacattacttgagaaactacttctttgcaaaataggaaagcagtgatgcttgtccaaccgaagcaggtttcgggccttttaccttctttttcacatgaacaggagatctgccactcttctccatcactttatccgcatgaacttcatcatcctcgttcttcctcttcaatcttaaagcatcttgtttctgtgttgcttcgtcagtaaatataaggtcgtcattcttcatggttttagccttctcgacatcatgttccaaagtgataggttgatcattaaatatagaagcatcttgctcctcttccacttggtgctggtacgttttatccaattggttttctgctgattcatgccattctttgtttgcagctcgaaaggcttttgtttctgcgtgatcctgatctttcttctctgatttcactggtttcttcatgaagaatgtcgagattggcttttcactgggtctcatctgtacctgcattttgaagtggaacaaaactaatcattgcacatccttttgctttacagaaaacacaaaaagaggaaagctaagaaattactatccagtgaagtcgaattgataggcaccacgcaaggacatggcatcatcttatcaatgcagcgtcaacaacagaaaacaagaaaaagctactgcttaattgtatatacttcacatattgtactttttgatagctctcattttagaagtaagaaacctgtagatctttcattcttatcatttatgacatcatgagcattttatatttaacggaggtattcaaggtacatcactgaaccacatttacatgttatctgaatcactccatcaggtacaagcgtggatccaccatagaatcattgaggtggtcatgtggccctaatgactattgaaagtgcagttgaaaaaaaatgtaactttgtatattagcgacagattataacacatctgagagtatgctacagctgatgatcacacgactacccgccaaatacaacaattatgggtgtcatagaaagtcaaaatttctgtataatttactctcaccattcagtaaaactcaatttcttgaacttcacaaaaacaattatttgacagaacaaagcagagctttctacctgtttgatgcactcaggaccatcaaaagatattttgcctattgcagctgtgacgggataccaaacctgcagaagaaaatgtttaaaaaaaatcataattttgatttgatcattaccgagaatcttagccactgatctttgttctcttactctcctaggtttcaaatgggccagaggtcttaagagattttcaattcaggtcaaagtgaccatttgagtagcatgccatcctcacatatgactactgatttaacgatgcagaagctcaccacattcatcccaaacttgacaaagtcttggtccagaaaattggacacacaacttagcttccccccaggaaacttgttttgtggtttggcagcggctccaaatgacgcagtgtgaccgagtcctcaatgggagggcaaggcttaatcccttgccacctaagggcccttttatggaaatgcgaatagagaacagaggagaatgttaatggaagctcgctccttgattaacaaatgaatcttgccttccatcctcttttataggactttgtctgaacaaacttaataacctcaactgtcttgaacaaaccaaacctaaactgagagaaaactgatcctgaagcagcacaattcaatcgcagtgcaggtgacttgttcggttgcttcctgcgctcagtgtaggcgattccccacataagaacttgcaataactaattgttcctatggcatgtgcaacctacttaggaaatagtttggtatgtttgacctctggtcaaaatttgtctttgctacttcagccgtaatagtagacgctaactcatgcagggaagtagatcaatcagactgtcataaatacctcgacaactgctattctagctttttacatgtctcttgaatgaaagaacattcctctatgctttgcttcaatctcttctcggcaactttagtccaataatgaaaccaggaatcagcctccctctagtattggataccatgaaaataacaatatgcccccctcccaaaaaaaaaaaagaaaaagagattgtttcgtacaagcatcatggataaacttgcctacgtaggaagtcacacatcgttaggacccacccggataacttaatgcttcatgagctcggatgctacaaatattttctacaaagaccatggatgaaggcaaagaaacaagcaaaagaaactgagagtccaaaggaaaagtacaatgaagttctaatcctcgagctaagatgaagcaagacaatgcaagtctcgtgaaatttgctttatgttcatgcacatgtatagcatgatctaactttgattcataaaaaaatgaacattttgatcattacctaaatacagcaagctaaagaggctaaagctatcaaggaaatgttggagcaaagcatagagggatgttctctgatacgacaaaaagcaagagcagttgtccaacaataagaaaggtactcataagaatatgatagatatactaatcaaagttacaagaaattagcttttattggctgaagtggtcaaggaaagtccagagaatccctctgtgcaatgaattttttttattttttagacttatatttttattttttagacttatttttttaatttgattaaaagacaattccaaaaagtatttccaaatctagaccttttggccacaccagcccgcctagtgtggccaaataactttgtcacgccacgtgcagtttgcgtggccgcattgtttggccacgccagcctcttgccacgccaccatggctggcgtggccaaacaacgctggccaaaaggttcagttttcgaaaatactttttggaatggtctattaataaaattaaaaaataaaaaatttcctgtgcaaactcaagttgaaaattaagaggcacaagtggataaagttatgaaagaagtgacttcaacaaataatatctttaactccatctaggtaaagtactaatacatcctaacaaggttaagctagatcatcattatgatgattctattgatttgaagattgctcacaacttcacacagtgttgaaaccagagtaaattttgtagcagagacaaagtttgacatttggtgaatgctaccacatgtaccaaatcacaaaacatgacacataattggctatgttggtagctaaaaaggccaagtagcatttcggaaaacttccagattgggcatttgtcgatttttatggtcggcaatgtaatttgtaaggtgcacaagatcaaggagagatggtgatagatttatactggttcaggccctcgagtgaggtaaaaccctagtccatttagcatagattggatctatgttgaggtgtgtgcaaatcagcaatggtgtggctaatggcgcgtatcaaagaaagagtgtaaccctttagggttcctaccgccaccctttatatagagctagggcggcaggcggcgtgcatggtacggtatacctcataatcaaggtacctaccgtctaatgatatgggataggatagactttcttatctcttatccctttctatacattgatgataccgcttgggcctaggccacttggcttaccctacgcagtacggcccaaaggcctctcgtggggcaccagggtaccgtgccccccacaatatcccccgagtacttcgcttgatgtagagtctgaagatgacgacgtcgttcgacaggatcaaatccagctgagtactcaccccaaaattttggatatagattactttagttgggtccgagtggaattgcgaacggccgatttttccttcttgaaggatggaaactgaacttattttccaaaatcagagtcctttcatgggtcggcccgtcaagaatacctaatggcataagtacgcccgacgggagtgttgttgctcaactttccccaaatggcgttgcatcctcctcatctgctacgttctcgagtcagattgggcgagattttccaccgccccacttctctcgccgaagctctttgctttccgcggccctgatgtcgtagtcgatggcagaatctgtgccaatcccgaaccaggccaccgcctggacaccgtcgatgatagaggaagcagtaggagtcctcccccctgcaggagctcatcaactggagggaggctgtcgaagaggacttccaaaccccgaacacagacgagatcatggtcttcctccccttcttccggttcggcctcggtctgcctgccggcgattttctccgaggtctgcttcacttttatggcattaatattcatcacctcagtcccaattctatcctccaaatagccatcttcattcatctgtgtgaggcatactacgacatcccttcccactttgcgtttttccgttatctgtaccaactcaaaccgcaacccaacaagaggaatcctatggtagttggggaagtggcaactagacccggaccaacaggatctggaattttttgatctccccctcaggtccagcaacaaaggttggcgatcaagatggttttaatgctccaatccactgccaagcctacctctatttaccgatcatgctcccgttgttaaagattgctagtactccctccccgacggtggcgagatggatcaagtccgagggttgttgaagggaatcaaatatatgatcaacaacggcttaactggggtcgccgtggcctgcaactttgtcacatggtgaatccaaccattgaaaagccacgcttacccaacataggaatacattggtaagaccgatgagacccgggagaggcaacaaatcatccgcaagagcgaggtcgctaataggatgatttaagttcttcgaagctaggactccgatcaccacggagggatgtcctcatcccctcaaacatggcatggagcgcccaaaggtatgctttgctttagttgatctttggttcacatcttttgctcaaactggtgatagacaatgatcctttgcgttcttctcttttgcagggagttgaagtactcatctccaaccctcctctgcccaatgcccgaagcaagaggcgtgtcgacgatccactgccgagtggtcgcccaactaagcgcgctaccaccgatgagcctagggccagctcatccaagaagccatccggtggtcccaaggtccacgaccgccacacggatcccggaggcctccaagacctccggcaaggggaaggacgttttggtgacctctgatccaagttcccgaaagaagaacccgacgggcttagggggttcacccgggactcctcaagcgacgacgaggacggcgactaccgcctccagggctgctaaggcagaggatgcgactgcaaaggtagcctcccatggcccgaccaggaccccgaagattggggtccacaagacccgtcaatccaccaggtgagttatgattgtgatccttgtcatttctctgattgcggtggagatcgatatatattaatgctggttgatgttaggtgaatcgttgcagggtatcaacgcaggacaacccaggtaagcttgactcgacccagggcgcagacgacgcttctgaccaagccaaatcgaggtcggctcaaccggagactgggccaagagccgagcccagtgccactcaaacctagcttggggccggtcgggtggcgggagatgctgagacggcggcgggcaacttaggctggcccagcggtggcgtatcgacagacgctgcagctgactcggcccggccgagtggcggagatgcagcgggagaggaggtaggtggtggtaacgagtcgacgggcgccgcagctaactcgatccggccgagtaaaggagatgtggcaggagcggaggtaggcgctggtgacgggtcgatgagtgccgcagctgactcagcccaactgagtggtggaaatgcggcgggagctgagggaggcgctggtgacggggttagcggccagggcgatagtgccgccacacccggcacatcgactttctcctccgcccagcccacaaactccacccaatcgccgacctgggaaagaaccgaccggcagggaaggagaggccaccggggatgaagaggatgccgaggagatcccgcggtgtccacatgccttgccatggacaaattatgtctccccccttcagaccttctggttccagggaggaagggagaaggaagctctgaaggagggcttcgatgatgcagctgataaggcctatgccactgttgatgtgaaaacacggcggcctgggagatctgcttaactccagtgcaggtccaaggctagcctcgagtgtgtcaagggcgtgccagctgatttgatcctgcaatcagtaagaaagacaaaagcagaattagtcagccgatagccgatcgaccgaaaggccgatagcgtatcgttggtggtctcagccgatggagttagaccaaatcggctatggactgattatatcaaagaatattaaatcctaaatatgcctaatcggctgtaataatgtctatcatgtttaataaattgattcggagacaatattatgaaaagtaatcgatctgacagtatttagagcaagaaagataatatactagctaatactctagtacaaacctatataaacaggttgatctatataaacatgtcaaacaatgatcaagcatgatagtgcaaaaatctagccgatactgactaaaacttgatatgcttatataaaacaatctgtctatataagtggcgaatacacatgaaacgaataaagaagcatgcatattaggtaagatcggctgaaaccccaatactatccgtattatatctaattgcaagctactttgcatggttctaagcacgactagagatgatgcatctcaaagtatgaaaaggagcatacagtctatacaatcaagcaattaaacacttttcaagatggtagatgccttagctaatctaatctagcaagacaatttagccgaaatcagcataaaccctaaagcgagcagcagccgatagagctaaattgagaagctaagaatagattaactaagacatatgatagcaatgactcgcgatatcgagcttagcatgtcaaaagcgacatgttagccccgatagcgcgggccattgagacgggttacctcttgcaaataactcgctgaaaacgaagaaaaataaaaagggtggcaatgcgccgaagttgtattggattgtctctcgtattacaatgctagggggttcatatttatatcccgagtacaaacttagtccattatggacacgactcaaaaccttctaaagacaaaacacaaacaagaccatatacagcggtctcttgccaaatctctaacaaaccaacataactaacctaattaatagatacaattgccttgttcgagctccgtctctaattggcaatgacggttatttcaatttaggtccatgtcaagcccaagttacaccatatcggctaagtcaatcttctgtccggtttacagccgatacgatactcagccgatgtgtagtccgacttggagatcaactcgattccacaccaaatccgcttcgaccttctccaaatctgatgcaaaattctgttgttaacagccacaatcatgtacaagtccgggctgctcctccttcaaaagatgaaggttaggagctatgtcccttagcccccgacttcaggacaggtgagttgtcagtcatcatgacctaaattgtgcatcagcatgggtagccccccgccagcatggtgtgatgttgataaatggcgtgtcgtgctggcaatgtccttgtgtttgttttgaagccggctagcccccgactccatgctgggaagactataggcgtcgtaggggtggagttgactcgtgttcttgatgtgtgatgcaatacattgttgaacactcggaggccaagagcgacggcgaagttagcaaggccgaaaggcaacggagaagtcgtggccagtgatgaagcacgatgagtcgcggtcggaggatgtcgaccttgttggcggtgaagtccagatctccaaagcggaactcagttccagaagcgaaactgatcgcttggacaaatccaacgatactagggctgaactgttgaagttggccggagtcatcggcaatgaagtcgaaggcgctgaaggagaaaagggtggcggtggggaaagcggtgagattcgcaaaggtgactccataagatgccatctcctcctttaagaaaaacgatctagcgcacccctacctagcgcgccaactctcgatttttatgatcggcaatgtaatttatagtgtgcgcaagatcaaggagatggtgacacatatttatactggttcaggcccttgaataaggtaaaaccctagtccagttagcatagattggatttatgtcaaggtgtgcgcaaatcagcaatggtgtggctgatggcgcgtatcaaagaaagagtgtgtaaccctttagggttcctgctgccaccctttatatagagctagggtggcaagcggcgtgcatggtacagtatccctcataatccgggtaccaaccgcctaatcatgtgggataggatagactttcttatctctatccttttctatacattgaagatagccgcaagggcatgggccactcggcttaccctatgcacccggtaccatgcaccccacaacattcaccttatattattgaatttttaacataaacataactgtgctattagcataaccaaaagtagattatagtacatcattagattggaattttgacagaaaaatattgtttaaattttaacataaccataaatgagacactacagatagatattattataaggtaaagaaataaaatcacagtacaccatcaggtaagaatttggtaaaagaatatcgtttttttaaagagattgctaaaaaaggatagcatattcagtactaatagtaatagcaaactatatgggtctgttcaatcaacttgaaatctctaccaaatttaaggtgttggacgtccgtcatttattaatcaagttttaacacaaacatagtgtgccagtagcacgacaaaaatgggaacaaatgtttcggaatgtaaattacaccaggtaaaagatttagtaaaagtacatatctgtactattataaaaactgaacatgtttccactggaattttgatacgtcacctgtgtttgagttggttgtacgttgtcgtatccaattcaacgtgactctacaataactattatacaccctcttccaacccaacccctcccagcccaaccaaaccaactcacaccaatccaccaccctgtcccgcgtccccctctcctgatcagcgtctttttctctccattttcttgtttgtcctttccttttcttccaatcatcccgatcctctccctctcgttctaatcacctctcttttctcctcttttctgtttttctcctttttttcctcttccaaatttcgctcctcataaatatttttttccttttgaaattatcattgtttaaggtatgtatacagtaagtttgttactttgtaaatgcttttcatctacagtaaaacaaaaagactttcactaattgaataatcaaaattgaatctttttttttcgaacacgcatgagatgtgcatatcatttcattaagcaaagaataaatgttcggacttacaaaaacaaaaacacaaagaaacacacccacattcgcccccctcctagggcacaagagctattgccttggctaacagctcttggagcctagaagctcccgccatacaccatagtgtgccctcattagtgatggacagaatcacatccgccatgctaggagtaacaccattggaaacacaagcatttctgtgtttccagattgcccacgtgaccaagataataagagagttaagccctttcttctcgctcattcgcaacccttttactgcctttgacaaccaacacgaaaacttgcgtgtcatggttcggaagagtggagaaatagcccagacttcaaagaactagtgaccacacttgtctgttgaaaacacaagaaaccaaagtgtgttgcattgtctcatccgcttgatcacaaaaggggcaagcggctagatgaggcaagtcacgcttggcaagacaataagtcatccaacaatggttgtgtatccgtcagccacagaaaaaaaacctacatttaagaggtgcccaattcttccatatcattttccaaggagcaaacctgaccgtctgggataaagaaggtcccatgtgcggatttggaagtgtaaacccctgactttgagaacttccaatagtgctggtctgaaacgcctatttcaatctttggttgatgaggtatagcaaaatacccatacatcaacttacggcatagccacccgatcgatttgtaaggctatggaatggtgtatataaaggattcttcatgtgatgatgcatgaagcgagcgcgaccagattcaatgccattgttacgtttgtttttttttatttgctgttaaattggtatagtttttaaaattgtcttcacatgttgcatcgcacatgcatttttgctagtcattaaaaaaagttaaagacaatgttcagttagcaaataataacatccaaaaaggatatcagccatatcacggaaatcccaataaaatgatgaaagcatgaacttacaagatctgctccttcatagggtactgtaatttcttcgagtttcacagatgcaccgttcaaccaagtactaatggagtctttgtcacccaagattactggcattctatctgttaagtcacatgcagactcagaaggtgccaaatcaaatcaaaaggtagcaagtcataaaaacattgtgtgcaacagtataataagtactcgtatatcaagacctgatagacttggcaaaaacatttttcatacatccattaccagaaaaaggtataatctgttttctcaattaaattgaactacaaggacaacttatcatataaagtaaaatacagatgcatcagtactgttaaaggcaatattgtactatcatcaatgatatatactatcttttaattgaaaatcaactggctttctccttgcctgcctctaaataagatattgtaaagtgaaaattaataggaacagtgcattaacaagctaaacattacaaacttccagtaatgtcactagcta

SEQ ID NO: 57531 - DNA, 14981 bp, Oryza sativa
accatgaagccaattcaaaggcacccttatcacacatgtatcgaaatagtaaatatatgaataatctgagatcatggggggtagagagatctagttaaccacgaaaccctttttagagaaatcgaggcccgagtagtcaaaatagtaaaagtatggatggtttctcctggggaaatagcagataatattaatactcaaacaagtaaattatcattttaccgattggagcatcaaaagtctaaagtggcataatcaattaatccgaacatgtgataaactgacgtatgtgaacagcagaaagtgttttgaaatatgcatcaataattcagctcaataaaaaatgcattaataaaatggttccttaaaatgtagacaaaaggatagcagataagagttggtagtgtgagtgcatgctagacaatttatatactaaatctgtcaatatttgtagagcaaaacgtcgtattatttttacaatcaaaaagccaaacaccaaacatgtagttctgggacattgtacagtggaactcgtatctgaaagcttttccctatcataatgatatgcatattgtactattcagaatgcagttcttctatgtaattaataatgttaggcatttaatgcgcagcgcagcgcagcgcatggcataaattagatttaaaaaatgtgaaacacttgatgacagcactacttcaagttcagtacatgcctgcaaatgttcattatcacagttcatccatatttgcaattttgatcacaagacaacatgaacttgtcgcaccgcttatgataagacatgatctagatataaagcaggatgtggatataatatgtttacaactatgtgcagacagagcaggcacaaagcaaaactgagcaaccatgttagatctttacaaacatggcgttaaaccagtacaaaaatatatcatactacaacttgtttcatttacaatgtcatatatgcagataaaaccttttaggaagctaaataagaccaattagtaattacaaccacagatgttggaataaataagctgcagcattaacaggacaacatatcttttgcagcaactcccaagactactttaagaaaatgtgattacactgaaacacattcttagtaccataatcatggcttccaaagactagaaagttaattgacaaatgtgcatgctaaccttccgagtttgtccaagtgtcaaagagggcagcaaagacaagaggcctctgatcttggaaatgaatgtaatacggcatcttctttggcccatcctttttccattcgtagaaactgagctcatataaaatattaatgcatgattaatacaaaaatatggtcagcttattgtctctctaaatggacttttcaacaaagacattatgctacaaataagaacctaaatattttttatctaccaaattgtgctgcacaaggataaaacaacttgaatgtgatacactaacaactaattgagtcctagattgaattttgtctattttaaccagttcaactcagattggtcagggcaaaatcaagccccagtgtcacatgtgaggattaagaagggtagctggagtttttcctcggaaacgcaggactgtacttcatttcattaagaaaataaaccaaatacaaaaggagggatcaaaactgatccaccactaagaacacacctcacatactcatcacttaaaggtgatgcataaccacaaacgaaaaaggaaggactagccatccggggtaaacaacctacaaagaaacacatgtaggcacaggctactactatcattttccgctgtctttaaaagcaccaaaacgtttgttgtggcaccactgaaaacacagtcgttgccgtgcttccaaatcacccaagctgctaggataatcccgataactttgccaccaccatcctggaaaatgggctgccgacagttcaggtgcaggaccagccagccccaactttagagagtagtaaagtccaaacatggccagagaaaacacgagatacaaggatatggtgaacagtttcgccgctttgatcatataaagggcaggcagcaggatgtggtagaccctgattaaaagcaagttgatctgaagtccaacatctgctgttaatagccaaccaaatgaaaattttgcagcataaaggaacccaactagtccatattcgcttccatggagcaaacttgatggatcccaggaaataagcattgtaggttgacttgctagtgtaggagcaggaccctgtaagcttccaaatgtgttagtcctgaaccccctgctgcaagaccgccccctcaaccaagtcccaaatcaacagagaacttgaacagtgaagccaccttttatatttctcacccaccttttgttctccaatgcctgcaccacagtgcgctgcttacttgacctttgagtgattaattcaaaaagattgggggccagttcagctattgttcttcctggcagccatctatcatgccagagcatggtgttcccccttttaccaattatagttttcacagccactccaaacaaagagtgaacattgtgaggtacttgtataggaaaaccaaaacaagcccaaggtctagaagagtcaggtgtttgaagccacaaccacctcatgagtaaggcccatcccatcttttccagattatgaatgcaagtccccataagggagaggtcagcaaacgcaatcccaagaaacaaggaaattagcaccattagccctctcctgacccttccaaagaaaacctctgtaccttttgtcagtagccttgatcacccatttgggtagctgggttagggattgaagaaatagtagattagatgtgaacagcaagaatacagaagagggctttggagggagaataggagacaacatgaaggagagaggtaattttttaactctttgcttaatccccaatgatgatgccaatgccctactgatctaaccaactaatgagtaatgatatgatacaaaagctaactaggaataataatcaactaaactaacaaatgatatcagataatccaacgccttgctgctccagtgtttcattgggccaaaggacctactagcagcccgcatgtcgtatggccatgacacctaggactgtaggtgcttttcacataaccagtaatccaagtagaacagcttatttagcagtgttatacgtctttgatatgattctagctgtatacatataagaccaacaaatgtactcagagcaaaggcttttggagccaatctatgatgataattttgggagtcttgatatattcgcgagttgtctcatgctctcagtgaaggtgtataattgagtacttggtgattcacctttggccaaaggttttactagaatagatcacaagcaacaattagtggtttccctatagatttgctcaatcaaaataactagttatctcaattcctgagatgaaaaacaggtaacccccagattcggtacaatgtatttaacatgtcatgcaatctatgcccccatgatttatattcaataaatataattaagatacctcatagtttggaatgaggaaaatcaagcacatctaaacctacagtcctatgtcaaatcctacaattggcatgtcactcatcgattagcaccactatatgacagaaggatggagcgagacacggaaagcaagaagagcaggacagaagttatatcaaactactataaatccagatgtcaaattttacatccaggtgcaaatcattctgtagccttttagcctctatcaatgcaagcaaatattgagcaagtacatgcatactgtaccaacttcaaggggtaaatcagagcatgctcatgcaaaactttaacaaagcatatgatagttggaagttccaaataaaaggagacaactattttgtgcatacccttctactgccacaagacacctattatttgggataagtcgccgaaaggaagccttttcctttatagactctgaccgtgcattgaactgcacaataaaatatttcagtgattaaatcaatttaaagaagcacagtaatgggacataataaaatgtaaatcaagctctatagcaggcagtccaatgcataagcaatgtggagtaagacatcagttttagaggagtcaaataaagaaatgaataattttagctataaaatgaagcagctaagctagcgtacataggaacagattcccattctgatgtccatagaacatatttttaagagaacattccaaataaatgctagaatttgaaagatgatagacaaataagcacacagaaaaatcaagaatataaaatatatactaggatgacagcacaaatatttcatgttttggaaaaaaattgcaaagcattacactgtgttcaatactccctccgtcccaaaatatagtcgcttctagcgtttaaatgtggtcccatcatatagctacttctctacctactccatttcaaccaatcccagccatctcccatttaatttctccacctactccctcatctcaaccaatcacaaccatcccctgtttaatttcacctctctccttaatctctgtgaaaaactctagaagtgcttatattttgggatagatggagtagctttgagtgtactaacaacctgtcctttcaaatggggcattattaccataaatgtgacactgaaaaccaacatcacaattgcagaagccgtccaaattgcctaattggagtaaacgtagtaatcaaacaggaatcaactaacttggatggttaaaatttgcagctcccccctgccactcatcgccggcccgccacggtggcagggggacggcgccagagatgttggcgccgtcccgttggaccacggagctagcgactctggcgtcccaaaaaagaccatttctgggataagttttccaggggtctatttgcaaaataagtttttcaaaaggaccaagttgtgaaaaatccagagggcgagaaggggccacctgcaaaattaacacggcatacccctcgcccaccctatgccacatcacatagcccaccctaccatagggcgatttatatgccccgccctacgttgcggtgtggaggagtatatttttgcaaaaatttgaaatagtagtttgtttatgtaaatcattaaagaaataaatataaaaaaaatttccacgtccacgcgcctgttcatattctattttcttcccttgttgctcctgttactttccttatgcaatggtcctgacgccatctaacaagacaactataacccattgttagatgtagatcagtgctaagatctacaggatgttcccgaggtcgctttccttgctggccacgtcgtactatcctccaggttccagcctcttctccctatggcctttatccacaactggggaaacaatagctaggcaaggctttggcatccaatttcctgtattctccctaattattttgacaaataatttattacaaggacattcctgcatttgaaaaatattctcatgtgcgggattctgttccacaggcattgtgatggagccgaacggcggggcatgaacacaggacagagcgcgtgcaacaatggacagagcacgtgcagcaacgtctagaacacggaagactcagcattgtttaaagatgaagtttaaatgtgttacctttatcctcattcttagagataagttgttaggaagagtttgttacaagatttgttagattgggtcttatttaagcttgtaattcgttcattgtgatcaatgaagaagaattaatctaaaccctctccctctgtcgtttcttctgtcccacggtgtgcccttctgcctgtgcacttctttcttactttgttcaatcttaatgtcgccgtgcctcgctgccatggggactgcggcctagggcgccagtcaaccacaactacaacctccgatcactgtcagggcatgcagatatgttctgaattgttttattgtagttgatatatgactagattttattgttagggtttagagtaaatttatatacatatattctaccattttgatgctaaatactgcacaatacctatatttttttttagtttgactacatggctgtaaataataggtgaatttaattatggagaaaattcttaaaaaaaaagcagcagatagcaccaacaagattggggtttatcgttctacgaatatgaaggagcataaatatgaaaaagtaatgtactccttccattccattttaagcgtagccatgaatttctgtgtccaaatttaataatccgtcttatttaaaaatatttttaaaaaaataaaaatataagtcactcataaagtacaattcatgttttatcatctaatacaataaaaatactaatcataaaaaaattcaaataagacggacaatcaaagttggacacggaaactcatggttgcgcttaaaatgggacagatgggacagatggagtatgtatttacacataagtacatgtataccagaaaggaaatggcattctttatgtggagtggcttttcctagaggcttatcttcttcgaaactcaaacttttggtttttgaaaagaaacaagaaaaataaatgagaagctgataaaaaaatatggatcaaagaaaagctaatgcctccatctaccaaagcttaattggaagcctccatccattgccattgatgcggtcctgctggcaaggcaggagatgccaacaaggagtgagccaaagctcagttcaggcaacaatccaaagggagcaggaagcacacgctcagccgacagcggacaaggacgtagctgtctctggcagggcagccctaaaggcggcagatccagcagcagcttggtcgacttcaaatcaaaacattgcatgaataacaacgtgccttggatagtgcaaacaacttgacaagactgttggacttttaagacgtccacgccgctccaactagttaaccttagttgccaaatacctaattgtctaagcttgagttcatctcactttcttataagaaaatgacttttaagaaagatattgacaatttggaattgtagttgtacaaatcaaacatctcatcccacgttaaagaaatagagatggtgttaaatgataaacacccaaccaattagtcaaaacatagtcatcaaatgtggatcaatcggtctgttgtttgtggtttatctagctgttacataggcaatcaacccactacaataaactgtaatcagcaatcataacttctcaagactcaaaaaaagctattcaagggataagaacaagattgtatagaaagaacaaccagtccataccatcctgaaatgatcgggcttctcgttcttgccggtgaagctgggcacaagcccccacttcatgcactggattaccgacacctccccgtccatgtcccctccaccatcataccccgccggccgcgcccgaacggtgcccaccggcaggtatgtccctggcgacacattgtatgatggccgatacctgcatctcacaaccagaatctcatgattggcaaaatacagctgagcaggatgaccccatacctcaaaactcccttcctaccggtccatccggagcaacggcacagcgggtgcgtcacctcctccgcagccgcccccagtcccaccgcccgcgacagaggtcgtggtcgggaagccgaaagccctagcggcctgggacgggctaagggtgcagcgagccctgccgcacatctcgtactctgcccgggcacatgttaattaagattagctttgcatttgaaatgtaatggttgaaggaatggaatcgaacgatgattaccctgggcaaacctgagaagaacagtgtaaaatggtcagagcatcgcatcatcctgaacataatgccattttcttcccatccctatatacatcaagagcaagcaaattgttctcaattctaacaagaacactccaagtgagataattattcagtccggaaagattaattcagatgaacaactataacccagaagaactattgattctctatacaattttcagagaaccaatatgagatcattcttttttttttggcaacttggaagtgtaaagcataaacatgtacgcgggcagtcagatagtgtgaccagtgacctaaccaaagctgctactatcttttttcataaatcattgttatatagaaaatagtactgattggtaaagctcccactgtaattcaccaacacagagaaaaccggatgttttatggcttaatcaacactatgtcatgttggcaagccataataatgaataaaatgttagcacgtgcatgttactaacgttacgcagatgactgtatctcaatttcccctctgaaattaacatcacacgagatcaatcaatccatcaatccggggaggggtctcctaaacctgatttcaatctagagtataatctatcggctaatttactattgaacatctccaagaatcagtatctcacggttcttagaaaagatggaaaatttataatcagaacatgatttcttgcaggtcagtaacaagggagagaaaagtgttctttttttcgaatcaagatccaaacttccgctgtggaatagaaagcttacctcttttctctcatcaggatgtgaaggagcaaccgggcgcacggaggggaggccacgacgggcggcggcggcggcggcgacggcaatggtggtgcttgcgaagggcgtgacggagattagggcgcggggtggagcgagcgcgcaggtagtgagagagagagaggagggaggcggcggcgtcggggtgagtgcgagagaggatggagggaatagcgagcaagagagagagagaggagggcggcagaggcgtttgcgtctgcgtgaaggtatgggtgcggccgtgcggggaggcgagtctgagggaaacgtggaccgatctgagccattggatcggatgattctggaccatcagatttgatgaatgaggttcgtaggagtgtaaggtcccgttcttttctccaatataagagttggataaaaataaaaattaagattttcatgttacgcttttcaaactgctaaatggtgtgtttcgtgggaaaaagtcgctctaaaatatcatattaatctattttttaagcttgtaataattaaaactcaatcaatcatacgttaataccacctcgttttgcgtaaaaaatttaatcttcatctttatcttcaggagaaaagaacaccacctaattggtgaattatagggtagaagatagaagaataataatatgtacaaataagatgtaatttgattatgaaaactaaaataatttgatataattttgagcctaaaaataattaagattgcatatttttaagagagaagaaagaagagacaatttgtgatgtgaccatgtctactacagatacaaccatttctcacatcatggatgaacaagaagatatcaagatcaagtcctccaagtgctgaaatccgattcggccacctactacactgctgacttcaaacggccgccgaatctgcatacgacctccgttttcagcccatgagtacttgatggaaggctctcggaaccctctttccaacagatctagcctcgccgccaaattccatgtcgtttggccgcaatcacataaacaagatgttgcatcacctggcttgggaccccggcccaagtgggtcccatgtggggtgcaccctaaccaggtggagaacgacccttggcaccccttggtcatcctccctgtaggatcgaatcacaagaactaagccaaccaaacgggggtgaatggttggtatgcccaaaaaccgaaacttttagcggaaataaaagttaccctcaaattcgacggagatcggtctgatcgaagttgtcctgccggtctgaccacgcctgtgccgtcggtctgaccggtgtagatcgatcggtctgaccgccctgagatcgcctgccgcacctatcaatgttgccggtctaaccgccttgcgcccgccagtctgaccgccgcgatgctgccggtctgaccgccggtgagtcaccggttagaccgtcgaaacccggtgaaacacaaatcaaagaactctaaaagtgaatgacgactttattgattctctctgtgtttacaaaatgcaccaacagcactccttacaaaaatctcgactaaactcgaaaccctaactcaactatcaactcaattgctctcaaaagcaataccgggaagcctaacgctccccctctatttatacccgaggtaggcaggctaaagccacgaaccaaacacatactagaagtcctaaacaccttaggaaactctctagtacaagaaacaaactttacataaccactcataccaaatttggactcattccaaattcgactccgcatcccatacgcacacaatacctccatcgtataccacgtgcatcaactctagcctaagtatcccgcatgatctctgaccaccacggacgtcgtcttatccccaagccgactcacggtccatcaccgcaaatactctcccgaggcatcgagtcacctacacatgaaataaacaaagaaaccatattccgagaccaagctatctccaacttgactcattgttagtaaacaatagtattacatacgtatagtatccatctagaagccataatcatgaaacaatcacggatatccaaacaaacaacctaaaaccgaaaccaacacaaagtcggccggttagaccgcgggctacgctagtctgaccacgcatataccaccggtctgaccgacagcaccggcccggtctgaccggtccagacaaaaacagcagtacctgaaacacctgcaaatccaatcatctccaaaaccacttcgtaaataaattccaaatatcaaaaccaataatctccaatgccaattgttcatcacataataataataatcaaaaacacctttgattttacattcccacccctataattagttaggtaccccctcagggtttcttgggttgtttagatgaaagtttagccattgctacttccttgcagctcgcgtgtcggctagaccgtccgtctgcttgtattcgaaaccctaacttatcgtgtgtattcattcctatttgtaattcagatttattttatcttgttcttacttgtttcttcgatttgcttgccggaataaggttgatctgcaccggcaagatcaacaacccacgaagagttgcgtcgatcgcaaaggcgcaacacaacgtcttgtacggttgtagttgggtcgtcaacatttctcccaaatcgtagttatcattaactcaccaaaagatcaggccaaacaactgccttgagtgtcgattggaacccagggttcatcaatttggacaatagatctatcatccgaaggttagaaataattggagtgatgtggtttaatgagagaagaaagaaatagcattaactacaattagtggggatgagctatatgtgaggggagattaccgataaggaagaaatacagatatggaaagcgtccacacaaatcaattatatcctaatataactcttctggagattataggtaccacgtactcacgctgttgggctatccgattggttaaaggggtaactcatatagatagaatatgtataggataagattcaggtgttatattacttgtgtattaagcaatatcacgtagtcttagtcggctacaattgtaaagtagttatagagctttaaaccataagggataaagtctctacattgtaatcatgctttctttgactatataaggagggtaggggaccccttgtgggcagaatcacacccaagatcgtcatatcaataacacaatcggcggaatatttctccggacataagtagggtattacttctcattgagaaggcctgaacctgtataaatccttcgtcttataacccatccactttcctagcttgttcgctacccacttttagtattgccaaaatctagttttgacagttggcgtgccaggtagggaagcgtcaagtttctcgccaactagtgcgatgggatctacatcaggcatcgacgacttcgtcttccctccagggcagacgttccgtttcggcagcctcgacttcatcaccgacatcctcggcaagatttctcttcacgactcgggatcgaatcagttgggaagagatggcatctaccccgttcgacttaccgaacttggccaagatctaccccaagacttttctccgtgggacggcttcaaaccactcaggagagaccaccaagatctcatctccttcgtcaagttctgctcaagataagccgacgtatccaccaatcaccatgtggcttctggacgacctccccactgtattcggataaaggtagccttccccctaggtcgacccaatttggctttcggccaagatcgtatctagcttcagggaggtcggcgttatccttcaaccactcggatcttgctcatccatagaaattgctagctatttcagctcttccaccaacagctcccatgcgacactaagatcatcgactacgacgacttcaacgacgactacgacttcgataattttgccggctttgatgattattataacgacttcgatgatgactatgctctactctacttcggcgtctttatggccgaaacgagacggatggacagagggttggacaactcgtggacgaggaacgagcaagattggagcaggagcgccgggagcaagaatgactcagattggagcgagaacaccaggagcaagaccgactaagatcggcatgtgaacggcaagagcaagaacgctgcatgaaggaagacggagggccctggccgaatccagacgccgtgcccgacagctgattggccagacagtcattgatgacaccaacgtgttccttacccagcagcagaaatgtagttggagcaattactcttcttgataccatcatccccaataccctagatcatgtgacaccaacgctcgacaggatgaagaccatgatcgccgccacaattccgtacaacttgggagacagtcgacagcccaccgcttcgacgtatacaccttcgggaagccgactaccatctctcaggtaaagggattatcgtgagcccgaacgcagcaggaccaattctcgcatgcctcatgcgggcagggaacaccgggagcagttggttcactcaccagctgtcggacacagaggtcatcgtgcagatgcggagtaccagaactcctctcgagcacttgtcgatcttagggagaccttgaacgcacgccgcggagagagaaatgatcgaagacaccaacactctcatgcttttacaaacgacctatgtcgagtgaattggccggctggtttcaagctgactggtatcgagaagtatgacagtaagactgaccccgaatcatggctcaccatctacacactcgcaaatcgcgtagtaggaggagacagcaaagctattgtgaattatctgaccatagcgttagctgacttggccaggaactagctcaccgagttaccgtgaggcacaattggttcttggagcgagctccgcgaccacttcattgctaattttcaggggaccttcgaacaactaggaacccacttcgagctttacagcgtgattcaaaaacctgatgaacccttaagggattgcagtcggcatttttctgaaaagcgtaacaagatttctgatataaacgatgacaacatcgttgctgcattcaccaaaggagttcgcaatgagctactcattggcaagtttggacgcaagcctcctagaacgctcaataattgataccgactagagagcaccaataattaagtttttgaagcaacaagagttagtgtcaagcccagaaatttagtccaaatttccatactattttgtgtattaagtccctgtccaggaatcagctagggtacacaaaacgataagtaaatatatagatccaagcataaataaagcgtaaatacttacagaagagacacttagtcctcacactgaaaagacaacagcaacagcggaaaaagtgatcctagcggggcttcagctccactccacaggcaaaactcaactgaggtatgagccatggtcctctaacttcgtcttcagctcagaagcacttcacttctgaaaagagggaataatagcaaaactgagtacaaccaacgtactcagcaaaacacaccaatgaaacattcatgcaaggggagacaaggagaggtttgtggctatttgcttaaaggcagttgtaaacattttatagttgaaaacagtaaaacagttgattaattaaggcaagattaaatatgcactgaacaacgccacaccacattgaacatgcccgaccaaaccacctgaactataccagttcattaagtcaagttattaataaagtgggactaatcacggtaaagctggtcgatcgcccataaccgcgggcatgactattcgaatagttttactctagccagaggtgcacaactgtacccacaagatacaacccaccggcatgttaccgtgtccgaccgaacacgtcaccatgtcaagtgattatgacaagacccttcgcataactcccctaaccaatcgcaccacacctcaggtttcgcccccacccatagaacggtagtgggcagccccctctcatgacacggtgaatccggcagccaatcaaccggacaccccggccggccaaactccatcacgcccaccctagcctgggtacgtcagctagaggaaagttatactacaagcctagcagttgcccatacttgcttgtggtaagcgcggtaagtcttccaggggtttcccgcgaaccggtccttaattaccatgggtgcgactagcaaaaaccatgcactcacagcccaccattaagccatattttagttggattattacgaccaaagaaacatggctgaatgtctcgagcatgcagctcatcaagatactagagtaaataatgtgattatcccattaggtaacct

SEQ ID NO: 57532 - DNA, 2052 bp, Oryza sativa
gatcaggatcttcgtcaagctttgccaagtcatcgtcactatggattttttgacgagggatacttcaactactttggatctgggaagtctaatctggccagagtatgcgccccgacaaggtcggaaccatcgtcatcaacaattcgatctcttgagatcgaccaagcctcaagataagcggcgtatcgaaagatgtcagaccgtatgatgtcgaacgagtacgcaacaaggtaattggtagattggttttttaaattaatctactaatttcgtaaatacatccggcatgtatctacaaaggtacgcaatattttatatgcaatttatcgtacctattcagatcatacaacattgtcagatctataatttattatgtttacctagagcatgttttttatacaatatctattgtgcgagtgcttccgatgttaggccaactacggtctaatgctggggactcgctctgttctcttctgtatgaatcatgcttgtctacgatatacataatgcctggtatttaatttgctcgttatatcctgataatactataagattcatgcagctttttgagtacatactcgatattatctgctatatatcttgtcttccagacgatatttttcaggaacaattgagcacgtgagtaggttgtggtcgagtacaccccattatcgagaacattctcgacaaatgcggagttgtcgcacccaacctaccaacgaagaccgacgacctatctcatagcgccaaccatggctgcgctattcgagaaaaggttgttaacggataaattctcgtgaacgttgtcagcttgatcacccgacatgattgcgagcggacatctggatatgctataagttgggtatgtgagtcatgctggccacatgagatgcagatgtaacaaaccaactttagcacccctataggtgattgagaggctcctactcctggttctcgaaccagtaggacgtagcgatctctcgcgccttaacttctgatggtcgaggtacgactacggcaatagcgtagcggtcctcgcaccacgacttcagatgacttcagatggttgaggaacagctacgactagtcttcgaccggcagcgtagcggtcctcataccacgactccaaatggtcgagagacacctactcactggttctcaaccagtcaatcgtagcgatctctcgtacatttacttctagtggtcgagttacgactactatctggtcctcgaccaccggtgtagcgattcgcccactacttccaccgggaatgctattaggcgagcgatcgccctcgctcgcccagggcgatcagttttgcgcacccccccttccctccctccacctctccaccttgtttccttttttggcaccgcattactttcctattttagtaaatttatacacctaaagtttacacatctaaagtttagagaccaaaaatttataagtcaaaagtttatatatccgattcaaatttgaatttgaattcaaatatttatatatatatatatagtatttctatacatctaaagtttatacacctaaagtttatagacctaaagtttataagtcaaaagtttatatacctatttcaaatttgaatttgaattcaaatatccgattcaaatttgaatttgaattcaaatatttttcatatatagtatttctatacatctaaagtttatacacctaaagtttataggcctaaagtttatagacctaaagtttatatacccgattcaaatttgaatttgaattatatcttattcaaatttgaatttaaattcaaatattttctatatatagtatttctatacatctaaagtttatacacctaaagtttatagacccaaagtttataagtcaaaagcttacatacccgattcaaatttgaatttgaattcaaattttttatatatagtatttctatacataaatttttctaacttttatttttcaaaaaaaattgtgtagtctactgtagtagaaagaggagaaggggaggaggaataggggagaggagggaggagtatagggggaggggggcc

SEQ ID NO: 57533 - DNA, 2051 bp, Oryza sativa
catttgcattgaagtcgggggctactgtcagggttatggataccacatacctaatagtagttggctaaatctcggcaggacccaccacataccatgtcttatacggaaacaaccttcggatataggaggagttccggataaggaaagacaactagagttctacatggaaacgacaaggactactcggattgtatccatattggttttcctagttctacttggacaaggggacacatatgagtataaatacaaggcccctaggaggagaggggacacggaacaatagatcaagacacaagatcaacatacaagccaacatacgccaagacaagacgccaccggatatcgacatcagagatatgcttggactgaccctatccagtacctacagaggacgactgtagggatctagcgctgtctttgatctcctcgggcacgggttcgaggaggaagactaccctgttgtcgactacgtgatgatacttcactccgctatgtcaacaatagttagataggctaccctaaatattgtactggtgtgattatggtgaataagagcaacgaccggcttcggccaacaggagtacagttattacctgacaattcaggggcccgaacctgtataaaaatccttgtccccatctcttttactacaatctcgcatatatcctagtaccaacgatccccatactatgtaaataccggaatcgcgatatcaaacgtcgacaccatgtaattagcaaaacatgcaattttatttgtaaaaaattataaagtgggttcaatatgctcaaggggaatgtgtgacttgctcgaatcttcaaacaatcctccgaacactcatcctcgcgaacgcgatcttccgaaacggtggattctagacgctggcacgcaaaacgaggaaaagctctaataaaaaccaaataagtagtatgtgaaagtaaacaatcatgcaaatctcaattttagatgaattttgcaagatgaatggcccaatttggagttcgtatgaattagttgagaattttagaagttttgagccatttaaatgaatttctagaattaaacttgattttttgtgctattattaattatttttcttaaaggaagtcaatggttattgcatcagcagtggggcgggtgtggaccgagtccaccaaaggtgggccccactcgtcagcggtacaaggggcagcaggccaccgtggaccaagtccacggcgtcgatcggacggtcgagggtggccgggcggcatagccagcgaggaaggcaaccgtgcaagcaaggcggctgcccgacaagcagcggagaggagagcggggagtagagaagggtgctctccgagcaccaacgacgaaaaaggcggtgcgcggaagctcagctgtgagagaccgaggcggcgctccacgaggaaaacggggagcgaagctccgacgacgaccggtggtcgtggaggagcgtccgagcacctccaagacctgctaaaggtggagaaggggttaggggaggaatgagaggcgtgaagcggcgtgaatcaccagccagaggaggaataaatggagaagctcaccggcaaacgcgtagggtaggtttttagcggtggaagacgacgaccgagcgatcgcctaggcgcggcggcgctgcggagccgaaagtggaggcgaagtcccccggcgtggtcccaaccgccagcaacgagcggctggagatggcaatggcgaaggtggctcggggtcgtggtttaagcggcgctcgggtggtggaatggagcatcggtgtggtggtcgggtgttggtattttttaatgatgttactagaaatataattcccagcaatggtgccaaaaatactcatggtatattatggttacagaattcatccgtaagcgcatggatataccattgtggcattttacctgagagtattctaagggtatcgtatttatttaatcccgtgggaagatcatggtagagagaacctgactaataatttatatgttactcgtaataatcatagtctaagcaggggttaatataatccaagggtagag

SEQ ID NO: 57534 - DNA, 3639 bp, Oryza sativa
aaggttagtgaaccaaatactagtggaattttattattctaacatggatatgcattgcaagcatgactagttctcctctattttggtaatattgacgggcaaaactgatcgctaatgaccgtcgacaaaacccaccaagcttgaacctttgctcgtcccgagtaaaggatgaatggaacaaagacttggttgttgattaggagtttctactatgttgtatatctcaaaggtacaagtgcaaggtatatatactctgtctctgattaaataatctttggcacggtggcttacccttacccctgattcccacgagacactgcttctcctttccttgggcggttgaaagatagaacagcaactagagcacaaatcacccaatctttattcaacttttattccagaagttttcaaatgattttgcaaaagaaagccaagttcctcatatgattaactcagtctctccaagtgtatcaatatgaattcctcaccatttttgcctttttgattcctactctaaggtttgatatgtggagctcggtagggatcaaacatggcatacttgcattcacatttattaccaaatcaaaaactcagactaaagaaaatgattaaacatactcaagatcaagatcgtgcaaagtgtgtgtgtgatataccctgtttccacaacaaaagtgaaaataaccaaggttagcctacaaagggcagtgattatacagtggtaaatataaagtattagttctagtaatctctattatgaatcttcctcggcaacggctccagaaatgcttgttggtatttcttaacgacattactagaaatataattcccagcaatggcgccagaaacactcatggtatattatggttacagagttcatccgcaagcacatggatataccattgtagcatttcacccgagagtattccaagggtatcatatttatttaatcccgtggaaagatcatggtagagagaacctaactaataatttatatgttacttgtaataatcatagtctaagtaggggttaatataatccaagggtggagagacacacaagcagggagctactcattctcataaaatatctaagctaagtggaaagaaaagagaaagagaatctattcctatacttctagtatacatacatcctagttatccgatgtactagctaataccctctatccgatgccctcctggtatttcgagaagccacccctgactgccgagttccttacgacagcccgtcatgaccatacaaccggggctaaatacggaggagtaccctccctaggaaattaacttaggactatatacacgcgcggaataatacccatactgagctgtcaccatcagcggcccacctctcatccgcagcatataaccccaaataatggtatccgtagtctagacaccacgcctaaactaccagaaactactctaatatcatcgtcatgacatagagtaattgcataagcaaacactatacccgtaccaaagcatctcctacataagctagcagtataattagtataacatgaacataatgtaaagttagcattcatatactcgggaagtattccaataccataaatgtataaagaagagtattctaaataaagtgcaaagcttacaaaaaaggaaaggaaagctactagagccatacccaaactcttccgaaggcttccggactgtgatttctactctattcctattccactaccttaagactactaaactaacttgagagaatatgagagagttcttgctgagtgaagtgaggttgagagctccttttatatcctcccaattgttggtatttcttagcaacactactggaaatataattcccaacaatggcactggaaataatcctggtatattatgattacagatatgatccgcaagcgcatggatataccattgtagcatttcatctgggagtattcgaagttatcgtatttattttatcccaagagaagatatgataagagagaactatactaacaattcatatattacttatatatgtcaaagtctatgcaggggtcagttcaaagggtagggtgacacacagaagaaagaactaagaaccactctcactaaaatatagtctaagaaaagtatcattcatgtacttctagtatacacacatctttagtctatacttgctagtatacagtcatgcaaccaatacctcgtacccagtgtcctcctggtgtttcgagaagccacccctgactgccgagttctttacaatagaccgtcataaccaaaaaaccgaggctaaatacggaggagtaccctccccaagaaattaacttaggactatatacacgcgcggaggaatacccgtactgagttgtcaccattagcggcccacctctcatccgtagcttataaccccaattaatggtatctaataatcgaagcaccacgcttacattactaaatactactctacatccttgcaaccgacagagagcaacagaataatcggatactaaactcacaccaatacacctatctggaaagctagttacacaactatattgattcaagtataaagtaaagtcggcactcaaataatatgaatggaataaactaccgaagatgtataaagaagaatattctattaattcagtaagtcttacaaaataagaaaggaaagcttttaaagccatacccggaatctcctgaagactcgaggactatgaagactattctatttcctactccactagcactaggactactaaacaatacttgatagaactcttgatcttcttcttgaggtgtgtgagggaatgaatgagaggaggggtatttatagcccatgagatgccctgggagtgtggagatgctccaagcatcctaggagcatctttgctctcctcatgacaaatggcatgatgaagcatcctaagagcatctttctccctccttgtgacaagtgtccccggcggttatttcaggtagaaccgatcacaaccgccatggtatgtggataacttccagctgatgaagaactgggctgatcgggctggctactggttcggccgaaccaaccctggccgagcccaatcagccaaccatttggcatgtgtgtctcccagtggctcctcagcttagtggtatgaattatgggcttgtttgctcatgttaatcctgtattaccagcccaactatccaaaagtctgcttctcgatagcgtatgattgatcgttcatctattttttgtcgattctcctccatttatatgtgcttctcctgtatacatgttagtagcatagtatatagtggaagtagatgtgttatttggaatttatgcattgcaagcatagctagtcttcatatattgggtaacattgacggtcgaaacaggccgataacgaccatcaataccaatgacggttgtgacggttggacaggtcggtaatacccaccaaccgtcattggggagccatctcagccgtccagaagaaaccttgatcgaacggcgctgcgaggggttcggccaaaccatgggtcgggccggcctggcccaaaatcggtaagtggcctcctccgttgctctcctacgcagacttgtgaattttggcctaattggtcatgtcaattctgagttcttggctta

SEQ ID NO: 57535 - DNA, 1913 bp, Oryza sativa
acacttcatgaccatacaaccaaggctaaataaggaggaataccctccccaggaaattaacttaggactatatatacgcacggaggaatacccgtactgagctgtcaccatcagcggcccacctctcatccgcagcatataaccccaaataatgatatcccgtagtctagacaccatgcctaaactaccagatactactctaatatcagcgtcatgacatagagtaattgcataagcaaacactatacacgtaccaaagtatctcccagataagctagcagtataattagcataagatgaacatattgtaaagttggcattcatatagtcgggaagtattccaataccataaatgtataaagaagaatattctaaataaagtacaaagcttacaaaagaggaaaggaaagctcctagagccatacccgaactcttccaaaggcttccagactgcgatttctactctattcctattccactagcttaagactactaaactaacttgagaaaatatgagagagttcttgcttgagatgcgtgagtgaagtgtggatgagagctccttttatagcctcccaatgacggttgtggcagttggaaaggtcggtaatacccaccaaccgtcattggggagccatcttagccgtccaagagaaacctggatcgaacggcgctgcgggggttcggccgaaccatgtgtcgggccggcctggcccaaaatcggcaggtggcctcctccgttgctctcctatgcagacttgtgaactttggcccaattggtcatgtgaattctgagttctttgcccattcatacataagtctgattctcgacatcgtccaattgatttattgtctgatttgatgtcgattctccttcactttatggttattctctacaaaaggttagtgaaccaaatactagtggaattttattattctaatatggatatgcattgcaagcatgactagttctcctctattttggtaatattaacagacgaaactgatcgctaacgaccgtcaacactgggcttgccagcgtggcggtgacgctagtggtggtggcggcgcggcacagcggcggctatggcggcggtggtgcgcggccggaggacaccagtgagcggcggcgatgcgtgcggtgtagaaaggacgggagagctagcaaggacccaaaacaaggtattttgcaagtagatgatggtgctagtgttgccacttggaagtttgatcctgaattgcttaagactgccttttgtataatggtcatagaagatgagcttccttttatggctgttgagaagtctggttttaggaagtttatggctgttgcttgcccacagttcaacttaccatctagaagaacatgaactagggaggttgtcaaaatatattatgagcagaaagcaaaattgaaaatatttctcaaacataattgccaaagagttagcctcacaactgattgctggacatcacagcagcaagaaagttacatgattgtcacagcccatttcattgataatgattggaacttacataagaagataattgccgttttcaaggtcaaaagtcataagggggaagaaattgggaaacacttgcaaaaggtgttgttggattgggagttagacaaagtaatgacagtcactgttgacaatgctagtgcaaatgatgttgctgttagttatttgagaaaacaaatgaacaatttgaatactagcattgcacaaggaaagtacctacacatgagatgtgctgcacatattgtgaatttgattgtttctgatggtttgaaagtggtggacatttctatcaagcgtgttcgtgctgctgttaaattcataaaaaatggtacggcaaggttgggtgaaattcaaggagtgcaaaaattggaaaaggtggacagcaaggct

SEQ ID NO: 57536 - DNA, 745 bp, Oryza sativa
aatccaatagcttctagttgtttaaggaagtactccattctacggaatggatcagtagcgcaaaccccagcaagaaccggaactcctttaaccacctaaataaacagtatgtcattaacatctactaatagtaaaaaaatcaattgacaggcacagtgccgaaggtatctgatgacttacaggcaacacttcattggccatctcaagtacaatagcgtttgcatctgcaaatggcaatagtcctgccaatgaacccctcccagccatgcgaaaccgcccggagttgtacagaactataagatcaactccaccagcttcttcaaacttggctgatatgccagtgccagcaccagctccaatgacaggagtaccctcaacaatttgttgctttagtttatgtaatactgactttgtcttttgcaaagtttctgtaagaatataagagcaaaccatcattgcatgtcattgtagcaagaaataccaggagtaaaatataatgaatgaagcatgccttggaacatgcagccaattttgagataataattttaaaacattaatgattgaattattccgctcatgcataaactgataatattttctgctatggttggcctcagccaatttcattgcaaggcaagccacttattagattatttatgtatttaaaggacttggcaatttatttggaacacaaaacattaaaaactcctcccttagcttctaatcttctgatttcactacagat

SEQ ID NO: 57537 - DNA, 1469 bp, Oryza sativa
  unsure (1)..(1469): unsure at all n locations
gaatgagccacaaaaccaccatcgatcatttccatttccattttcaggaaagatccacatcgccgttggcctttcatccagtgagtgagggagggagatctcgatctcggtctcgcgacatgaaaaaggcttcgtctcttcggagctggggttcgacgcggagggcgcgtcgtcggggttcttccgtccggtggcggacggcgggtcgacgccgacgtcgcaccggcgtcggctgacgaagatatcggtgatcggcgcgggcaacgtggggatggcgatcgcgcagaccatcctgacccgggacatggcggacgagatcgcgctggtggacccggtgccggacaagctgcgcggggagatgctggacctgcagcacgcggcggcgttcctcccccgcgtccgcctcgtctccgacaccgacctggccgtcacgcgcggctccgacctggccatcgtcacggccggcgcgcgccagatccccggggagagccgcctgaacctgctgcagcggaacgtggcgctgttccggaagatcgtgccggcgctggcggagcactcgccggaggcgctgctgctgatcgtctccaaccccgtcgacgtgctgacgtacgtggcgtggaagctgtcggggttcccggcgagccgcgtcatcggctccggcaccaaccttgactcctccaggttccgcttccttctcgccgagcaccttcaggtcaacgcccaggatgtccaggtcaacaccttacccctctctcctctcctncactggcattgccattgcccattgtccatgggccattgttgctgtctctctctctctctctgcgacaaagtgacatgtggtgtggggcctagctaaagcatatggttggctgagtggtggntgtcacttgcccacccacatgtgagacatggcacctttagcctttatcctatttccatggatgactagcttcctgcacacatgtgacaagagcgaacacatgcttctgacaacttgataaaagcccaaagatgcttagttagtgctgatatgatattattaagattcaactgaatagaatcgaatgccttgggttgatgctcctagctactactatatgtggaataatacaacttaggatccgcatacgggagaacgttttggctaaaatttccaacaagacaaagttattatcatttgactaatcgaatattagtaactacaaattttaaaattagttttttatatataaaatcaaattgcgcgcctagcatcattatattttctatcatataatagcatatatgttttctcactatattattcaaatatattaaaatgacaacataattttaaattttgcaatatgtgtaatattcatattatattttatatacatgttagttattaattatttttaatatcaaattttagttatttataaattgtatatattcctatatggactctagactcgtcttttaat

SEQ ID NO: 57538 - DNA, 1316 bp, Oryza sativa
cttatattgaccttaaactcttcttcccatatttttcttaatttcgaattttagttatttgtaaattgtattttttatacagactctagactctacttttaattttattatgtttattccaaattttagttagttttaaattcctatatggactctatactctacttctagtatttcttttttaaattccgaatttctattttttttcttaattgtatttctatatggactctatactctacttctaatattccttatttttaatttcaaatttctattatttcctaattgtatttctatatggactctatactctacttctaatatttcttgtttttaattccgaatttcagttatttcctaattgtatttctatatggactctatactctacttctaatattccttatttttaattccgaatttcagttattttctaattgtatttctatatggactctagtctcttcttctaatattccttattttttaattccgaatttcagttatttcctaattgtatttctatatggactctagtctcctcttctaatattccttattttttaattccgaatttcagctatttctaaattgtatttctatatggactctgctttttctttttctccgattaatgtgagaatttctaagccatgagagcgaacgtggaagctcctttttctattcctttaattatataatagataaggtcaaagatatatcttgtagaccgtgtctttgtccaaaacgtcaattaaaattaaactagagggagtacttaattaatcatgtactaatgaactgctccgttttccgtgccggaggggaacgtttccaaccagcagaaacgaatgcagccttagattgcttccttgctcaaatctactgctgtttggcctttttgctcagtcatctgcataaaatgcatttccgtaatatttgaaaggaaaaagaactttttagaaaatgtaatgtgctgatgaagctataagctaaacaatcccaaagcatccttgagatgctgattgtcctcaactgataatttataacgctgccatttttcacttgccaggttgtagtttgtgggatcttgctggtggtaatggcagtcggcaactttgtcaacacgatggagactttgatgttaaaattgaggttcaaagcaaaaatgaaaagagcaaagagcaggcaggatctcagtcgccaacaccaaaattgacaaagtgacccataatggtgactccatgcttggaaacagcgaatgctgacacaccatctctcttgtaaatcccttaatccataaactgttttgg

SEQ ID NO: 57539 - DNA, 2405 bp, Oryza sativa
tgtttcacaggtttttttatgtagtgccatcagaatttgtgttcctctatctttgtgtttgaagggttccatgcaacacccagtgatatagagaaacatcaatagaaatcatttggtctgattggacatgagagttgtaactcatcagtatgatctgtgttcttacaacctctggttggtctttaatccatagaactaacatagaagaattggcagcttgtaaaccctttacctgttggttgaaaagtcaggagtgtgtgataaccattttgttccccattttttagacaatggaattttgttttggacatactgttgtacctattgggaatacattctgcatttatgagcttgcatattggcaatatcttccatgctgtggtccagcaagaaacctttgcaagtttgcagacctgccaatcatcagtgcttgagacaaagcaaaaggcaacggagctcgctactgtgtatcactctgattgcggtagcctctgttctagtacctcaaattctttcaactactgtgtctaatcatatgcaatccatccaatgacatgcaccatcatgattgaatcattgagcccatctcatctctgtatgattagtttttgtttgtcagttccacacctgaaacccaagatcatagcatccaaatgcacaagctgcactcttaatttagaaatcaatatttacattccagtatttcatcactctaatcaattgattccagttctttcctaagcagtgttcatcgtttcctacaattaattaattaccttgccaataataaaacacacagacacaaaaataactaagtaaatcatctacaaaataaaaataaactgcaatacgatatacatcatgtggaatcggaggcatcgtgcaggtcgtgatgagcaatggagatggacgtcgccgccttctccgcgatggccgcgcgcacctgcgccatcgtcggccggaggcccggctgcgccgccaggcactcgacggcgatcctcgccacgtcgccggcctccgccgcgtcgtagtcgtcgcccagccggcggtcggagagcccgtccaccccctccgtcttgacacgcggcagcaaccgcgccgtgaggttgcccccgccggcgccgccatccgggccgggtatcccggcggccggcgagccggtgatggcctcgagcagaagcacgccgaagctgtagacgtcggacttcttggagacgatgccggtgcggaggaagaaggggtcgacgtagcccggcgagccgacggccgccctggtgggcgcgacggcggcggagaacccctcgcaggcggagcccaggtcgcagagccgcgcgcccaggccacggccgtcgaggagcacgttggacgccgacacgtcgccgtgcaccaccggaggcgcgccgtcgtggaggtgctcgagcgcgccggccacgtcgtggacgacgcgcatgcggtggcgccatggcagaggcggcgatgcgccgccgtggaggcggtcggcgagggtgccgccggagaggtactccaggaccagtgcacctccctcctctgcacgcagtaataaaatttcttttaattaattaatctctttaattaacaaaaaatctctctcttagtaacaaacgtataatattataaatcattttgacatacatataataccaaaatagttttattaaaataaaattaaatatattttgataacaagtttgttttatgttttgtatataaacttaaataagtttaacaaagaaaaatcaaaatgatttataatataaaacggaggggtagcaggttaattagatgaagtataaaatcatttgcaatttctttttcttttttggggggatttgcaatttcattcatctggggatcaaaattgaattagaattaggattaaaatgatatatacgatcgaaagcgatcgtgttgagttaagttttggacgacgaaatgggacgaaaataacacaggtcgttactcgttaacgtactagacataaataggcaacagtgaagtgacgtttgttcttaatcgatcggtaggtaggaggtaatctccatttcttcttcttattgttttccccccgtacgacgtacgcatgccattctctacacatgttttattcggtcgatttgaaatttaatttgtgaggtgaaatgtaacatcatactagtagtattcatattgaactaacttaataacaaatcttaagaggagaaagaaattaagcaaagtaaataaataagaaagtgaagaacatagcaagcagcaagtggagtagctagcatcagagttgcatgcagatgcagtgtaaagcaagtgaagaacagaaaaaagatgttcccttttaagacttttaaccaccccgagacgaggtaacgtaagcttagagtcaaagcttg

SEQ ID NO: 57540 - DNA, 4712 bp, Oryza sativa
aacagggattagcattcttggtgaggtcatccacgtttcgacacgggtgataaccagaggagacgtcgtgttgtgattgtggggctcaagagtgttgacggtcattatcgaccaattttgaccgtcaatattaccaaaatagagaactagtgatgcttgcaatgcatatatatatattagaataataatattccactagtattaggtttactaaccttttttgcagagaatgacaataaagtggaggagaatcgacatcaacatagacgataaattaatcggacaatgtcgagaattagacttatgtatgaatgggccaagaactcagaattgacacgatgaattgggccaaaattcacaagtctgcgaagagaagcaacagagaaggccgccagccgaaccctccttagcacagttggatccaggtttcggctggacggcgtggatcactccccgatgacggttggagggcaattttgaccattccaactgccacaaccgtcattggcagcctatttaaggagttcctctcctcacttcactcacacacctcaagcaagctttctcatactctcaaagtttagtttagtagtatctagctggtggaataggaatagagtagaaatcaggagtccagaagtcttcggaaaagttcgggtatggctctagtagcttttctcttatcttttgtaagctttgtacttttattagaatactcttctatatacatttatggtattgaaatactttccaagtatatgaatgcctactttacattatgttcatgttatactgaatatacggctagcttatctgggacatgctttggtgcgggtataatgtttgcttctgcaattactctatgtcttgacaatgatatcagagtggtatctggtagtttagacgtggtgtctagattacgggatatcattatttggtgttatatgctgcggatgagaggtgggccgctgatggtaacagctcagtatgggtattcctccgcgcctgtatataattctaagttaattccctagggagggtattcctccgtatttagccccggttgtatggccatgacgggctgtcgtaaggaactcggcagtcaggggtgacttctcgaagtaccaggagggcatcggatagagggtattagctagtatatcggttaactagaatgtatgtatactatgtatattagaagtaaaggaatagattatctttctcttttctttcttttctttccacttagcttagataatatagtatgagaatgagtagctaatgcttgtgtgtcactctacccttggattatcttaacccctgcttagaatatgattatcacaagtaatatataaattattagtcatgttctctctatatgatcttcccacgggataaaataaatacgatacccttggaatactctcgggtgaaatgctacaatggtatatttgtgcgcttgcagatgaactctataaccataatataccaggagtatttttgcgccattgctgggaattatatttctagtaatgtcattaagaaataccaacaaagagcgtattcgttcagaagtcggatcgatttgtttatcataaccttttgaaagatcgggaaccctagtccacatcagaagatcctgaatcgttttggctacattgatagtaagccttctccaacaccttatgatcctagcttgttgcttcgcaagaacaagagaattgctaggaatcaattggaatactcccaaatcatcggctcacttatttacctagctagtgcaactaggcctgacatctcctttgctgtgagcaagttgattcggtttacctctaatccgagagatgatcactggcgtgcgcttgagcgagtgatgcgctatctgaaaggtactatggaattggggttcactatactgtgtatcctgcggtactggagggacatagtgattctaattggatctctgatgtagatgagatcaaagccattagtggatatgttttcacactaggtggttgtgctttttcatggaattcttgcaaacagaccatttagacgaggtcaaccatgaaagcagagctgatggcactagatacaactattgttgaggtagaatggtggtgtgatcttttgatggatctgcctggggttgaaaaaccggtgccggttattcgtataaactgtgacaatcaaaaggtaaagccgttgcccacgctggcttgtggttggcacggttaatgtttcacaaccgaagctcgcgaaccggtctttaattgtcatgagcacgaccatcaaaaccatgtgctcataatccaccattatcaagtagttggcaattaattaattaaccaatcatgattgaccattgtgagctaccattaaatatccatcattaagtaatagtgaaacattagttatcccaatcatgtgctaatatttctaagcatggctaagcaattatatctaatatctagctaaactaatatataagtccaactagacaaattataacccaaggtatcaaagaatagagtaattaatgcaaagtggccataacaaaggaataggttcacaccagccggtgacattcgaaaataaatgcgcatttgaaataaatagaaaatttaaatataagatcagcatgctgaaaggattgtgtttgggatatgtgtgacttgccttgcaataatcggtcatcaattaatcttctagaacacttccaacacactcgcaaaccttcgcaatgacggaaacaacaagctaacaggcaaaacgaggaaaaagactaagaaactccaaataaacagtacatataaagtaaacaaacatgtagacggaaacgacaagttaacatgaaaaacgagtaaaaagactaagaaactccaaataaatagtacatataaagtaaacaaacatttagagcatgaatttagatgaatttagagactcgaacgacctcattccgacttcatatgaattaattacgaattttacaagatttaattaatttaaacctattaaggaaaatactattccaaattaattaaataatttacaaataatttataactgacataaaagattaagaacatcttcagaaaagattagataaaatttggtagatgacatatagtaaaaaggaacaatatgtcattgaaaagacggaaagagatttaggctaagtttagatccaggggtgtaagttttggtgtgtcacatcggatatacagacacacatttgaagtattaaatgtagactaataataaaacaaattacataatccgtctataaattacgagacgaatttattaagcctaattaatccgtcattagtaaatgattactgtagcaccacactatcagatcatggagcaattaggcttaaaagattcgactcacaattcacgcccaatctgtgtaattagtttttttttatatttagggactgtctatggggcaaacagctgaaaatttgttgttttcagtcattttttttagccgtatgatgaaaacacgtgtctcccatcctgctccgctactcgcgcactacgtgaactaccgtgcgcgcaagtcgatttggggtgtgtttagttgaggaaatgaaaatttttgggtgtcacatcggatgtttgaccggatatcggaaggggttttcggacacgaatgaaaaaactaattttataactcgcctgtaaaccgcgagatgaatcttttaagcctaattaacccgtcattagcacatgtgggttactgtagcacttatagctaatcatggagtaattagactcaaaagattcgtctcgcgatttcctccctaactatgtaatttgttttttcatttatctacatctaatgcttcatgcatatgtccaaagattcgatgtgatgtttttgggaaaaatttttgggaactaaacggggcctcgtttggtcggattgctgattttttttggcaacaaaaaaaaagcccatggctcatgagtgggagaaaaaaagcccaagagaaaaaggcccacagcaggcgggaagaagaaaattttctggaaaagtacaccgaaggtccctcaacttgtcatcaagttacaaaatcatcccccaactgcaaagagtaaatcccttgtgtacacatgaaaactcacctaatcccttctataccctcgaattttacacgatcctctctgtacccctgaaattttgctttgatcccttccatgcccctcccgttaggtttccttcattttcacgttatgtgtggttccaaatgtctaaaacacccttgtagatggaagagtgccagctagagtggcatcaggagggagatggccggcaaagcccgcgcggcaagaggagcggcgaccggcggcccgcacggtgggaggggcggtggccggtggcccgtgcggcgggggcgcggtggccggcgacacccacgcggcgggaggggcggtggcggcgtgacggcggctggacgacggcgcgcgcggccggaaagcgggacgacggcgcgcgcggcgggagggcggtggccggcgacgcccacgcggcgggagggcggctggacgacggcgtcccgcgcggcgtgacggcggctggaaggcggtgcgcgcggccggaagggcggtggccggcggcccgggcggttggaggacggtggccggcccgcccacggcgcggcgtgacggcggctggacgacggtgataagctactgta

SEQ ID NO: 57541 - DNA, 14563 bp, Oryza sativa
cgccccgcgcggtgagacggcggctggacaacgacctgcgtggccggagggcagcgggacggcggcgtgcagaggccattcgcatggaagaggatgagggagaagaaaaggggaactttagtttgggttggcaggggcattttggtattttctaaaaattctgacaacacaatacacggtttgagcaacgtatctaatggaaacttaacgggaggggcatggaagggatcaaagcgaaatttcaggggtacacagaggatcgtgtaaaattcgagggtatagaagggattaggtgagttttcatgtgtacacaagggatttactcaactgcaaaaccagataccgggcgtggctcaacttacaaaaccgttcgcttgaggtccttcggtggttttgaccccggtgagtgtggccgtcagtgtggccggcgagcgcagcgggccaatgggctaataaagatgcatgttttgctaattacatgggaacaagctttacctatctgcttgcttgtgccatattatttgatatctgtcctttgtcaaccttgggtaataaatcgactagcttgtgttactttgatgacctagctagaactatatgcttagccatgcttaattaccactaactcagttgatgggataattgtagtattatacctttttagtatcacgacgagttgcgtgctcgagacatccgaccatgtttcattggtcataattatccaactaaaatgtgactgaatggtgggctatgggtgcatggttttgctagtcgcacccatggcaaataagaaccggttcgcgggatgcactggaagacatacaacgcttgccacaagcgggaatgggtaacttccagacttgaagtatagattttctctggctgacgcatccaggcgagggtgggcgtgatggagcgggatgggccctgcgacggcctttgtcgcttccggattcacctaggaatgagagtggactgcccgctgcccgtggggagtgggggtgaaacctgaggtgtggtgtgcttggtcagagggggttatatgaagggtcttgtcacaatcactcgacatggtgatgtgtttggccaggtgcgatgacatgctggtggattgtgtcttgtgggtacagtggtgcatctatggccagagtaaaactatttgaatagccgtgcctgcggttatgggcgatcgaccagaatcaccatgattagtctcacccctaacaaatcgactcaatacactgtaattcaggtaggttggttgggcctgttcagcgtggtgtagcattgttcagtggagatataatgttaccttaattaatcaactgttttactgttttactcaataaaatgttttacaaccgcctttatgcaaatagccacaagccattcttgaatcccttgcacgtctgcatcgtttgtgtggcttgctgagtacggtggttgtactcagccttgctattattcccccttttccaaaagtgtagtgcttctgagctgaagacgaagttagaggaccaaggctcagacccagttgagttttgcctgtggagtggagctgaagccccgctatgatcgccttttccgatgctgctgctttcttttcgatgtgaggactaagtgcctcttctgtaagtatttacgctttatttacatttggaactgtgtattacttatcgttttgtgtatcatggctggtcttggacaggggtttaatacacagaatagtctgaaaatttggggctgttgatggtccttaaatcataatatctgaccgtcaataccgggatataatgaaataaaacatagtatccaacttagttgtaggtattattactaatcatttccactagtgttggtgaaatatgtgtatgcaggtaatttgaggagaaaatatatccgtcgtgtgacaaaatgcacctctgcgcattcaggacgcatttacacggtttagaggcccaataagtcaataaaaaccatttagaattgggccaaaacatagcccaggttattgggggcccattaagcaacctaccggccaaaggagaggccgggaggacactttttgggttcggccgaaccaaccagtttggccgaacctgttctgcggctgttcgccatctgcttccatgtggacagcttggattccttcccagaggtggttgcagggtgttttggacaattcccatgcccctaaccgtcctttggagcctatataaggaggagcttactcacattcgaacacacacaactttgagttgaattacgagaggctctattgtatcttttgtacattagaataaggtagagagtgaggggaagctctggaggagtgcccggaagtttggtgctaatccgacttctacctcgacgagtgtagcttcctaggaggaattctggaggagtaccggagctgtcggtacactctgcgccgggttcggagaacttcttcttttaagtaagcatttgtgttcctttattttgttatttaattatttagtctgagtaagatatatttccatatttgcgggttcattgtttagtattcgtactaagtgctctagaactaggactctggatagagaaagaggttcctacgcaagtattagagtagtaattaataacttaggcgtggtgtctaggttagggactacctttgtttgttgtgtatcccacggatttgtcagaggtaggcgataggtggtgacagcctgaattccgtcccggtaatcctccacgttcggatacatcatagagctatagccagaaccacgctggcagaccagcaggggtcggtgcctgaagcaatagataggaaattatctttgcttatcttagataattaaaacacatagaaagtcctctctagcctgcctacctttagtttttgtccttggatagtcttagccttagatagatttcacacgttccctgagttcgatatccttttggggtcaccccattagttgttaatttatccaagtctaggtcatccttgtatctttttttttatttcttcttcttttattcctttccatgatggagcaacccacaattcaaaacctttctgctcctcgggttgatctttttgagccatcctgttcttcacaaccaatcctatccgatggctacgaaatcagtcctggctttatagcaaggttcgagagaaaaccttctctggtagtatcggtgaaaacccatacctccatcttcgggactttgagctagtgtgttcttgcctatccatgtcgtaggcatgacacatgaaacttttaagtggaaattgtttcctttttctcttagagatgaagcgaagcaatggtacaatctgtctgtcaagaaattccacggtgaatgggaggagcttaagcgaagcaatttctgccttactttctttccactaacccgtgtaattaatcttcgattagacatcctctctttccgatagaatgagaaggaatctctcggtgctgcctgggccaggttctcactgttaactcagtctggcccagacttgtctttacccgaccatgtgttgttacaacattttcggtactgattagacaaggagtctgctgaaaatctcgatatttccgccggaggatcattcgcacacaagacaactactgaaggaagagaactcttagatatgatcttagagaacgattctttcggctgaagcgaagcaatcccagaggtcgagattatccatgaggaacctctgcacgtcgagtcggaatccgactctactgctgaatcctcatcccagtcgcaggagccggaggaaaaagaaattcatcctccggaaaatccattcaattcgaggaggatctttttgatgattgttggaacacctcgaattattcctacgacaagagaccaccgaccaaggtcaattctaatgatcctctcgataaagctatgcttaaagagacggtgaagaagttgaccaccatcatgagtaacaaatggttgaggggaggagagctctcatgagaagcaattcagatccgatgcccctcctcaaccgttacgtgtctcattggagggaaattggtccgtgctctctatcccatgacatatagcgagtgggttagtcctgtccaagtagtgcctaagaagggaggcatgacggtcattgaaaacttgaacaatgagttaatcccacaacgaaccgtcatgggatggaggatgtgtgttgactataggaaactcaacaaggctacgaagaaggatcactttccactacctttcattgataaaaatgcttgagcggttggcgaaccattccttcttttgtttccttgatgggtattctggttatcaccaaatcccatccatcccgacgatgaaagtaagaccacgttcacgtgcctatacgaaacgtatgcatatcgaagaatgtcgttcgggttgtgcaatgcacccgcgtcatttcaaagatgcatgatgtctattttctctgacatgatcgaggatatcatggaagtcttcatggacgatttttcagtctatggtaaaacttttgatcaatgtctggagaacttagacatggtcttacaaagatgtcaagaaaaggacttggtacttaattgggaaaagtgtcacttcatggttcgtgaaggaatagtcataggacatcaaatctccgaaaggggagttgaggtggacagagcaaaaatcaaagtaattcaacagcttccacttcctgtcaatttcaagggagtccgtggcttcttgggtcatggggggttctacaggcgcttcataaaagatttctccaaaatcgctagacccctaactactttgctagctaaggatgttccatttgactttgatgatgagtgtatgtagtcctttaaaattcttaaggaatcactcatctcagtaccaaccccttgattggtcgttgccgtttgaaatcatgtacgatgcaagtgattttgctgtgggagctgttcttgggcaaactaaggataggaaacgccatgctatcgcatatgctagtaaaacgttgactggagctcagcttaattatgccacaactgaaaaagagctcctagccatagtgtttgccatgataaattcagatcttatttagtgggagctaaggtaattgtttacactgatcatgctgcactaaaatacctgctcactaaaaaagatgcaaaatcttggctaattaggtggattcttttactccaagaatttgacattgaaattaaggataaaaaaggagtagagaattctgttgcagatcatttgtcgcgtatgcaaatcactaacatgcaggagctaccgataaatgactatctgcgagatgacatgctgctgaaagtaacatactctgacccgcggtatgcaaccattgtgagcttcatggtcgcggggcatgtgccaccgggagaaaataagaagaggttgatctacgagagccacaggcacttgtgggttagatagcgatattgccagagattatgtaagatatatgataactcgatgaattacataaacaagattagagtgtcataaaaatggaagcactaatcccgagaacacaagctgccataacaagttttacctcttgttgaagatcgaaaccgatgcagctcaacccgaaagcaagaactcgtcgaaacaaaacaaaagtagaaagggtggcgatgcgccgagattgtattgaacatgtgttagtttgtttacatggggctcagggtctatttatacccgagaattacaatatatgtccatatcggacacgactattatttctaacaaactataagataccataagtctttgcggcagacttttgcccaaacatatctctaaggaaattacataaaatatcctaattaatagatacagttgccttctcaggactctatccatgcgtggcaatcatcatgaagcacgtcaacctaacccgacaacatatgccatgtcatattgtcggactcggctcaatcggctaaccctgtccgactcgaactctaccgatcttagtcatagccgattgggactttagccgatcttcactctatttccgggacaatctctatctcgatttccatctcgattcctcctttacatccgatccttgaattaccaaatttggtcgttaacaaaggtatatgtactctctctcagattaaataatctttggcacgatggcttacccttacccctgattcccacgagacactgcttctccttgccttgggctgttgaaagacagaacagcaattagagcaccaatcacccgatctttattcaacttttgttccggaagttttcaaatgattttgaaaatgaaaaccaagttcctcaagtgattcactcagtctctctaagtgtatcagcatgatttcatcaccaaatgttgccttgttgattcctactctaaggttttgatatgtggagctcagtagggatcaaacatggcatacttgcattcacatttatcactaagtcaaaaacttagactaaagcagataactaaacatactcaagatcaagatcgtgcataatgtgtgtgtggtatatagtggaaacggtatatgaggaaaaataaaaataacaaaatgcttctcctttgtgctttactttcttctcccagaaatccttcttttattaattaggagagggcatggctacattttttttcaacatcatgtcatgcttgatggagcataactttattatttatttttttttataaccatgcatttccctcctctcttttttttcaaaaggatttttctttttaggagaagaaagcacatggaagcatggagaatttattttggtggaaatatggaatggaacaaaatattgcttagctcccagtgtaggagtttagcatgtgcatatatgtgggtgtatgatcttgatcatagagcatgagaagtatctacacaagtcacaagagtttgacaaagttcaatggaatggcaagcaaccaaaatgtatatggtgtaatcatgatagcacatttttggctctggtaggaatttatatcaaatgaggaactttcaatttatcattttaaaaaacaaaacatccggagttcaagtcaaactagtatcaggatcatagctactcatatttactatctcatatctcgcaacaacctagacttagatcagcaagtgtagcccatttacctcaggttcccagataattgttggctacttatattcaatctttgagagagtacttaccaagaacccatatatcagagatataaaacagagcaactattcatcatttcaacaaagagaactagcttgtcttacctagcatgactcaaacctatcctatctttttggtattttctattttgcaaatttttattttgttttcaagttttataagatgcaattggaaagcaaatatgcaattggaaaggaaaatatgcaatgtgatacaagttacctcagtggggggagcgatgtctccccccaagcttggctttcgctcagggtccttgataaggattgaacccctgaaagcgaaagtacgcctgaaggtcatcatgctgttgctgcatcatgttgttgatgttggtgaactgagcatcagcagattgttgccattcttgcgtttgagctatgtgttccgtgaggttgtattggatctcccccgtctgcacatcaagggtgtccattctcctagtgatttcacccaagtcctaacgagaggaactcgagcgccattcacttggagatggaggcacaccacttgatctggaaggttgattgtctccccagtggatgtcatgaggcgcatgccaccggtcctcactggcgcttgcccaagttgagagtccatgctatagcgtagagcttgggtccatccgggtgcatccccagttggtgcccaacctgcctcataaatctacatgggtatcgaggatgatgaacttccttgttcgttccttgtcatgttgcgcgtctccatgtatgttccacctgcacgagattcttctatggtttgcaggagaatggttagttcatggcagttgtacaaatgataccctgcatttggcaacgggatttcatttgtacaaccggggaaaaagtatatcaaagatccatatgctacatgtttcaaaatatgcccttgcactagataggcctcatcaatacgcggacgagtggctgagataaaaacaatttggtcgctaacaacccctagcccttttgctatccgagtaatcatagaagtgcactcaacaggagtagagaactttatactttctaaccattgccttatcatacatttcgcaggagaaattttgatctttctaaccatggcaaacatgataattaattcatctcccctaatgggtctcagatcacttctaggaaacaaagtcatagcaatccatttgtgcatgagcctaagtgtaggattatggatatcatttgttctaggtttcttgcaaattggagcaccaaaaatatcttcccaaaacctatttttctcgaacccagaaattcctttctggagatcgattttacaggaatcgtgaaaaccaagaagtgtactcaagcctttccatgtgagcgtgaactccttacggaaaaagcgaaaaaaaatatcatcttctatttctttcaaagtgcatagaaattgcaaagtaagcaaacgagaaccgggttcatctaccacagcaaatctctaccaaccaatagctttccaaatagaacgaaattcaacatccatacctatctttttcagcaactccggtgagtattctcgcgtgtgagcatactcccggtcgcttcgcatgtagtaggcttgtctctcccgatcactgacaaggtcgaggtcagtgtcactcaggagttgtcgcggagcgtcggcgtcttccatcgaaacatccgctgatgaacgagtgctagactcgccatgatgacttgatggagagcctgaccccttgaacagacgagacagtcgcctcctcatactgcacaatggagcaagaacaggctaactcggcgggggttagaaatgacaagagtttcacccatcggttagtttcaccaaagcagcttgtatatatgcaactaaatgatttgaacttgaggaaaactatcaaagcatgaatgaacttgagagcaaactttggagagggaatgaaaatgtgttgaaatggatggaattccctctctcggccggctggcttctatagggtacccacaacggtcagaaatgacatgtgggacccactagccgttaccctgccaaaaatggaaggaaaccgttgcctggccggttcggccgaacccctggtaggcccaaccgaccccactttcgttgaaaattttattttggtttcctccgaaaaattcatttgaagaatttcctccaaattcaaaaaccctaaatgcaattttgaaattcaaatatgtggtgatgcaaaaattcaaatgttgaaaacaaatatgcggatacataccaatttacctgttggcgaaggtcgcgtcatttaaagtccaatgtgcaagaccatacctcctttcgatttagctcacggattttccacccatctccggaggtgatggagcgggcgtctttggcttttccctccacaccttatttgattttggtgcggtagacggcttcttctgagccggttgctctaacttcttggccggtataggtgattttaccggcatcctccaataacggttcctgttcattgttgtttccttttccaggaagttctgcatgaactttaccaggctatccgtcttgggtggctccaattcgaccacttgaatattctgcgggttcggtccgtacttgattctgaccatggagcattgttccgtccttggttgaaactcaaactcttcctccttcccgttgatatggaaacggatactccccgttcccacgtcaatgttggctcctgcggtgctaaggaatggacgccccaagatgagcggcgtcttcttccccgtgtccatgtccagcaccacaaaatcaaccgggatgaagaaatcctgtattttgtctggcaaatcctccgttatccctgccgggtaacggacggactgacgagtcagccagttggaggcatatcggtgttggtgccaacaccgtgaagttgagcttgtcaaagatgtctttgggcatgacgctgacgctggctccaaggtcgcacaaggcctggtcgatttgttgtgccccgatcgagcaggtgatcgtgggacaccccggatctttcttcttctccgggagcttgtggagtatgatgttgctgcaatgttccgtcagcttggccacctccgttgttgggagtggtctcttgttgttgagtatgtccttgagataacgggcatatgttggcacttgcatagcgtccaacaacggcacgttgatgtggatcttttggataacttcaacaaaacgagcgaactgctcgtccactgacggtttcctactccgctgagggaatggcagcaatcgtgtgtcgcagtactcctacggcacggtcttctctggctgaatctccttgttagccgagtcagtagatgacttttcttttgacatcccattagttcctgcagggttaggatactacggatcacgagtggacttacctcccctcgttgtgatcgccttaacattttcaatggaggagtcgggttgccccggaatcctcctagattcatttgcagggactaaagatgccaactgagctaactgggtttctatcatcttattaaagctcagctggttttgaaatgcggaagcaaagccatctagattcacatttatgttttctaagatcttatcattggcagcaagctttttgcttagcgcatcagtggttttagcttgcgcaaaatcaagattctaggttggttagaggagttatcgttattatttcctccttgatcatacgggcgtggttggttccactcctgacctccttgtggacgataccagttgttcttgcccatgtacatcacctcctcacaggtttccgggcattcattcccagaatgacccgtgccgccgcagacctcacacgtgacgtgagattccaaggccttaacggtgccttgtggccgtttctcgtggtcgtccaagcgtttcatgaggagatccagcttggcagcaagtaactccgtctccttgacggtgtgcatgcctcgctaacgagtctggagtcgttcctcgctccaacccatattggagaccatcttctctatgagttgaacggctccttgaaccgttttagagaagaacgctcctctagttgccgtgtccaagtgatcgcgggacatcggggtgagcccattgtaaaagttgtgcaggatcagccagtcgtccatcccatgatgaggacaggcggccacgtactcctgtagtcgttcccatgctttaggaatggactcatcccttgtctgctggaaactagaaattcgtccacgaagggcattggttctgcccatcgggaagaactttgagaggaatgccgtagagcatttatcccaattgttgatagcagtacggttggcatagaaccactacttcgctctcccgaggagggagaacggaaacagccacagcctgacggcgtcgggactgacacccttgatggtgtatgtgctacatatctccaggaattgctgcagatgagcgttggcatcctcattaggcttgccacagaacgggctgttgatcctgaggctttacaagacaagggctgttgatcctgatcctaggcgtcagagggtgaactatttgaagaatctgcccaagtgtggaaaggatagaatgatgagtcctgacacaatgcctgctgactctcaggatgacagattcaggaccttggtacaggttgattggtataattctgtgatcatgggaagatctcatccagtggtagagatgaagtggctagactggcagtacatgttctcgaagaacaacttagttttcaatgaggtgcgcaaggtgtgtgagtgcaagcacgtggcagatctgttggccttgcagtattcctagaatgaggaagtgattggtcagctctactccaccgctttctttggcaccaccaagaagggccatgattttgtgaagtggaccattcaggtgcagcagtatagggtctctatggcacagtttgctacagctttggggttagatgatgatgacctgaatcgtccacatatctttgtagaggatgctttgtcaccgaccagcactactttcttctatgagaaggatgctcccaaggattgtttggggactactcgtgggttgcgtccatactatagagtgttgtattctatcttcaggtggcctttgctccccaaagtgggagatgctacagcccttccaggtaggcatgcgctcctcctcagtcgtatgcgctacaacaagccagatttcagcatcatgaagcttatctggagtgagatctatgagacagtgtgtgagccaaagaggggctgcatctatgctccttatatcatgaagatgattaaggcaaagactgggatttgttatttcaaggacaaccaacacaagcctttccgtcctcatgctcccactacttcagctactccttctaccagggcaactcgtgcttctacctcagctgctccttcttcctctgctgcaccacagtgttctgagtcttcttctcccataaagaaggctctccgggctatcttttgtatgtgtgctaagaccgctaagaaggtgaagaagatagagaggcgtcagaaggaagattggattgcagtaggcaaggatgtctctgatatttttgatgatgaggagtttgttgatccttttgctgcttatgagactgctcgagacattgctagtggtgagggtccctctggcatttctcattccttcaatgaggagtcctcccactccgaggagagcagtgatgatgaggagtctgatgcacctactgagaatgtacctacagatccagatgaggcagtggacgccgccgggcaagacatcgactctcctcactccggcgacaccgagatcattccttctgatggcgatgatgatgaggcttgatcctcttcttcccttgtgattttgtctctttttggtgcctttatgccaaagggggagaaaattgcaatcgaagggggtcaaaattttgttttcgctgcttgctgcctgctctgtctatttatccggaagtttcggatcctcttatccggaagttccgaacttggcagctccctcgctatatattcctgttagcttgtccagaagttccgggtattttatccggaggttccagacctggcagtcctttggcctctactcgtttggacttatggacatgtagtaattctctaattgtatggatgtaatgactgttagatgctcttagctgctctttatatatgctgcacttcatttatgctatgaatgtcttatttgttgattgtgatgtgacgttgattttatccttttgaatgctcaccatgtcggatcttttgcatattatatctattcttactgcttatttgcatcccacgaatgagtagagatgaaggaaactctcttcgttttctcccttatatatatgcatatgagcatcactcatatcttctatatgcatacattaagggggagtttcattcacctctaaccattcaaaacaaaatttatttcaatcttttgtaagctttaaccatgttgtcatcaatcaccaaaaagggggagattgaaagtgcattaatccccctagtgggttttggtgattaatgacaaatgtggttaagggactaatgagtttattgagctactttcaggtgcattagtccaaggcgtggaagatggatgcttggagacccccccccccaaaagtatagaatcaaagcggaccggaactcgagaagtgcattggatagtttatttaattgcaattgagttttaggaaaaaccgtactattaagaggggttccaggtggtgctctgagatatgtcaagtgctcttagtgtgaaccaagtgtcaaagtttccctatgagttatttttgcaaatactccatctgtccaaaaatgcaagtccagaacttcctatcttccaggtccggaagttccggtctgatgaaagaaattttcctaagtgttatccggaagttcctgtcttccaggtccggaacttcctgtctagtttccagttcaaaattgtgagtaacggctagatgacgtcacctagccgttatacatatacagctcgtttccagctcgttctttggccattccactttcacttttcaaacctagaactgttgctagcctctcccaagtgtttcttgccttctccactcaatctaaagcgtaatttttgtgagaaagacagattaaaagggagagaagaagatttggacaggtgtcaagactaggatcttgggtgagcacttggaatatcacatgggctgtcatctcggtgcttgtgactcttgaagatgatctcctatacggttaggtgtcgcccgcaagcacccatcgcatattgtggatgtcccgggtaagtttgtgaaggatctcctctc

SEQ ID NO: 57542 - DNA, 8075 bp, Oryza sativa
cccagctctttggaactcctcaatggagagtaggatcgcaagagccgaacttcggaaaaaaatcgctcttgtctctttctgtgatgtttctttgatctatcctctgcttagaatacctgcgcaccatcttgtgaagattggcttagtctcctgtttcgaaatttcaatttcttctttcatctgttatccgaaagttcctgtcctaagaacaccggaagttccaggcctggcaggccggaagttccggagttccttaccaggaagttccaggtctgtttgaattttaccgctgcgatttgtctttaagtttttagggacagcctattcaccccacccccccctctaggcttaatcagcgcgttcacttagcacttgtttcaccaaagtacttacatcacatgcatatgtggaaggtgatgtagcagtcatggtttgtctcccgtccaactttatctcatgtccataagaaatgtaacctgccattgttagtagaaaacagagaacaacagaatagtattatccctattaactacagaacatggattgtagtggaggctagcaagtggaaacaccttaccaagatcttacaagtgtcttaccagcaatgctaaagacggtacaaccggtggctggttcatgtcaccttgaaggacgtgatgtggtgattgcaaggatcaaagtggtgcgaaccagaagtatatatgtggagcttgggagacacaatatatagtagcataggaacacaattgtgctaatcagaaaattcagagttgaataatagttcaaagtactagtcaatgcgctggcctagcctagactcaattctagctcaagcaagcacccgacaacactaaggactagatataaatcaatgcacaactttgcactctcaaaacatactcaaaagatgattgattttttttgtgcggtttttttaagcatctttctgcattttttttatatttttaggcgcggctttttttctttgcacctttctggcttttttttcagcaggaacctttcaatgacctcaacgagggactcaaatgtaaataaaaatattatagggagtcaaatgcaaagtgcaaaactaaaattggatcacctcaaaaatggaatgctcacatcatgtaggttccgtttttacaaaaatatctcaaatctacaaccaccaaaatacctaacaatgtggtgaccgaggagaaggctgttgggatttcttagcgacactactggaaatataattcccagcaatagcactagaaataaccctggtatattatggtcacagatgtgatccgcaagtgcacagatataccattgtagcatttcacctgggagtattccaaggtatcgtatttattttatcccaagggaagatatgataagagagtactatgctaatagtttatatattacttatatacatcaaggtctatgcaggggtaagttaagcttaagggtagagtgacacacagctaaggatttagctaattcctacatctcctaatcatggctaagtggaaaagtatagaaatattctattcatgtacttctagtatacaagtacctagtctatcctaattagtatactctactgtggcataacccctttaacaatgcagcacagctgagctgagactcggttgtgccctcccgatgcatcggaaagttaccccgggttgccgagttttttacgacaacctgtcataaccatccaatcgaagaaggatacggaggagtatccaaccctcggaaattgtatgtaggaatataaactgtggggaagactcccgtactgagctgtcaccatcagtggcccgctgctcttccggcgaatatactcccaaataatgataagtcttagcctaaaccccatgcttaagctactacttattactctgctgtcatgcctagaatttctgggcgtgacatctgcagccttgcaattggtgcagagcatctatgtcccagaaccatagccctcagcttagcctaggctgacgtatggcccggtaaacagacattataccagcatcaatgcaaatcccagaaggtttaaccaacgagattatactaaatataaataagactaagcatagcactcatattctataattggataaagtactaaacttgtataaaaagaagaacattatattactgaaaaggaagtcttacaaaagagaaaaggaaaagctaagaactataccgaactctccgaagcttccgcggactccgaactattctattcctattccactagcactatactaattctaacttcggagaaatggagcttcaatccttgcttgtgtgtgttgtgaagtgagcatgagagctccttaaataggcaggtatgacagttgtagagcatggaaagtgttggaaatgccctgcaaccgccatcaggagttcattcggagcgtccacgccaaaccctagcctgaacggctgtgatctggcccaaacggcccaattcttggcaggccgactcctcatttgctcctcattccaaaacatggaattttgggcttaattgatcatgtcttttctgagttcttagcgcatctatccataagtctgatcctcgacagcatctgattgatcgttcatctattttctgtcgattctcctccatttatatgtgcttctcctgtatacatgttagtagcatagtatatagtggaagtagatattttatttggaatttatgcattgtaagcatagccagtcttcattaattgggtaatattgacagtcgaaacaggtcgataacgaccgtcaacaaaggcacggaagaaacccatgaggtagaggtgggggtcagccgtgacaaggagctggagtcggactactgtggaagattggaaaatatgtggagattttattccgtttgacgacacagatcagataaccccctgtagaaaacaaactgatatgccaatatgtttctctcctcaacgtgcacacaaaaagcacgacacagaatagacatggcaacagacagcaacacagaaaccctagtaatctagcaactccaaaaccgctcaaagaaaactccaaaccacaaaaacggaaacctgatgatgagtagattcgatttttcaaggtcccgacaacaaccgacgagatgcaaaactggacccaaactgatggacgtgactaacccaaagcgatgtacaaatgcagtactcacaactaaaaattaaatctaaaactaaaccagcactcaacacgaagatgcaatctaaaattcaacaacgcaaaaactaatagaacaatgcaatggatcaaattgtcttggtaaagaataaatatttttgcatagcaattttttggttaagggaagataaattatctaacggcaatctggcgctttgataccgactgatgaggatgttaggtctcgatcttccgattgttactgataaacagtcgatttgggcagagtcgcgacacactcgatccggcttctgaacaaacacgctactgagccccgtaatcgcagaaccacgtctcctctggttatcaaccgtaccgaaactcagttgacctcgccgagaaggttaatccctgcatgcgaatcgaaaaacacaagaaagaacaagatatattgcaaccaaattgcacatgaatgattaagcactcgaatttggggttccacaaaccgatctagcggcgaaactgttattgatagattaatttaagcaaaacccaactctaaacgatgacggctactgaatatatatgattagggaagtcctagggttgccctagggcgcacacccccttgggctaagcccacgacacaattacaaggcccaaaacccaaatcagattcggactggatgagatacgtggcttgttttgcagattcctggcagctcggtaggaattttgacgtgcgacgaaaaccatctgaaagtagactacataatctttccaataagtacttatgggccccaaaattccttctatatcagcggctaggtccgtttgaagttggtgctgtcaggaggcctgaatccgaatccaaaacatatagaacttcatctcatctcttgtcttctatggacttggtgaggtagaagtagacttggagaaggtaatggtttggtccccaatcaacttttttcatcatccatgcattcgttacgctcggtctcttttcctttgcccaagcaagtacctctgcaaaaaaaaaactcacgaaactcattgtgtagcaaagtttgttcaaatatataacatgtaaatctaatatagaacatatgcacctttggttgattaatacataaggtagtcatggttatatccgagctagttgtgtcttcattacgttggttccaaagaggagacaaatgaatagtgttgacaaaaattagcgacacgagagcgagtggttaccctctttctaatgtcaccaagtatgttgtcgacgggatgatctctttggacggtgtgatgtatccttggatggtgcactgggaggacctaaccctgattaagatgctctacagtgccctcggcatcaatcccattcacttgtgccgtaggcacgccttgactatcatcagtccggaacttccgggctgatggtttcgaaacttcttggcatggagaggcccggatgttccggtcctcagtccccggaacttccgggtctgctgacagtggacttgatgtagggctattgggtgtcgatgacggaggttgatccctatcttcttggtcatcctgtgtctcgactggtcgtatatctccaatagccttagtaccaattgctttgctaggatccgcatcatctacaacatgtacaacaacatgctctcgttgggagccattagattcatcaaatgtcacatacgtagtaacttcaacaatactggaggttttgttgaagacacgataggcatgtgtatttgattcatagccaagtaagaatctcttatccaccttaggtgagaacttagatgaacgaggcctcttactcaagatgaagcacttactcccaaaaacacgaaaatatgaacatttggcttcttaccactcaagagctcatatgaagttttgtcacatcctgattttcatcttaggatttataaattatttaagaaattattattagaatttatattaaatgttcattaatttacaactgaagttaaatgtgggaaatcaaatttcctaaatataaagcatggttggatttaatttttattaaattctccatgattaattatactctctgaaattttttcggatttttcggagctcaattcttaattttaatcatacaaagaacatttcagtaattattcacatattaaattaatcattaaatggtcttcttataattttattaaatacttatagtgttcaagtactttcaggatttttcttgaaattatttgagcaatataagtatttttaacaattcaaggatcatttcagtgattaatttaattggaaaagtaattaaaatccccttttcattttcgggctgaaactggaaaagtctatccgtcatcctcagcccgtccttcctctttgcctgtctctgcttcctgtctccttctttctcgaagaagtctattacttatccctctcttcttttcttttcagaccagtgaaaagtctacttttcctccctgtcgctgttgttcatcttcaacctcaggacagccgaactgagaccgagttggctcggtttttctcctccgaatccggccttatctctcgtgtattccgaaaattagttgaggggatttgtttcccttatcctcctctatctcttcccccaaaaatccagttttatccctttgaattcgacgcgaatttggattcgtttgcgagtttatctctccaccaaaccctaggttttcccggcgcgattccttgcgttccaagcccgatctctctctcccatggctataaatagagtcccctccctctcctctttcgtttgccaccctcgcccgagctcgccgtcggccgtagcgccctagccgcgtctgctctagcgccgccgtcgccgccgagtttccagccgcgccacgccgcctttgcagccgccttctccagtcgctgtcgccaccatcaggttcacgaggaggagccgcacaccgtccaccactcggccgaagccgaagcccgctggagcgccgccgacgccgtcaagccgagctcaccaccgcctcgatctcgttgccggccgtttttcattgtcgtccttcgtcgtgccgcccctcagtgagtttcccacgtcgtgttctttcttctggtgccttcggtttggccgcctaaaccctccatcgccggcagtggtgtggtccagtaccatgcccggtagtgatgtcgtcatgacatcattaatccttttttgtttaaggctaaaatcagatttatcttgtaaaattcataactaatttatttgaagttggaattaagtggttcaagtctctaaattcatctaaaatcatgatttacatgtttgtttacatttatgtactagccgcgccacgccgcctttgcagccgccttctccagtcgctgtcgccaccatcgggttcacgaggaggagccgcacaccgtccaccactcggccgaagccgaagcccgctggagcgccgccgacgccgtcaagccgagctcaccaccgcctcgatctcgttgccggccgtttttcatcgtcgtccttcgtcgtgccgcccctcagtgagtttcccacgtcgtgttctttcttctggtgccctcggtttggccgcctaaaccctccatcgccggcagtggtgtggtccagtaccatgcccggtagtgatgtcgtcatgacatcattaatccttttttgtttaaggctaaaatcagatttatcttgtaaaattcataactaattcatttgaagttggaattaagtggttcaagtctctaaattcatctaaaatcatgatttacatgtttgtttacatttatgtactatttatttggtttttattagtctttttcttcattttgcgtgttagcttgtcgttttcgtcgttgcgaaggttcgcgagtgcgtcggaagagattcagaagactaattgaagaccgattattgcaaggcaagtcacacagatcccaaacacaatcctttaagcatgttgatcctatatttaaattatctatttatttcaactgtgcatttattttcgaatgtcaccgggtggtgtgaacctattcctttgttatggccaatttgcattgaataccctattccacgataccttgggtaatgaattgattagcttaaaccttatatattggtttggttcagctaaatgctatatatataattgcttagccatgaacattagatcgttaatgggatgactcatactacattattatttatgattatatttaatggtagctcacgatagtcaatcgtgattggttaattaattatttgccaattaaaatttgacaatggtgggttgtgagcacatggttttgaaggtcgtgctcatgacaattaaggaccggttcgcgggctactgttgtgagacattaaccgtaccaaccacaagccagcgtgggcaacggctttaccttttgtatagcatggttcattacggggtgccagactaagaagtggcgagaagtccgtgggggtcaatggggagtccatgcctctggttatatttatagaggggttgattatgatccaagaatggtgcactgtggtgagttgtgttgtgtagagggtattgtcacagcctctattcgggtactttccagcatcgcgacgcatggtagacatgatgttgaggctgtgtcttgtgggtatagtggtacacatctggctagagtaaaactattcgaatagccgtacccgcggtcatgggcgggttgagcaatgtttttcgtgattagtctcacacctctcacaataattattgatgctataactggtaataatttgcttagctcctggtttggaattagatctgtacaaccgggtatggttgttcagaatggttgggcctgagcagcatgggcgtgttgttcagtgttgattaaaattaatgatt

SEQ ID NO: 57543 - DNA, 2581 bp, Oryza sativa
atccttgtgcacttgcatatttgctgtgtagcttgcggagtattccatgtactcaccttgcaataatcaatcaacctcagttaaagaaaaatgatccagaaggagaagacgtttggcttatacctcagttaagctgcctgtgggagtggagctaaagccatcgctagatcgttttttcgctgttgttttcttttcttttgtaagtatgtaacattattattaaaatggatttatatattaaattgtttgtttgtgtacctcggctgattcctggacgaggattttatgcacaaataagttcggaaattactagtgaatttctgggcgtgacaagttttctttagaagcttgtggaggtagaggcggttgatggcatggcatgcggtgctcacggcctccgcccaaaagatatctgaagtcttgtagtcatcaagcattgtccttgcggcttcaatgagggtttggttcttcctctcaataatgccattttgaggaggatcatatggcgcggagaactcgtgcttgataccctcttcatcaagaaattcctccacttgaatgttcttgaattctccaccattgtcgctttgcaccctcttgattgtgagataatagaggttttgaggttgctctacgaaacgcttgaagacatcttgtgcttcactcttgtcatggagaaaatacacccaagtgaagcaggaaaagtcatcaacaacgacaaagccatacttattacctccaatacttatgtaggccacgggtccaaatagatctatatgaagaagctcaagtaggcatgttgtagtcatgatgttcttgattggatgcagactcccaacttgcttcccagctttgaatgcactacacacacgatctttctcaaatgtaacattagtgagcgcgaggatgtgttccccatttagaagagttgacaaattccgcactccaacatgggctagtctacgatgccatagccaacctatggaggatttagcaatcaaacaagcttccggattcactctatccacattgaaatcgacaagatagagatcacccttcaactttcccttcaatgcaacggaagagtcatctctcctaatccttgtcggtaaacaagtaattgtaacccaacttacacaattgtgacacggataataaattatagcttaatgaattgacaaggtgaacattagagagagattgattgttggaggtggcaattttacctagacccacctttcctttaccatcatctccaaaaacaatattctcacgagttcctccctcctcgtcaagacttgtaaacatactcctctttccagtcatatgattagtgcaaccaatgtccacaacccaactcgaaccaccggagaagtatgcctacaaaagagaaataaagcttgggatttaggtacccaaacttggcgaagtttgggtcctttaatgttagtcacaattgccttgggcacccacacacaagctcgatactcttcattttaatcaccattaaaacaagcgaccactttgccctcaagattcttttttttttttgagaattacacagtacaacgcagacactcataatgcacgcgcactcacccctatgaacacacgcacgcaaaccctacccctatgagcatcttcgaagactgggccggcgaattctggagagattgacgaagtcaccacaggcgcctcgatgtcgacgggtacgtcgcctaccactgaaagcacaacgccgttaaatcctggaaaattcgctcccatggggagtcgaacccaggacatcaggtgctactgaggctcttgtaaccactaggctacaggccctttcgcggccctcaagattcttgatgattacatatgatacatagtacagaccagctggccggagcttcctagctttttgcccggaacctcctgtcagcctctttgtcttgccagaggtccggaacttccggtccaaatgatcggaacttccggaccgggacctctgtcctgccaggaagttctggacattttgtccggaagctccgagtctctgaccaacaaagggtagagtcacctcacttgcttgtgaagcctttccttctcttacaaacatcaagaaaatcttcccattcaccacaacacgtttggacacaggactttcatcagaaaaaccaagctcatgtccatctttgtttggatttgtagcgatggtcttgtagagagcgtctttggagtggtatgtcgaggtccggaactttcggtccaaatggtcggaacttccgaactgggacctctgtcctgccccacctgtcagcgaatagaagcgcgcgcgagcgggcggtggctcggctgcgggccgacttgggccggggaggagagagagagggttttgggccgactttcggcccaaagccaaaaggaggatttttaaaacttttttcaatttcaattattcatgaaatgcaattccaattattaaaaacacttccttggctcaagtaaatcgaagaaaaatctaggaactatagaatcaagtaaagtatttaataaaattttatattggaatttattatttaaaattagatcttct

SEQ ID NO: 57544 - DNA, 1588 bp, Oryza sativa
cccatttggaacctttctttctatcccaagaacaattaatctagcatttatatttttcgttccatttttctctatttttcatcatcagggtatctcatattctgatattcaggtatacgtgggtgtactgtagctgtagccgacaacagaatagaagagagcacaaaggatacttacaagcggcctgatagctacagcgttgcattgcgccatatcggccgtgaacttagctgataatgatatagatctcagatgatactctttcagaaaaaaagcaaacattcagctgtccatccttgggttcagagttcagaccagcagggctgcatgcatgcattttgccacttgctgaatgcgtgagaatatcatctagctacaccaaatgtactactcctagctccttaatgcatccttaattaactgtatactccaaatgaatgtcttatcatctatctgattgagaaatcagaatttcagatcaccaagagcttaattactgtatgtccttcctgaccttatctgagcgatcgagctgactgacgaccaaccggcagcttatacagaaacagtgagagcctgaaaactgtagtaatacagttctagtagctaaaaggacttgacttttcttaattaaccagtatatgtatatgttttcggatgtatacaaattctcctcatgccagccagatcgatccatgcacagtttgaagatagataggggatgtataggacaagagagaacacatgcattgaagtgacaaaattaaaaggagggacgcagcaatcatcagatgatactacaagcaaaggaacactccacatgtaaaaaggctgcatgccacatcaccccctctgcctgctcttggctcttgctgcatccgcatgcctccaaaatcaaccggtttattaataacattcaccaagcatgaacagaaatttactaatggatcgaaccagtgcttgatttttatgaaaatggatttaaatccggccactacatttgaaccggaatgtacgtggccaaaggatttgtgctcagggttttaaatttcgaaacttggttttctgccagaggtgagcgaaagaaccgaaattcagatttttttcgtacgaaattatttgaaattttgactgattttgaatgaatttgaataaagtttgactgaattcacaaaaaattgcaaaaaaccgaaagtttcgggcgagatgtgagcatttcggtgggggcgaaatttcgaaccgaaatttcaaaccctgtttgtgcttcacgttctttacaatcaagttaataatattgtaataagtaacagctaaagtagaggatgggattttcattgcattatcaaaaaaatgtatatatatattcgacgaatatttccaccggtttcacctcacaacataagctatagctatctatcttcatcagcagcagaggcagaggtgagctgagcacaacacatctccccttgagtagttgagtactgcacttgagtgatttaaagcttaactagtatactgactgcactaagcttaaacctcactcgactactaccacaaaagtgaaatattcttggctagtctagtctac

SEQ ID NO: 57545 - DNA, 987 bp, Oryza sativa
aatgactgaaatcgggaattcagtatgcatgtctgcttgcttaattctgacggaaaggcaagtgccactagtactctagtactgcctccgtttcgaaaatgtttgacgctgttaactttttagcatatgtttgaccgttcgtcttattaaaaaaaattaagtaattattaattattttcctatcatttgattcattgttaaatatatttttatgtagacatataattttacatattttacaaaagtttttgaataagacgaacactcaaacatgtgctaaaaaatcaacggtgccaaacatttcgaaacgagtagtatataaagttgcatgattctggcaaactttggtaatatctagattggcaaatgcatgataatcagtgctactttactattactacgctggatatttatacagaagcttaggttgtgcttagcctacgcctaatttggcaaagtggataatgcacatcaatctatcctgttgttactatccgacagtgagttgtcctgtatttctactcacatcgattgattcagagtgtggctgcctttgatgccttcagtcattcagatagacgatagttactgactctgtgttcaacgtggttagttctccacccaaacgacaatgcttccggttccagaccatttcatcgcgtgaaaaggttagcactaattagtggtggtgttgtgcatgaagatgcctgaccaaaattatggatagtcaaacagtagtcaaattgatgcgtcctcccgggtgttggataggagtacattgctcttttttccttttttgtgtgtgtatgtgtgaatggaggagtataatcaagtgtttaccgcaaacccgctctggcctatacagaaaggcagcccgcaaaatatgggcttcccacgcggcctattgcttcttcccgcttcctccaataggcctacagtgggctgacgatcaatatgggcctaatcttagggatcgtagctggcccg

SEQ ID NO: 57546 - DNA, 978 bp, Oryza sativa
gaggagttcgggtacttccattggttgctattgtgaattcatccttcacggcacgcaagcgtactttagggatcgatacaagaaaattggtccgtccatggccgataacaacatagtgtttggcaatgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcagactaaatacttctatcgtgtaatttcaattcaatgttgttgtaatgagtacctccgactatgttgtactagtagtattgcgaactattcggtgttgtatcaaatgttatcgtgatgagtgttcggactacacaccttt

SEQ ID NO: 57547 - DNA, 753 bp, Oryza sativa
aaaactggacacattgacatgcagatgcagcactacccttttgctttatagcagtttgtgttggcggtcatgtcttcttgatataaagatggaaatttgtgctgaaccacctcacaaagtcacaatgcagttatatgacagtaagatcacgcaattgaaaataagtacaatatctcataaaatgccagagaggacaagaacatacaccattgagatgaagatatcttgtgacttgtgaagtgaccttgtcagaaatagcctctctctcttttttttgagaccatggtgctagtcccaaatccttcatttttatggtgaagtggtgataacccaggatatgtgttatcttttctttggatcaccggtggatggtaaagagcatttctctggttgaaagctgcgactctccagagggcttggtacatctctgtctctggccttgttccgctaaacggctgctccatgatagaagtaaaagaatcgttggctacttaaattcaatgaattgttttcgtttcatcattatttttgtgagcaacatgctgcctacctttttgctgcctatgcctctttagaatattccagttcaggcaatcttgattgaaattggaactgcaaaaactcatttagaatgtatattatgtgcgtgcatttttttaaaaaaggcaaatgggccatgtgtagttatgaacacaccacactctgatatggtcagataagtgattgcgattcaagtggaccagtttcaaattt

SEQ ID NO: 57548 - DNA, 2284 bp, Oryza sativa
aaaaaaaaatcttacagttggttctcatctaatttggtcatcatctgatccttacagaaaatgaaagaaaggatgcacgaatgatgagcgtgttcaatgggtttaattcaaaatcggttatgaagttgcaatttgactttcccttattccctttgtgagcatgcgcagtgtcaggctgagctgttgttcaatgaaggtatgtgtccacagtgcattgaaatgtatttctctgagatactactgatgatactcatgctgagctgctaaccaatctagctagctgcctccccagttcccttaatatgctgcaaatagcagcttttggcatttaacagttccagcggcagtttgtttgtattttggctcgtcaagaacatgatatattaaactcaacacggtgtagaaaaaacataaagcagaagacaaaaatctgatctatgcatgtattgtttgtagctgtataagcatgtactgtgctacatttgccacgtcccaggctttgcatccatgtgagaataataagcatgtgcatttctgtatttctttttgcgggctgaaaacaaatataaagaaatcagggaaaaagaaaaaggcaaacaacccaggccagcaagatgtaagaagcatcagtctatcacgggccgcgaaactctttttgtgcgtgtctctatcttggtgcaaattaagagaggattcttcatttggatactttttgtttgcaaagagggagggagagagaaacatatatattataactctgcataaatcttgactcatgtgaaacatttacagaagtattgcttgaccatggcatcttcttcccctaggtacagttggatcgaagggagcgatccatccatgatccatcatccatgcatttcttcatggagatatagtaattaatcgatcggtcgagatcgatcgagatacaaaattaaagcagagacaaaaaaaaaaagaagcaagagataaaattctgaaggccaggccagcagctagcagcaggcggcggcgtcaaaaatgatttacaagtaagcagcaataatgtaataatggagaagaagaagaagaagaagaagagaggagtctaggccatgtaggcttggttgtaggaggagtccatctcgtggacgacgagcttcttggccgtgacgcgcgcgctggtggcgttgttgaagaggaagacgccggcgttggcgtagatggcctccgtggggtacacccgcgacgtcgccgtggacctccccccctgcgcgaagctctcgacgatggagtggtcgacgagcacccggagggagaaggtctcgccgtcgagcaccgggacgacgttgccgacgaccctcttgacgatgtcgtcggcgtgcgacgacctcgactcgtcctggcagaagtgcgtcgtgacgccgccgtcgctccccttggccacgtagaagtacacggcggtctgctccccatccccgcggtggcgcttgtcggcgagcaccagcagcccgaaggggcccagggcgccccggccggccgcgccgccgctggtgctgcagttgtagccgacgtcggcctcgaggacggcgtcgacggcgagcgggtcgagctggaactcggcgagatgtcgagctgcgtggcgcggtggaggttgagcggaagacggaggcgtagtcgacggtgatgccgccgaagtcggtggagttggtgcgcagcgtctccacctcctccaccggccattgcagcaggttgctccccgtcttggtgtccagctccaccgtccgaggaatcgaatgcatcccactttttttctttttactaattagctactactccagtaatttaattacacatgttaatcataattattattactatagcttgcttcacatgaaccaagcgattttgcattatctatcagtactgtgacagcaaagaaaatgagagcggtggaattatattgaaaagcaagcaaaaaagacagccctttttctggtgaaaagaaaaggttgcaatctatgaatcccagttaagttgtgtgtgcaaatgatttcagttaggcaaagcatcagcaaagacaagcagaatgcagctacagcacatggttgcacatgagttatgggcaaggacagctattcctactagtagtaacagttgctaggaggactatagcttggacacaagcaattccatccatcaaccaataataatacgatctgtttattatgtcaattattgcaaaaaagggtatctcaacagttgctccggtcggtagctgagcagtggggccccaacaggatat

SEQ ID NO: 57549 - DNA, 6904 bp, Oryza sativa
aaaaacgccaagttttatcttgcttcttgacaagtaatactggagaagaaaattcggaatcacttttctggatgataccttgggtcaacattgcagcacattgtcattcaatctcatccttcaggagttgtggataacggtaaggacgaacagccaccgctgctgtgtcagaaatcaaaggaatacgatgatcatgacttctttctggtggtagtccacttggctcattaaaaagatcatcaaattcttgcagcaactcaggcaataagtcacgtccagtcaaagcatgagcctgcggcggaaaagaatcaccaccatgaccatgccaagctacttgatgatcgtccctccaaaaagacatggtgagcttatcaaaatcccacaagatgggtcccaatgtacggagccactgaacacccaataccacattatagcctactagtggaataacataacaatcggtgatgaaatcctccgagtcaatttttataggaatacctgagcagatgcttgagctagtgacttgatcaccatttgctaccataacgttcagtccagattttgtggtaggcgagaggccaagacggtgtgctgcctcagtagccacaaaagtgtgggtagatccggaatcgaccaaagcagacatggttacacctccaataataacagccaagcgcatggtcttgctagtacggatgccggtcaatgcatgaagagagatggtaacggtgtcatcattgatactatcatcgtcctccccctcgtccatctccaagaggtagatacctttcatagagcactgacggtgatgatctttagagaatttctcgggacaattgaagcaaagccccttttcacgacgctcagccatctcagctgctaacaagcgacgaaaccttgtgcctgtagtacctggccttgtaggtgatttggaagcaacaatcgcagcagaagaagacgtgctactacccacacgggaaggtgctggagcagaacgaaaagaaagtgcagaacgctgtttattctccacgatacgtggagcagcgactgcatcatcttccaaccgctgctcataagagcgtgccaagctcatggcggcctgaagattagctgtattttgaagctcaacatcaatacttaaaggcttgccaaggccggcagtgaaaagattgacttgatgcatcggattgagagatggggtaacacgacaaagaagagccaaaaattgtttttggtattctgccacagtcccggttcgtcgaagtgcggacaattcaccaagaatattgttacggatgggaggaccaaagcgcatattaacaaagtgctcaaaaactgaccagttcacgagtccattatctttggaaaattgaatataccattgttgcgcctcacccgtcatgtgataggaagcaagccagaccttctcatcctcaggcgtccgttggccttgaaagaattgctcacaccgattaagccaggtcaagtgatcttcttctccatcaaatattggaaaggttagcttgtgataacggggaacaccacgtttgtcatcatccagattagcaccactgctccctttttcccatgaatcttgccgagcctcaaggttatcaagtttcttcatcaagagaacaagtgtcttggccaaatcagccatggttgtgctgtcttccgacatggtggagagctaggtataggtggtggctggggttggttgacggtggaacacaacagatgtagcggcggaagtgacgcaagcagcgcgaatgtgaggcgtgctgcgtcgagcggaacccagcgacaaagcaagcgctggatgagggctctgataccaaatattatggctggaaatagaggattgatagggaagatcgccctcaagtcgccggcttctccggaagaccgagtctctgatctgattgacttagtgggcagggcccttaatatctttattgcttagtccttaatacaataccaggccccctttatatactaggtgccaatctaatatttaggaaatctaagacaaactaggaataggaaacagaatcctaaaccaactagaattagatatatctactgattattcctattcctattcctatggtatttgattccataacgccagtctataacagatacagtatgcaatcagattttgtatttgcatgaacacctggagtcaaagaatccacaggttagatggagagaattttgtaatttgaattgagtaaatttcatcattagcacaaagatgagtcagtttcaaacagtaaaaccataaaattttaagggtgctaataaaaaccacaggaaacacgataaaaatgtttccgaaaattaacaatcgactatttttaatcatcaattgatatattatagtactatatatagttagcagatccaacaaatgacagctgtgtttagtttcacactaaaattgaaagtttgaaaaaattaaaacgatgtgatagaaaagttgaaattttatgtgttgaggaaagttccgatgtgacgaaaaagttaaaagttcgaagaaaaaaaaattttaaaaaaattgtcctgctcttctcctctccccctcccttgtttggagaaatttaatatggcaacgccgccgtcgcccgtccacgcgcagtgtcgacttcctctcggccgcgctagggacccacgccgccgccgccgccacgtccgccttttccccgctccgctgctcgcctccccagcctccgtccgtgctcccctaaaagcaggaggcggccgccgagaaggagaaggcgccgcgaagagtgagagcggggggctagacctagtgcaatcgagccttcatcggcgccaccgcgggccatcgcgtggttagccgccggagtcgggggtgggggggatgccgcgggagccggccgccatgcgcgtctacacggtctgcgacgagtccaagtgcgtgtcgcatcacaaaccctacctctcctctcctcttccaatgcattgaatccctcttgatgattcaggtacctcatcgtgcggaacgtcccgtctctcggctgcggcgatgacctcgccaatctcttcgccacctacggcccagtagacgagtctgtctcttcctcctcccacctataccataccaccacctgcctgtgtgaatgatttgcttgcttattcaggtgcacgcccatggatgccgaggactgtgacccctacaccgacgttttcttcatcaagttctcgcaggtcagcaatgccaggtgagtaaccaaaatagtaccttttctttcagtcctttttcctgttcaggaagaaccgacgttcacagaatgagtgaaaaatgttactagccaccattaattccaacaattaaatttgtgtttggtagtcttttctaagacaaatttgtctccttctcatccctgttttgagctctgtgcttaggattacagctttagtttagtttgttagcaattgggaacaaatctggacctactatttgccaaatcgcaagtttattttctcaatgaaagcaagaaacggcattaattgcaggtttgcaaagaggaaattggatgagtctgtatttcttggcaaccggctgcaggtgtcatacgcccctcagtttgagagtcttctggacactaaggagaaactggaagtcaggagaaaggaagttcttggccgaatgaaatgtgtgcttccatgttcttcttttccccctaactctatgctgtttagccttcgttgtttcaatatgtaaccgttttctttctacgactacacattgctagtttatcttgcttggatagttatatataaatgtttgctttcatttctccagcatcttctggaagacctgaagggttatctcatcattctccaggtcagggatcatctgctgcaaactcacaccgtcagatgagctctaataaaaggttaacatattgcgtactactatcagtttttttttgtgtgtgtgtgtgtgcaaacattgctaaggagaacattggtcatcagttactcattgatcggcccagtcttcaactaaattctatccctgttaaccatgccatttggaattggaagttaccctcatatccacatctttattgatatatgacatctggtctgaatatttgaagatggatacccagtctttatgaatagcttagcagctaagctacagtgggtttaccgaacaaaactgagatctttggcacagtaaagttgaaagaaaaaccagcaatccttattccttaatcaaaagactgagacacttcttctagctttgtgtttggtttgctctttagattttatgcatcagtttgtatatttcatactcagcactaccatgtaggagtatcaaccaggatttggtttgttcattttaaggaatgaacttcaattatgatacaattacatacactcgccttttatggaatattttcaaactttataagtaatattgaatgatgtggaactaagatggtaacccaaaagcccatctggatcttctctgattagaagtgtaaacactgtatatgacttatctagtgaagttccattttgccatcttcagggaatacacaaaaacacttcatgcttctcaatttgaagatcctcgtttcactcatgtatcctctaataaggtatgcagtacaacagtatgtatcctctaataggtatgcggtactgcaaagtaatataatgtttggaatttggactctaggtgagaaaccaagaggttattcattgagaaaaaatatggcattaaattagcagggcatataatggtgtaagcctactttcttttcagaaaaagaaaaacagaaacaggggaattaatgcattgagtcatacatagtccctggaaaggcaaattctgcaataatttggatttttgtatatcctgccatattattgaacttagtattcttaccaatttgtggagaaaatacttctctgtaggattattttccatctgagtcgatgaatgcaacagtaaacctagtcagggagaagcttgataaggtaagagtatctttgttaagtgtattatcatattcactgcaatatgtgcatttgtggataagttaaaggttccattttcaaaatttcagatacaatccagcagcgacaattccagtgctatagttgcacccaagaaaccaaggaccgataaccgtagacgaatttgatatcatgggatggagtagaacatgcatttttttttcttcatctactttcttgtagtttgttttataattggcagaaaatagtgtactataatgctaaatgctgtctatattctccctcagttgtaaaagtatccccttttaggttttctgcggaagtaacgttagtatcatgttttgacgtggattaatgtcatgtttgatgagcacatttctcttcgtgaaaagtccacctttcttttgaacaatttatatttgaaacatcatgttctgttggtatactgatttatctctacagttatgttctatttggatctcaaatggttcctatgaggttgtgacatctgtgttatggcatgaagaatttcatgatgtctgatataggagaaaaagatgacctctgctgatcagatgtactccctccgtaccacaaaaaaaccgaatctaggactggatgtggcacatcttagtatgtatgtccagattcattgtacaaagatatgtcacatccagtactaggttttttatgggacggagggagtaatagatagcttacatatactctattcggtcataaattgttgacgtctcggacaaaatttagccggagttttgaaattccctaaccacccgtatccttttcttttcctaacttcaagttcgagtcggatcccgatgcctatgtactatgctaagagcaagtacgatagggatgactcaatactcactccatcttataaaagaaaaatctaggactgaatgtgacacatagtataacgaatctagatagatctgtccagattcgttgtactagcattaagaacaaaagatagtgcagtcggctgtagaattataaccaggctatagcacgtaaaaagagaagatacaataacttgtccgcttctattagctatggagcatagatagtgatgggcctaataaatttgtatcaaataactattgtgcatgctagctactaaaaaaactaacttagactatagttagctgttggctttattattgtacctgctctatgtgtggaccttgaacatcaaacaatcagatctcgataggctattatacttaaatatagatataatattgagccgtacatttcgatgcctatgtatatgctactatcttcgtcccaaaatataacaatttctaactatatagatagaagttactatagtttataacatagagagtatgtaagcgtcgtttctcaaggtctaaaaacaactgggaagatcaaaatgggaaaatgagggagaaatatatagagatggaagagacgaaatggaaaggggaaatgaataatgcataataaaggaaaaaaaatgacaactgaattttttttagtcggacgacctcattgcccaacttcttgtaaaaagaaattaattaaatccggaaagcacaaagtaatagaaaaccatctctctcgcgatgtacaaagttgctgacaaccataaacgtggcaactttctggtctggaattcttgcgtgggaaagccgttaccacaatattaacaggaatagaagaaaggtggttactattaagtcttcgtgatagacgtaccatgacaatatttatattaggtgaattttcaaatagtggaatataaaatgccagcataaatatatctttacctctactattataaaaattaaagatgtttttgccggtgctttggtaagtcatccgtatatgagtt

SEQ ID NO: 57550 - DNA, 7999 bp, Oryza sativa
aacagacccaaagtatatatccaaacaaatttgtacagtgaattttatcttagctaaactgtataacaataataagattaaagtaactttcacccgtttgcaacgcacgggcatttttagtgggaataaaagagaaactcaaggagtaaaagaaaaagaaagcgaggaaaagagaaaacagggggagggagaggagagagagacatcaagcaagctaggaacaagggaagggaggggaaaaaactgtaggatctcccccgacatcaaaagaagaagaagagaaaaggatggcgatggcgatgcgacgtcgggtgtcgtcgtgaggcagccctccctcgcgatccacctccccgccgccggtaagcctccacctccgccattcctccccccacccaaaccctagatccacaccctcctctccgcccccgagatctcctcgatcccgtccgcgattccacgccgacatggccaccccttcgtgccgacgaccagaccgacgccgacttcttcgacaagctcgtcgacgacgacgacgacctctcccccgcccctgcccctgcccctgttcccgcccaacagtcggcggaggcggccttgcttccagctctttccgacctcagcctcgccgacgatgacacagacccttccccggctcctcctcccgtcgaggccccgccggagggtgcctcaccggagtcggggaagggcgccgtccacacaacggtcaagcaggtccagtgggcctcatttggaggcgccgccgacgatggggctgatccgttcagtgatctgtctggaggcgccgctgatgacggatttctcgggaccatggccgggaaccagagcttccagacctccgtcattgggagcgtgggggcatcagctcacgggatctttggcgggagccagagcttgactgccgaggtgacagatcaggattttttcggtggtacctccgatcagaacaccgatacccagcagcagcagctggagcagagcggaagcagtgctttctactccacagatcccaagtatttggagagcatttatcctgggtggaaatacgacgaggcgacacagcagtggtaccaagttgacaattctgatacgcacggtaacgccacccaggtggacaccagcactgagaatatccagcagcagcagcttgccgcttcttacatgcataatccgacacagtcatcgctagagacaattgcggaggagggtacgacgacagggagtgtatcgacatggggacagggtggcacctcggagtacccaccaaacatggtattttacgccgagtacccaggctggtactttgataccaacacacagcagtggcaatcgcttgagtcgtaccagcaggcagtgacagctagtgctgttcaggatggagcaaacaatggtgtcgttgcctcttctgctgagacaaattatagcgtcaaacaaaccgaagatcttcctgcccacaatcaggtggcccaacataactctttctctaataactatagttatcagagccagtggcagacaaattcatttagtaactctatgcaacctgaaagtgcaacagctagtctgccagatagtttccagagccttggtcagcatgctatttctgaatctttcaattcctctacaaatagtcaagttagttttaacaccgctgaaaccgctacaagccattatggcaacgtgaacttagattcgtcaagtactcagggtggctacaccgcaagtggtggtcaacaaactggttacaagggcttcgaacctttcacaggtcatcaggctggttacaaggggtttgaaccttctacaggccaccagacaagtcataagttatttgatccatcagcaggtaaccaaaacagttacaagccatttgaaccttccactggtcaccaccagcacaaggggtttgagccttccacaaatcaccagggtgattacaaggcatttgagccatccacacataaccagggtggttacaagggattcagtccttccacagttcagcagcctggttacaagggatttgaagcttctacaggccttcaaactaatttcaagggatttgaaccttactcaggtcaacaggctggttacacgggatccctaccttctacaggccaccagtctagttacatggggtttgagacttcttcaaaccagggttatggtgatgccaacaatgttgcaaatagtcaaggctttgttccgatggagagcatgtacggaagccataatcaagctcatacaaacccccaagtgcctttgtcaaacagttatctcagtgttgataactccaagaatttctctcagcaacaatttcttggtccaaatgcttcacacttgcaatttgggcagtccccacatgaagagaggtcatcagctggacgtccaccacatgctttggttgcttttgggtttggaggcaagcttatacttatgaaagaaaccaactcaatggccacaaactatgactctgggaatcaggtatgctaagagttcctgtgtgatatatttttagtcatcaaacaaaattatggcatatgttaaagtaactaaaatattctattttaattttgcaattcaaggggaattctagtggcacagtatcagttcttaatttatcagaggtggtcacggacaaagctgatgctttaagcgccagtaacggtagcgcacttagttatttccatgctttatgtcgtcaacctgttcccggccctcttgttgggggaagcgctgcatcaaaggatgtgaacaaatggcttgatgacatgattgcactgtatgaatcatcgactagtgaattccagaggggtgatcctcgcaagttgcttatttctttgctgaagatactatgccaccactatgggaaactgcgttcaccttttgcttctgacccatcacatgaggtactttctgcctttcatgctcttttttgttgcatctatagtgtattttaccaaaacagaggctgatataatgaatgctccagttaatcaactcttagtgttgtaataacggcgcagagggcaagcttttaatactttttaatgtgatgaacatgtctgaattagcagtttaccttttagctcatcgtgtgtgataatttgggtacttgtttcattgtttgtcctttcacctttgtatctctgactcatttgaattctcaataataggacacagacggtccagaaatggcagtaactaagctcttttcatcttgtaagagaagtagctttcaaatgggcgatttcggatcccatgtccgttgcatgaagaatattccctctgaaaatcagatgcaggtgattgccatttatattatatggatgtgaaatttagctaaatcctaaatgtccccagttgaggcagctactttgcttgtaggctgttgcacaagaggtccaaaatcttctagtttctgggagaagaaaagaggcccttcagtgtgcccaagaaggtcaactgtgggggcctgcaattatacttgctttgcaacttggtgataaggtttgttcgacttaatagccttctcttgtttgcatttgaatagtttgcttgattttcaatgaggttttcttttccttaattttttttatttatcttttctttccccaccggtggtgcagttttacgtcgatactgtgaagaaaatggcccactgccattttctatctgggtcacctttgcgaacattgtgccttctcattgctggacaacctgcagatgtttttaatgcagacaacaacatcagtagcaattatggttctcaacagcctatggaggtaatacataattatttttcactttctagatgcgcgatactttggtcgtaggattattctgtagttagatgtaatagtaataattgttcttaacttttcatagcacttgcctgtcccatattgttgtacaataatggcttttcatttctttgttactgcagtgtcatggtgctttggttttttttttcttgaagaaaatgttttgcttcattgataatgcattctactgttctaccacctcgttgttggctttctgtttaaatagtggctcactttataattcattgttttgtcacacagcctagtcctaatggcatgttggatgactgggaggagaatttggctatcataactgcaaataggacaaaaggtgacgacctagttattacccatcttggagattgcctttggaaagagaaaaatgaggtctgtatgatatgtatttgcagaattaaaccctttcttttttgtggtcaagtaccttatatgccttttgatacaggttgcagctgctcattcgtgctatttagttgctgagttaaatattgacccttactctgaaagtgcaaggttatgtctccttggtgcagaccaccttaagtgccctcgaacttttgccagccctgaagccattcaggtatattactgctagccattaacccattacctgtaaatatattgaatcttagtgcaattttccctcgaagctctatcttttgctttttaatgattagttaatgcaagcatactgtctcagtgttttataagcaattattgcatagatacatagactggaaatgcaagattgtgtgtaaccgctaacctgttgcttcatctttttttactctgctgtccactgttctgaactaatattttgaaatgcgataacagaggacagagatttatgaatatgcgaaggtgcttggtaattctcaatatatcctgctaccctttcagccatataagctgatatatgcatacatgcttgcggaagtgggaagggttgctgattctttgaggtatgttgttgatttgtgcatggccagcaaatgatttcaatgctatacctaaactcctgctttcacattatgacccatttgaatctccttaaaggtactgtcaagcatctatgaaggtgctgaaagcctctggccgtgccccagaattggaagcatggaagcaattattttccaccctggaggacaggatacgcactcaccagcaggtaaatccttacagcttgttttgcaatgtagctgagttcctccctctccctattaatgcacttgtgttgattgctattgtttagggtggatatggcacaaaccttgcccctgcaaaattagttggaaagattttcacctcactcgataaatctatatcgcgcatgatgggtacaccttctgctccacttccgccattgccacagggtgctgttagtgatagggagagttacactgcacctggggctacaaagtttgcaaatagccaatcagtaatgaccatgtcatcgttaatgccatctgcatcagtgcagtctatgagtgagatgtcagatagtggcaggaagattgcacacaacagaagtgtttctgaaccggacttcggcagaaccccgaaacaggtaattatgccctcggctgaggtagacacttataaagacagcaggttctgattagtgaatgccgagtgataaaattctaattcttccgtttgtttgaaaaataacagggtgctggatcggacagcacacagagtactgctccaggatctggtagttcacgctttggttggttaggctccacactacagaagacaatgggatttgtttcaaaatcccaccggcaggtactttaactgagctattgaattggagccactccacttttgttcagtttctcttccatatagtaaagctaatactgagatccttcctatgtcttgaaggctaaattagggcaacaaaacaagttttactatgacgaaaagctaaagcgatgggtggaggaaggtgctgagattcctgccgaggagcctcctctccctccacctccatcaaaaccctcattccagaatggtgtggtagactataaattaaatggccccatgagtgcaagtcatactcccaatggattcatggaagggaaatcttcaacttcttcagagcatggttcgggaatgccaccaattccgccaagccagaaccagttttctgcccgtggacggatgggtgtccggtccaggtaatctaataattctgccacttgctcatgtctttctctatattctataaaatattgaccagaggaaagttatgtttatttttagatatgtggacacattcaacaagggtggaggaggaggagcagtcccatcctataacaagccagctgttgcatctgtgacaccacccagtggtgccaaattctttgtgcccactgcggctgttgttgctgcagagcagatgcctaaccaaacagcggaaacacatggtgaaaccttccgtccagatgagcgttcatccccagctgaaacgtcattttcttcacccccaccagcaacacaattttcagcaccactgatggtgcctaccattcagcggtatccgagcatggataacatcactaccccgaacaatggatccggattatcatcgggaagtaacagcagctcattctcaagatcacgagcagcatcgtggagtggaacttactctgaacaaattaatgctgtggcaggtgctagatctcctgaccagcagaccatgccatcgcccctcatgcctgggaagcagtcacatagtcgttccaacagcaactcatctgttcagttcaacagtttgacagaggatcttcatgaggttgagctctgatatgctgcgactgctcagtatgacccatgattttatagaaacaacctgggtaaaataccttgatcctctcagcaaaccccctaaaggagggagggagggagggagggaaaaagagaggaaatgttttacagtaaatgaagggaatgccacaagtgaaatggatatctctgtcttgcacaaagttgtgggatggggaagtaaagcaaggtgtgcccgccctgtactcgtacaaacagttgtttttttgggagattttgtaggtattgttggttattatgggtttagagaaggggataaagagtcggatgtccttttttacatgtgaaaagcagagagcatgtggacaccattgttcagataatccaccccagcccagccccagccctgcccccatattataattcattgaagacgcatataattgggaattcattccgcccacatccttgttttgtcattgtattactatcatatttttttcttcataattcttggagaaggatagaagagagggagaggtcaagatgtgtctggatattctagtgtaagaaagaagaaagcttttgactgcgtagagtgttgttatacttactgtaatgttcctataccatgatgatgataatattattctttggagtcgaccgatggatcaatcaatactggagtaagtagcatcctttttgttttgtttcccagcatgcgtgatgaaagaggtcaatatcatgtggtggtttggtttgatgtgattcatctggtagtttaatttgtgctgtgtgttggtaaccaaaggctctctctaaaaccggagaggaagaatagatcactatttccttcattccaaagaaaatctataacagaaattgagggcaaagaatctggataattgttttaagtttttttaattggttattctaagatacttcctccgtcccaatatattgcaacctaggatagaatatgatgcccaggttcatataggttcatagtattaggatgggtcaatcccatcttagttgcaatatattctaggttgagtttttaggatgtagggagtaggctactagagtagagagattggtaggaatcaccaaaagttgagggcatttttttatttattttcactaaaatatttaaaaaataatcttttgtttcaaaaatttatagatctggatgcctcatgccatttgggagtgtaaacgggctttaaaaaaacatcaaacattctgttagagaatgatgtggcatataactgttggttactcctttcccgccctcccaaagggtttttttttataggaggaggacgcttttaaatctgcttgat

SEQ ID NO: 57551 - DNA, 3176 bp, Oryza sativa
  unsure (1)..(3176): unsure at all n locations
tcacttttgtactgcagctgcggactctacgtgatgctctagattatgatcggtctgctcttgtacgctacttctccgctgcttctgcatcctttcccacaaagggaggtgctgctgctggtatgtgctgtactagtagcctttttctctttttctcaattgatttactggagtatatgcatgcaatctgtttgtttgtttgtttgtttgttcaaccaatctggagatgccctttcacattactaattttctgtgctcattatttatttctcttgtttaattgtatcttctgtttgtaatctatgtaattctgctgcggctgtggtcactgcttataagtcctgcattgtcatcatcgttcaaactgatgtggtgctttgcactctcacttcaatttaatcagaatacaacttttgtatcttgtatcagttatcctggatcctccagaggtgcttcttcttttgcacctacatattatcagtttcacaagaatatggggcattcatcaattatgtattctggactgtaatctaattaatataggcaaattatcaattgtttacactaaaatctgtacaaacaaactattttaacacaagcacaatgctttctcatcttttttacctctccactccgttattttccgtaccttcgaccaaacatgttttggcttcctgagccaatatcatcatttttatttattaaggtgtcatttgccgttgacttagtttaactacgctcatatcctccagtgcagacagcagctatttttgtcacgtggcagcttatttttacagagagaagtttctgttgttcattgtcacccgtgcttttggtttctgcaggtgttgagaaaagaattggtggcgccagattccctcagtgcaagcagcctgggaaagagcttgagaccttcaaggttatgttcatgaaaaataatccgcattctgagatccctattgtcatatcctgattgtctagtttgtcattttatcttttcaggtgtcactaggaggactaaatggaagatatgcttgtagaagagcacctaacaattgtatcccaaccactattaccggtctcaacggttcattgtcatggtatgttttgttttctgctatgctattgttagcttatatggctgtgtaggaatatattgaattagagaaccacccttgaaacaagagaatatgaactagtaatacttgaacattgagctaagacaaaccataaaaaaattattgacatcttctgtaaggcccctgagatatgcctctctgctctttagtgctcttttaccagaagaaatgaccccatgacagttctaatttccattgcatcttggtaatattcctcttttcctgtttcttttcccagtggacaggtgtcttcagcaagatctttctcaagcagtgcaggtacttatcccagcagttagttagtcttaagtgggtttattggttgggcctcacttatgtgtgatgctttttgggaagtgttcttggtgggaggggttccttgaccctttctttataaatatttctctcttcttaatgaaatgaagcgcagttctcctgcgttttttggggaaaaaaacaggatatcgcatagcagctcctcagttttttattgatcttttttgcacttatctacaatgttgtttttttgccatccttctttttgttctattatttgcttcactttatcccgtcttcccatgtaccaattgtttcatgcatgtgatcctctattctgctacttttttttggatatttttctccacatctgtatctccgttgaattttcaaaacttttttttggaatgtgttatataagcatttaggttatttgcaacaaaataagtatatcccaatctcacgccacatctccccattgttttggtaacatgtaaaattttgtatgtaactccaatcaatggttccttaaaaagcatgtaaagaaaggtcctctgtaagcttttttaattcttaacgcaatttgctaattcaaaacctgcccccacatcaggaatattggaagtgccatcattttttctcacaatgaattaaggtatcttgttacgccaaaaaaaaaaaaaaaaaaaaaaaaannnnnccgttgctccttatctgtatttcttgaattgcatccatcggtgttacacctttaacaccagaagtattacaccttacacttgtattgtctgtaggggaacattgcaaggtggctgaagaaggaaggagataaggtctcacctggtgaagttctctgtgaggtggagacggtaagttttctaatatgtaaggctacatgccatatattgtttagatttatttttagttatgcagttagccagttacttctattaagctgcagtagaagctaaatatcctttgaatgcattcctgctgactaggataaagccactgtagagatggagtgcatggaagagggctatctcgctaagatcattcatggagatggtgccaaagagatcaaagttggtgaggtaaaaatttactgatcaaagaacaaccaatttatgactctcattttactaatatgattattacagttgcctctgcctataaatttttctgacgtaatcttggttgatttatggccccactgttccttttagatcattgctgtaactgtggaagaagagggtgaccttgagaagtttaaggattataaaccttcaacttcagctgcacctgcagccccttctgaaccgaaggctcagcctgagcctgcagagccaaaggtgaaggagacagagccttccaggactcctgagccgaaagccccaaagactgaagaagcttctcaaccagggggtcgaatattctccagccctcttgcaagaaaattggcagaagataacaatgtagtttttttttcgtgttacctatctaggctattaattggtagattttattgaatcatacttaataacacaaaacaggttccactgtcaagcgtaatgggaactggtcctgatgggcgaattttgaaggcggacattgaagattacttgggtatgccctttctcttgtcccctccaccccccttctctctctctttctcctcccttaatgatgaaatctgcgtggaaaaatgcaattaactagttttatatatttaccaatgactatagattaatttattttcaa

SEQ ID NO: 57552 - DNA, 1571 bp, Oryza sativa
atttaacaaaggctaatcagaactaccttcctgaagcacagaattatgatttcataaacacacctcttttcaaccctgcacctgcagggaacatgagaattcttactttcaggtgcagactttcaggaaagccaaagaatctgatctaaatttgaccttgattaacccttttcctttcttcaagtaggctgaaaactctggttcatatttcatactagaagaatgtgggggtgtaagctggattgacaggatgattaccagaagtctccgcaagagcacgtgccattgttaaacttgtgaaatctgacagcatccctcacaagaatatcacggcaaatctggaacgctaggaacgatttgaatttcaaatccaaaaaattgggaacctctgcaggtatgccatgcagctcaggcaatgatttatgcatatgagaaagaagcaactttggaagaaacaggtaatactgccaacaaggaacaacagcaagtagaagtcacaaacttatctcccatccctgcaggtatatttggtgctacgttgattgatttgtgtgtggataacaaaacaggaattgatctttttgtacatgatccagttatcccaggctgccatctggctaaaagctattagtgtgaattctacttccccttgcaggctgagcttacagatctctgggtagccttaaaaatctgcagtcttctcagcttggtgaatgtgatcttctcactgataacacaacaattgctactatcttcaagcaaaataattttcaggagaatctatgatattggagcttgaggccgctcctatcaaaatttcaacaaaatttgcaggatcagcaattgcaggtcaaatggattcctacaagggcaaatgaagttgctgataaacttgcaaatgaggcaagaaggataagttgttatagggctagaactttcagtttttgtcacaatagttctcatgtttgctatcaatctagatgcccaaatacaagtgcccttgtaaacctctgtcttgaagagcaaaacataatgcatgtattataatagaagtcatgaattctaaagaaagagaagacttaaggttgttggctcaaataagaattgccaagatgttaaaagaccaattgccaagatgtctatttgagaccatactcatggccacatgtagtgcgcaagttgcataagttcatcaaaacggcgtagcaataaaatttaatgacggttctagtgtcctgtggtttttcagaagataataaataacaaaaaagggcttatgcttaaaaagcagccaatttacttggaaactaaagtttctaagattcgttttttagggaaatcatccaagaaagcatattagtttattgcaaaggaaagcatattagtgacagcagtaaatagctatatctttatgtatttctgcagaaatcaatgcccaaggtcatatgaaagaaatcagcatataaatgacaaaattgatattgataggtgctggaagcctcaaattactttatcccgttggtgcttctatacaatatgatcctaccataaaagcaaaaaaataaaataaa

SEQ ID NO: 57553 - DNA, 1415 bp, Oryza sativa
atctgagttgagtaggatttcaaggaacatgtcctctttgagcaattttatagccaatttagtaaaaagctctcatcttatttacatttttaagaggatatttctatgacaggcattacattggatcatagaaggaatcaacgagatgctgacctttcttctcaggaggtgatacttcccttttaccagtgacattttctgctttatgaactacagagtgagctaggaaatgcagcagtagcttccctccctacttcatctactgactgcactaacggatccaagcaagaaaaaaattcttccttggagatattatgatctatatacttggattgaactgaagaaatttacagaaaaatgtcagtgcaaaaaaacaacacacagaaaaactcaattagagaatggatatcagctattgagcttgcaaagtgagaggacctggatggctcaaagccaatggctctgaccggaggagctcgcagcgatcccttctcccatttcaggaaagccaaagaatttgatctaaatttgaccttgattaacccttttcctttcttcaagtaggctgaaaactctggttcgtatttcgtactagaagaatgtgggctgtcagctggattgacaggatgactaccagaagtctccgcacgagcacgtgccatcactaaacttgtgaaatctgacagcatccctcacaagaatatcacggccagttatcttagaaatgaacttggtagcattgtgacaatccacacatacccgtagattcttgacaatccgaattggcatttcttgtggaacaaagattaagccaaaggcaattgctagcttctcgctgtgatggctaatcatgtgaaccttatcagcatctgccacatcatgcagcaccgagctgacatcaggcttgtatccttcttcagccatctttgagttgagccactctagcttttcgtatattctactggagaaggggtgggattggtcatcggctgaaaatatgtgaactttgttcttgtacttgatccaactgcagcctggttccttcttcacctgcctgtccctcattccacgtctaagatgagcgacttcagtccattgacctttagcagcatgcatgctacacaacaacacatagctggcagggttttgtgggtcagtttccaagagattctcagctgcccacttgccaatctccatgttcccacgcagcctacacgagctcagcaatgttgcccatccaaaggcatcaggactgtgtggcatctgctttatgaattcctcagcctctttgaacctccctgatctactgtacaagtcaatcatacaagtgtagtgatcatctataggaacaataccgtggtccttctgcatggaatcaaagtagtcgcaccctttctctacaagtcctgcacggc

SEQ ID NO: 57554 - DNA, 1810 bp, Oryza sativa
aagacattatcttcataccaagtccgagttatgtaggcatgtatctgcttcctttcttccaaggcagcaagggcaccgcaggctgtaagaatgcttccgaaagtgtactgatcaatgccaacaccctctgccctcattctcctgaaaacatcaagagcctccaactgcaaaccgttctgagtcagtcctgtaaccatcgtagtccaagtaatggaatccctgtccaccatcagctgaaacaaaccctttgcatcctcgatcatcttgcagcggagcagccctgtgatcaaggtattgtacatgaccacagtcttggcctccatttcttgaaacacccgcctggcatccctaatgaggcccatcttggcatacatatcgaccaacgggctcccaacgaaagcatatgccccgaacccaagccgcagtacctggcaatgcaccgagtggccaagcgcgcggtcggagagagccgaagcgaccatgatcatcgccgacagagtaatccgggttggcctgacgctctcctcccggagcagcgcgcggtacagctggaccgaccgggcaggagagccggtgctggagaagccggtgatgagcgcgttgtaggagacggcgtcccgctcgggcatcgaggcgaagaggcgctccatgtccgggacgagccttgagtgggcgagcgccgagaggagggcgttgcgggtgaagaggttggggtcgggcatttcgtcgaacacgcggcgggctcgggcgaggcggccggacttggcgtaggcggtgaggaggtggttgaggaggaaggttgggggagcctggagaaacgtcttgagaatgaggcagtgcacagcgccggccacgcgaaccccggtccggccgccgtcgccggcggcggaggagaggatggcggcgtagcggttgcatagcgcgtgggcggcgtgggtcatcgcgcgtgggctttcgcttactagactagaagtgcccgcgcggttagcagataagttttcgatcgttcgttttattaaaaacttttataaaataggtaaaactacatgtatacataaaaatatatttaacaataaattaaatgatatgaaaataattaataattacttaaattattttaataagacgaacggtcaaatattttttttaaaaaaaaagtcaatagcatcgaacgttttaggatggagggagtactattaaaggccttcacatcaataaataaaagttgggattgtacttgacagtagttaacaattcgggaaagcacaagaatgcatatgcaaacaagcatcaaattgggcaaacatctttgtgacacacaaacataaaataaacaacctggccactagcaaattgacacgacactaaatcaagaggagggaaaaatttcaaaaaaacagggaaaaaggaaccgtaccgatcttggggaattttatgattcgcgagcttccctgcaagtactatggagaattttttttatttataatttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctcgcgagggcgattttgtactgtgcggggggccgcctgc

SEQ ID NO: 57555 - DNA, 12222 bp, Oryza sativa
ttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattatgcattagatgtgacaagacgatcacgcgtgggcgtgattcactttatgtaaacaggcagcgccgaaagttgatagtgataactcgagctgccgcttttcatgtgtgctgttgtggactatgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagatgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgttgtaggtcgcactgctctgaagctaggggcgctcgaaggcaaacgaggtcctgcgaggatggaacatcaagttaccgcggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgaacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaatgggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactgtcgacctatggcaaacctctcggctgcccaaagctgaagcaacatagggcagccagcgatgatcgctcccgcgtcagttgtcacaccccgaagttttcctccctagtcaaaattgtaatttataattgaccctaagaaaatgctggtgaaatcaggagaaaaccctaagaaagtaatgcaaataataatcggatttgacatgtggaatttttcttgaattctacatgtcgaaattcattaacaggatttttagtggaattttcagagctctagaaataattttaaccaattaaaaatcactaaagtgcaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgccttccccgcgcccgttcccctccctctcccgctcgcgccgcgcccgagatggccgggattcgaaaaccgaatcccgcctctctctcctccccactcccccacgtcggccgtcgaatcccgccgctcccggccacgtccggtttccccatcccctatttaagcatcaccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgtggccgaggtccacctcgtccgcccctcctccgtcgaggttcgtcgccggagccctcatctccacgcgcacgggtgagcgccacctctaccgccgccttcggccatggatcccgatcgccatggtccatctctctctctctaattcctctcttctccttccttagggcacgccggagctcgtccgctagccgacgccgtcctcccgtggcttgccgtcgccgtccgccatcgccttcctccgcgccggccaccctcggtgaggcatcccctccctccttttccccttcctctcctcctagagccgctagccgccactctccgccgccggacgatcgccgtcggtcgtcgctttgcgccgctgccgcatgcgcgccgccgccgtgtgagcgccgcgccgccggcgccatggtcgccgccgtctcgcgccgcgcccgcgcgccccggccgcgaggtcccgcgccgccgtccgatctacccttgggtagatcggggccgtcggttcggccgccacgtggcgccgccgcccctccttttccccgggtcgctgaccggtgggcccgcgcgccgccaccccccttcctctctctcccatgccgctgaccggtgggtcccgcatgtcggcgccgcaccccccccctcgctgacgtcagccctggttaatattgcgcaataaattatttaaggatttcttttatagtattaaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgattgctttgtatgtcgctagattccggttccttcgacgctccggtgtacttcaagatagtcgccgaggttcccccagcagcagagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttgctggtgttggttaaataaagtgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgtttaattttttttacaactgtttttgcattaaattcctgtttataaatgccagtatttatgcaaatgaacctgcttagctatcccttgttaaatccatgcatcatacccctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgttttccgctgcatctctgtaagacttttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttctttgcaattggattttgttccgggaaaacggggatctgttcttgtggttcaagggaaaaatcttggtcgctcgtttaaagtgagttttccaaaacgagtcagtctagggttttagtaaaattattgggatttactcgtcagtcagttgggatttgatgggtgaaatgcattcggtcctagctcggtatcatgggttgcaaggtgtttatgcttcgtttgttactactattatgtatctaatttcccattattttatcgttatgtgagtctgtcttatttattcgcgctcatgtaaaatgatctatgcataaaattttgctcttatttgattcctttatttgagtctttattgctttatttaaatttggatttgagcatacattgatcctactcctttgtcttctctagatggccggtcacccacccaaccaccgcggagaaggcatgatcgacttcgtggcagagctggcacgcatgacactggtagtgggctaccccgacgcgccggagtacacgaccattccgccgctcagtggcgagcttcctcaccgtgtccgcttggaggtccatggctacgtggggacttgcctcgctaacatggcggtcgaggcatctggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgaggtagcgcgcctgaagaaggagaatgctcagttgaagggtcttccagcgccaggaggagtccggatccgcactacgccccgtaagaggacgactacacctgtgcgcatccagctggcgcccaggaacccacctccaccagcggcccccgcagcagctccagctccgcccgcagttcctgcagctccagctccagctcccgcgttcactctctccttcgctccagcatcagccgccggaggttcagccagtggtaccggaggatggctgtctgctactcccagtggcagcggcgagactgatccgtcaggctccaggagtcgctcagagggaccgggtgacgagcaggaggacgctttcgactccaccgaccgcaggagccgttccgagcattaggctcgtttttccactagttcatcgactgtctagtttttgtttgttagtttgtgtgtttaggttgcttgtttggggtcagttgacggtcgatatcatgtgtctatgatatggctgtcttaataaggatttttgcttgcctttttaagtgttttaattcagatcagaacaattgcagttttaattcctatataataaagcttagttcttgagcatctgtttttcttcttttccccgtctgttcttccctccagatggtctacaccaggactggtagccgcgcaacaggcgagggcagcaacggtgaagaacgcgctgatggtgtgcaccccaacggtgattctggcaatggtccgccaccacttcccgagaatccgacgcttgcccaagttatggcacatcagactcagatgatggccgcgatgatgcagcagatgcagcagcagcaccagcagatgcatcagaggatgatgcagcacgccgaacagcagcaccagcagtttggtccccctccccctcagtccaagttgcctgagtttctacgtgtcaggccacccaccttctccagcaccaccaaccctatggaggcaaatgactggctccatgcgatagagaagaagctgaatctcctgcagtgcaatgatcaggagaaggtcgctttcgccacacaccagcttcagggtcctgcgtcagcttggtgggacaaccacatggccacccgcccaccgggtacggaagttacgtgggcagagttctgccgtagctttaggaaggcacaggtgccagacggggttgtagcgcaaaagaagagggaattccgggcgctccatcagggcaacaggacagtgacagagtacctccacgagttcaatcgcctcgcgcgatatgcaccagaggatgtccgcactgacgccgagaaacaggaaaagtttatggcaggcctggatgacgagctgaccaaccaactgatatccggggactacgctgactttgaaaggctggtcgacaaggcaatccgtcaggaggatcagcgcaacaaaatggacaggaaaagaaaggcggcgcagttccgatccaaccaaggtagtcagcaccgaccgcgcttcactcccggacagcagggtggacctaccaccatgatcgtccgacagcaccgcccgttccactctagcaacttccaccagggcgctagcggcagtcagaaccaccagggaggccagcccaaccgcggtgcagctccacgcccaccaatggcaccggcacagtcagcccagcccgcgcaagccaagaaggagacgggagcaaaaccagggtcttgcttcaactgtggcgagcttggccacttcgctgacaaatgcccgaagcccaggcgtgccgggctaaggtttatccaggctcgtgtcaaccacgcgtctgcggaggaggcacaagcagcaccagaggtcgtactgggtacgttccctgttaactcaatccctgcaacagtactttttgattctggtgcaacgcattctttcatttcaaagaaatttgtggggatgtatgggttaaggaaagaagagcttagcacaccaatgagggttcataccccgggaaatagttcaacctcagtcagttttagcccttcagtgctaatagaaatccaaagatcaccatttctagccaacctcattcttctcgaatccaaagacctagatgtcattcttgggatggattggctgaccaagtttaagggagtcatcgattgtgcgaatcgcacagtcaccctgaccaatgagaaaggagaaaccgtggtgtacaaatctctagtctcgccaaagaaaggagcctcgttgaatcagattgagacggaaatcccagtggacaccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcggaggtcaagaagcaagttgatgaacagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcctttaccgcggatcgacgatttgtttgatcaactgaaaggagctaaagtgttttctaagatagacctgcgatcaggttaccaccagttgagaatccgggaagaggatattccgaagacggccttcaccactcggtacgggctatacgagtgcacggttatgtctttcggacttactaacgcacccgcattcttcatgaatctgatgaacaaagtgttcatggaatttctggacaagtttgttgtggtattcatcgacgacattcttatctattcaaagtccgaagaggaacatgaacaacatctccgtctggtactcgagaagttgaaggagcaccagctatacgccaagttcagcaagtgtgacttctggttgacggaagtcaaatttctgggtcatgtcattacagctcagggtgtagcagttgatccatcgaacgtggagtcagttacaaaatggaccccaccaaagaccgtgtcgcagattcggagttttctaggactggcaggttattaccgccgattcatcgaaaacttctccagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggtccacgctttgaagatctggaggcactatctgatcggcaaccgctgcgaagtatatacggaccataaaagtctgaaatacatcttcacccaaccagatctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcggcaggagtttgaacatctcaacgttggaattgttgaacacgggttcgtagccgctctggaggcacggcctacgctcgtggatcaagttagagccgctcaagtaaatgatccggaaatagcagaactgaaaaagaacatgagagtcggaaaagctcgggatttccacgaggatgagcatggcacaatctggatgggagaaagattgtgtgtaccggacgacaaggaattgaaggatctgatactcaccgaagctcatcagacccagtactccattcacccaggcagcaccaaaatgtaccaagaccttaaagaaaaattttggtgggtcagcatgaggagagaaatagctgaattcgtcgcactctgcgatgtttgccaacgagtgaaagcagagcaccaaagaccagcaggtttactccaacctcttcaaatcccggaatggaaatgggaggagattggaatggactttataacaggactgccccggacatcatcgggacatgattcaatctgggtagtcgtggatcgacttaccaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaaatgggacccgtttaaatttcagcacggctatcacccgcaaactgatggtcagacagagtgagtcaatcaaatcttggaagatatgttgagagcttgcgctcttgattttggtggagcttgggacaaaagcttaccatatgcggaattctcgtataaggacaggtaccacgccagtctacaaatggcaccgtttgaagctctatacagccggaagtgccgcacacctctcttctgggatcagacaggcgaacgtcagctgttcggaacagaagtattagcggaagcagaagagaaagtcagaatcatcagggagagattgaggattgctcagtctcgacagaagagctacgcggataaccgtcgaagggagctaacttttgaggccggagattacgtgtaccttcgtgtcaccccgctccggggagtacaccgctttcagacaaaaggcaagttggcaccacgcttcgtgggaccgtacaaaattttggaacgaaggggagaagttgcctatcagctagaacttccatccactatgatcggcatccatgacgtgttccatgtgtcccaattaaagaagtgtttaagggtacctgaagaacaggctaattcggaacacattgatatccaagaggacctaacatatgtggagaagccggttcgcatacttgacactagcgaaaggagaaccagaaacaaggtcaccaggttttgccgtgttcagtggagtcatcattcagaagaggaagcaacctgggaaagggaagatgagttgaaggccgcccatccgtacctcttcaccagctccaccgaatctcggggccgagattccgtttaaggggggtaggtttgtcacaccccgaagttttcctccctagtcaaaattgtaatttataattgaccctaagaaaatgctggtgaaatcaggagaaaaccctaagaaagtaatgcaaataataatcggatttgacatgtggaatttttcttgaattctacatgtcgaaattcattaacaggatttttagtggaattttcagagctctagaaataattttaaccaattaaaaatcactaaagtacaattgttaattccagggaaaatcctttttccttttctttttctttttcctctcttttccctcctttttgtcaagtgggccgtcggcccactt

SEQ ID NO: 57556 - DNA, 1484 bp, Oryza sativa
cggttttccttttttatttttaaatcttttctcaaaaataaataaaaaaaaaggaaaatggggctggaagaatcttaaccataaaacgttcctccaaaatgggaatttatttaatagcatttgaatgttgtcagatctagaagaacgaacgaacagagcggaaggaatgaacgaattgagatgagaacaatcaatcgatcgatcgaagaaggaaaataaaagaaaaaaaatgcaaagaaattaagtaccgttgggatcgttcatccagttcctctcgggctggaaatggaatccggtgcgctgccattgcagcatcgcgttgctccacgggaacgcctccccacccgccgcgccgcccatcagcctcaccatctcctccgcccccgacgtcttctccgacacgccggactccggccccctgctcgccatctccatctccaccacccccgggacgaccatcgtcgtcgtcgcggggcgcccggcgagcctgacgccggagaggaccgccacggcgaggatcaccgcggcggaggcgaggaacagggcgacgcagagcgggcgcctccgggaacggcgggcggcggcgaggtcggcggaggcggcgtccccggcggggagcggcgagtaggagtagggaagcgccgaggcgtcggcgacgtcgtcccgggtctccatgatcgtcgcgtcgccgcgagatggatataatattagcacaagaaagaaaaagggaggagaggagaagaggagattagtttgcgtttgcgttgtgtgcgggattggcgaggggtcggaggatgtatttatagtgcctccgatccaattgctatttctatttcttgtattgctaatactagtattagagttcggatccatcactaatttatttgtttattttatttagttattattattatgtggtggattgatgctggatgcacgtggcgcgggcccattggttgtttcgcctatttggcccagttgccagcctccgttaatcgatcatcgataggctgttaatttgacgagagaagagtaggtgaatcttacgagaggagattcctcgcctatctcaccggagtcccgcgtcacacactgcatgcttcactgcccgggccacatagaaatttcatggtgttttttcttgttttgttagaaatacaagttaatgttagatgttttgtcggtatagttgtatataaacgctagctagtcatatttgtagaaatagaaatcattgttatatgtcaaatatcgtttttaattttagaatttagcgcgtaattttaaattacgcgggaaaacccgctacttcattattataaataaaaataagtacgtgctctaacttattgtgattcatagttgctaacctaattcattccgtaagtattggaaggcggaggggggatttctagcggtggctcatcgattctcccactacagtaactagcggtggatcgatcagttagagtttatggtctaag

SEQ ID NO: 57557 - DNA, 5109 bp, Oryza sativa
  unsure (1)..(5109): unsure at all n locations
catgtacgcagctaccccaccatggatggaggtgacgctgtctaagctagctagctagtttaatactgtactaattaatagtgtttgattaaacgcgcagagaaaaataagtaacgcataattaattcgagcgagtatatatagtccatatatatgcatcatagcatcgatggatctacagctgggtgacatgtgggctggctttggatgcccccaccatatatttcatcacactaccgtgacagatatacacagttcatgcatcgatcaaactcagctgtgaaatctgtataataattatactaattaatatatattaaatttcttctctgcatgctgttcatgtacacatactacctgaatgagagtttcaatgccttgccaaattataacatgcacaccattataccatggcaaatgtcaggcatgttttgatttgcatctccaacagagaatcggtcatgtgatgtatgtatatactatggcttattatatattgcagttagcaggtatgtgtatatgcagagacaagaatgcatggttaacttgtgcaactcagcaacatgcgtgtgtaatataattatataacatgcgctttgtccggatctagcttcgatatttatatatcgatcccttccaaaatcctggttcaatctattgcaatttgcaagttctaatatgctactactaatatatatatgcatgatatattgttattctttaattttattagccagctgctctggtcggcggcgctaccaaactttattggagtaacatagacagaaggccagcaaaagcacgaattggttacctatatagtggcttgcttaatgaagaggaaaaaggctagctgcttactcaacattagtagaagactaattaaaagtcaatttcataaaaccttgcacattataatctaagttacacaaacatatggcatataactctgagtattataggttgaccttcaattaatatttagacatacaccatgtatccaaatttaaaaagcagatgcaacacttatatgatagataaaaaacttataaatttaacatgtgattgtagaaaaaaaatgtatgcatggtaaatcaaagtcaaaattgttgatagtgtagtttgtaaaactttacgaccataatatatacttgcactactatataaagacgtacaagtcggcattataggtgctggaaatgatataaccggcacctatagtatttatttcctgtccacgtgttaaaaccattgtggttttgtgtaatttagactataatatatgaagttttattgaatttactcattaattaattagcagcacaaggaacacaatgctatgtataaagtcaaactctgtaaattttgatcaattagccaaactagctacaggtatatttatttagtgcataaagttataccaacagattcatctttcaaaaagctttcataaaacattggttccataaatattataaatatacttatgcacaacgaatagttaaagaatgatacctttttccaaataaacatgctctataattttctacggagggagtatcacgtttactctacgccttgcatcaaccgctcgtcacaccttgaaccaattggccggaatccttattagctactagctatgagatgttgatgagtcaggacgtactagcagtaactcaattcagtccccatcaaatttaggtactgctctagcctatcaattatttttcagtaaaaaatatgacgccataaatataactactcctttattattatcatagatatgatttccatacttctaaacggtatgttttttttaaaaaatcctcatcagttcttagctagagaactttatacgctatgaaaaagaacctttaaaatcgacctattaactttctacttcttccattttatactattggtcgttttatttttttctggtcaaactttgttaagtttgattaagtttatagatagatttagcaatatttaaagcactgattagttttatttaatctaacatgaattatgttttaatgaaatgtttgttttttcttaaaaaactattacatttttctataaactggtcaaacttaaaaaaatttaacttaagaaaaaaaatcaaaataacttatactatgaaatggagggagtaatatttgacacattcattttttttttcaaagaagcaggagatccgcaatttcattactgcattcatttaaatcctcgaaataataactatcatgaactcagttctatccctcaccaatcccttaaatcatccaaaacaattcaatcggtggccaatgcgtagatgatggatgtaagggcagaccagccacgtggagggaaggtgacacttaatggtggtgaagttttgagctcttctcccccctgaatttcgcaccacgtcacagctattggattctctcttcactctctgtctctgtcctctctctgaaagagaagaggaagaagagatggacaagagaaagaaagtgaattattgttgtcgagatgcaccaatgattccatggcccacaaataatttatcggcgttttcttaacttgcgaatcgacgatggctgccaattaagtctatcttgtgctcttctgtcgatcgcttgctgctggtccagtagtcaagcaaaccctccatttcctctttctttctttcttaatttctttttctttctctcagtctctcttgatttcgttgccttgcatggctagcttgttcttttcagcaagcaaatgaaatgatcgaaaggctacaagcaaaacacacattggtgaaattggacaaaatgtgccctgatcctgcctacatgctctcacgttagagaccgaaaacaacacaacagaaaatagtacagactaataaagggcaacgactaccatctatttccagccactatttttatatatatccattacctaagaaaaaaagaaactagtaattaatagtaattgccaacttcgtattcagctaacttgagaaagcgatggattgattgatgaccatatactccgtttcctgtatgggcagtgtataagccatggccatggatatatgatgatttatctctgcatcatatcgttgttgttatgccaagtggcactagctatatagctagcattattgatttgctgtttcgtcgtcagttagctagctagctctgagactgatagcagacagaatcctcgttcggtgatcgcatcgccatacatgtgccttcagccgactggatcgatcgatcgcagatgcgatgcagctgcagcgatcgatctctaccactagcagcagcagcgagcagatgtcatgtctgtttcattcgttaatctgcacattctggatacatcgatcaaatgtccacctgtgataacccaaaccacaggtgctgcatgctagctgctgtgctagcatggagtagattaacctgtgactttcatacacacaatcttcagacaaacatattcagaaaaggaactgtacgtattgctggctgctgatcgaatatgtatgtatcatcagtaacatagtctacaaattatatatgcgttatctcaccttacgatcgagttcattgcattggtcacaatgccagtaatgatatctatagttaccttcgcatgtataatgcctcacacggcacaaatataataagttcagttgatagaatgatttgattcatttctatgacgggggaagcggcggcttggaatgttaatttagctagcggacgtgtgatatggatatgaaatggcattaaatcaaccaagtacaataatgcaacgcgtacgattggaagagaagactactgaatgtatatattggagccatcaaaacgcatatgctatggaccacacgtacgtccacgacgatggtggagtgaaaactcgtgactgtgcttcactccacagtataattaccacaggaaacacaatgatttatacaacagccatatgtgtataagccatttttactctctttatgtaataactaactaaggacaagaaccataatgagataacgaaaagtaacatgtgaataaaacttttatgtacgtgttcttagtgatctaaaagcaaaggctgaaaaataaactttgatgaaaaaacctcaaaatcagcctcaaatttaaggttaaaaattaaaattttgtctgataagcataagcataagtgaaaagatgaggtccgtaagttgtctcttcgctaggtcannnnnnnnnnnnnnnnnnnnnnnttaattttcttttcagctaatttgtcaaattattgtcatgaattatttgcaccaagcctctgaaaagatttctactgcattatttacaccacttgttctaagctacaatttatttggtttgtttctcaaaatatttaatttaccccataatcaagtatataatccacggcaattatctgttgaatgtttattgttttattttatttatcaataaagtaatcctttgcctttctctttataaaaagtagtagtggtaaatcatcaaccagtctagtagctggccaatccaaaacaaattagctggtggcttgaaattaagagtagaccagatcaaccacgtggtggaatagttctccggcctgaaatttgtgccaagtcactagctatattatcggattatctcttacacaaccacactgcacggtctctttctccctcttttcactcggtatgaaaatgaatttgcttttgttcagatgattcagtggcccacaaacaatgcatgtgtagtatctggtgttaattgtttctgaattgatggcgatggtttccaacagattaattgggccgcacaagcaaattaattagtaaaacgtttacattttctcccttccttatttctttctttcttccaccaccttttgtattcgcaagaaaaatgaaaagctttctttcgttgcagtaatgatttggccacaaatttcaaaatcgacaaatgttgactagtaaggaatgcctgctagcctatcaacgacaaagagcgaaaacaccacaaacacaaattaaccataagttcttaaatttgtgacaaaattttagtgatgcggagttggttgttagcttcactgatgcggatt

SEQ ID NO: 57558 - DNA, 4203 bp, Oryza sativa
aataattaaaacttaatctaccatatgttaatatcatctcattttacgtaaaaaaaaacttaatcttcatctttatctttagaagaaaagaacaccacctatataagagagatgtgagaaatgacttcaatcgatatcttgtagtattgttattttatttgcagataggtaggagtaattgttgaggaagaattgataccagaaggcattcatgcctcctactacaaggcaaagcttttgccttttctttatttctttttttttaaaaaaaaggaaggcattcatgcatcatccaattgatgattgatgggggaagtggaaaatggtggctgtgattgcttccggacatttaggcaggcgggctgctgccacgtcgtcgtgagcgtgggagccacacattaattaggcgatcgattccaacgcgacacgtgtttgtgctttggtcgatgctgactaggcagattggtaggcaagccatccgatacgacaccttaaggcaatgattatatttgtaaagtgagccatatatattgtggaaagtagcattagcttagggtacaccttatgcttaagttctaccacaaacaaaaagaaaatattttttctctctcattcacttcatgaacaagagatgaaacaattatttttccattctaagtgggccatcttgtggctaaattttaaccatagcattgtgggtatggctataataatgactcactatttatagggcccaccttaaggttacattacaccacaaacattgaggatgccctaattgacgtgcgctataaacttccaatgtaatcaacccatcttgtcgtcgcccgtaatacacactatattatacttctttttgttactatttcaagatataatcctttttaagatgcagccacaccggtttttatataaaaaagagtttgaaaccgagtttttataagatttgtttgtatctgtatcattatattttcatgaaagaaaccaggctggaaataaaacgaaacatggtacatataagcatggtagaaatgcacgcgtaaacacaaagacttaccggaatttgtcatgtgaatgaagattggagggaaaagcagagaaatatatatggactagtgttaggcagttaggctaacagtacattgaattggatcagtttgataatccgtacgtgcatcttgaggccaatagctagacaggagaacatggatgcatggtgcttcgccgtaggagaacatgcgctcaatctgccataggccctgtttagttcatgaaataaaatttttttattatcatatcggatgtttaaccagatattggaaagagttttcgaacacaaatgaaaaaactaattttataacttgtctggaaaccgcgagatgaatgttttgagcctaattaagccgtcattagcacatgtgggttactgtagcactttatgactaatcatggactaattagctaggcttaaaagattcgtctcacgatttctatgcaaactgtgcaattagtttttatttttatctatatttaatgctccatatatgtgtccaaagatttgatacgatgtttttgtgaacaaaattttgggaactaaaccaagcctatttcgttcagttttgttacgggtcactctgttcagttaattttccagtactacatgcatacatgtaatcatgtagtaatcactatcactgctcctatatatatgtatgtagaaacgtgttttcctatattggagttattagtgcatatagtatatattagagcatccccagcagatactccatctagtcctctatccacaaaatagaggttgggagaagaaaaatgagctccagcagatactccatcctagcatccaaatttagctatcctccatccggggagagagaaacgtcaaatttgaagtttctctctcctcacaccatcctaaccgccagcgtcgcccgcccccatccggagtccggattgacctcccctccgccgcgacctccccaatgtcgtcgtcgtcgccgtccggatgtgcatttttcactatggagtgagggtggagagggagagacataccagatctagaaggagaacccacgccggccgttgcgtcgccgtgcctctacacgccggccgtcacgccgccgcgcctctgcgcccgtcggctgccgcgcctccgagcccgtagcgccgctgcgccgcagcccccgtcggccgccgcggcccgtcgcgccgcagcgcccccgctcccgtcgcgctgccgcggccgccagcctccgcctccacgctggggagaaaaggagagaagaagaagaggaatagaagaggagagaagaagaggaatcggaaagaggaaagaaaacgagtagagaggaggagaaaaaaaaggtccggaccattaaaaatatattcattaaaataaactcatttaaattatcaggataaataacacggttaaaatttaaaatttagttgtttaaaatatagtctttaaaaaataatacaaatgtatggttagttgaaaaatattagtaaaatatagaagggtgtgatatgaaagatgcaatatagatgatctgttggagtgagaagaaatatgaatgaggaatctttttagatggtcatccatatgagcatatggaggatcaaatttgaatgagctgctgggatgctcttagcagacatccatgttactagctagtatgtatagtagcagttgatgttgtgacttgtgacagcaattcgatgcatataaagctgatgagatgaaggtaaagtgctggcatatggcatgggtgctgacagttacatatacgcgcctaactaacggacgtcgtgttgcaataatgcaaacttcggtctcgacgtggcatcaaaaaacacgattcattcattctattaactggagtagtagcctgccaattagtcatttaattaatatgaatgtgattatgatgagcgatatatcagctggctcatgggtcgccgattgcagctagacatcacatctcatcagcccctcatcttctccaaactcgtggctatatgttaccttcagacctgttgaaaattttgctgcattattcaaaacacacgtggattagtataataataataataatgttaaagagtgagattcacgcgtgcatcttggcaggtagaacgtatacgatttattccacccattccaatggtcgcttctcaaattaaataaggatgtcctcttgtgtgatgaaagcgtcgtcgttgctttttactccacgtggatggttcgttcttttttttttcttcaagaaattgtggcctctcgcatgacaagaagcaaccctagccagtagaccaacagtgaatgccgccaatagatcgagctaggcaattcagaactagtagcattattgagctagctaagctgctggatcttctggttcatgaacattattgcaaaacagcactgccattgatagagctagaatagcaatacagcacatcagcaatctatcctcatcacatgttgagtttgaggctgatctgaagttggcgccatatattgtactgtatttgtagatgccatgtcagctagccatggtggggtgggggccaaaagtgacactgtaggccccaaggaaataattctatctggtggctgtgctcagccccaccactcatggagatccggaatctcctcctctcatctaacctcatcccatcacaagctcactctctcatggtcatggtcatggagtttagctagctagcacactgatttgagctagtagcagctttgagttcttggcatagcctaatgattggcacatgctgttgccaggtgccagctagtagcccaaatggactaatcaatttcttaattagctcgagcaaactgattgtcactagcttgatgaagcagctgagggcaaggaagttaagttgagtgtctgtccgagtcatcggagagagagagtcgagatgctgttggatgtttctgtttgacacttgttgtgcattgtcagcagcttagctatgagtgtgtatctccaataattctgtttctttaagtatcggatatacagattctccgagaaatggttcccaaataattgatcccaataatgcaattgtttaaagaacgatcgatcgatacctgtgtgcccggtcgatcgatcttaagtgtaagataactgtcgaaactagatttcggcaataataaaa

SEQ ID NO: 57559 - DNA, 5487 bp, Oryza sativa
gccaaggcctgccgagtagcgaaaacgaagactgtaaagggcgaaaagataaagaatatggtgcatcgaatagatgcacctaattaggtatagcctccaactatgtgattagttaacaaactaaacatatagttgagaacaaaataatagcataattatgcatcatatgacaaaagcatacacggcgcctaaagaggcattccagccgactgctttttagccataataaaagaaatccaagtggttaacactctaaaaagttcacgaatgaacacacttgacaggcatccgaatataagactctaaagattacccaccaaatattataaaaatcatggtaatgaataagtctaatagcctaggctatgactatttaccacaatgaaaacaggcatataacataccgaggaaatgactatgataaaaacaagtcattccaagttaacccagacagcttttgtagcctaaaaaaacgtacaaaaacagcataacgcctttctgtcgggcaccttttaatttgcattgcaataattccaaagaattatatgaccgcgtaaaaaggatttaatcagcattgggcaacactattgtgtacataaattgccaaagcaaaaaatgcataagtccataagataacacaatgggccacgactgttaaaatgtattgggactgagaatactatctcaggacctagcgcccatcaagcacctcctatacaccttaacaagaaaacccgagatccaagcgacatctttgtcttccccgccggaactctcgccattttccccactccttgctacagtacagagctacgccggcaaaatagggttcaccattccactcaaatccaccttcaaaaagtgatcaaaatccttcccgtgatccaccgcctcaattcctcatctctcccaagccatccctcgaatcaaatcaacgtattcggggaaaatcaatggcggaagagaaagaaagcttcgaaggccaatgggcgccgtccgacgtgacggaggagaacctgaaggagatggtggcgcacggcgttctccctgccaaggagatcatcgggtggcggccagcgtgcgatgaggcttttccgacccccgatacacacgaggccgtggtcttctctcatttcttttatggtggatttgctcttccaacctcaaagttcttccgtgggatactgaatttctatggaatcagcttacatcatttgaatccgaactccatagtccatattgcaaatttcgtccatgtctgtgaagcttttttgggcattagacctcattttgctctgttccgccgaatctttttccttaagcctcaaccaaacaaaaacaaaccatgcgtagttggtggggctggatttcaactgaggggcactctgagccagaagtatttctctatgcctttcaagacttcaaacaaaggatggcacgccaactggttttatattcaaaatcccgagcccgctcttcctgagtactcctgtcttcccccagtataccaagatacctggaactctcttcccatgggagatgaagctgcccaagccttagaactgatggaacgcatgctgaagctcaaagagcaaggcttacagggagagcaaatcactcggcatttcattaagtgtcgattagctccaatcaaagagagatcccgcacagcattcgagtttgacggcaagcatgatccaaaccgtgaagacccagactctctggactttaaaatcatgaaggagagaatgtataaaatcttctcaaatgctattgtcgtcagctactcacatcagctgccagttgtaccatataatgcattcaatccgcctccacaggtatgtatctgaaaccttcaactcatgaccaaaacataattttatcttcatgttgagtgagctaaccgtggaagcatctcattcaggagtacgtattgatgaaatctgatcccccaattgctcaacgccgatctcctcgccagcacaccgttcagggaagtggagggccgacaatcaggtcagacccgcaacctcaaacctccaaaccggctgggcagacaggttctcgcaagagaaagctggtgcttaatgacgacgaaggcgatgacagcaacaaatctggggacaagggcacgcccaataaactcccaaagcataccatgcccaggaaaaaactggctggccgtcaaatgccaaagattagaacatcttccaggtataaacttctcggtaccattttatttcggcatgcttctctcatagaaattacgctgaataccgaaaggacactttgcaggaaaccgtccgatatagatccaactggaaaaaatcctgatccggctgccacagagtcaaatttatccaaagatgctgatccgaccgccgaaaaccagccgactgccgaaagccagccgactgccgaaagtcagccgactggcgcccatgcttcggatgacaaggccaatccgagtgaccagccgccgactggaaaccagtcggcagctactgaaactgcaacaacccaagagcccccgactggaaaccagtcggatgtaggtctaaatcaagagattcctgaagctgaagcgcaggcgacaacttctcaaggaccagaggctggtaatgactcagtgattgggtctccggataaagagcagggatcacctcacgctcagctaggcacatcctcaggtaactcatcttctcaagtgatgccgttctgaataactccagcttactcgtctaatgtcttggaaatacatcaggtccactaggcggcgacgaagaagaaattctccgcataaaggcagctgatgactctcgtcctcctatcttactcaaatggtgggacgagaactctcaagtttccggcattgtcataaatcgccaaaaagaagatgaggaagtgtgccagctgaagaaagtacttggagaagctactcgcattgtgaatgtaagtcttctaggtgactgcctttaatgactttgttttctcgttagcaaaactaatccatgaaccaccgtgcagagaatccatcttcgcaatgaggccaagaccacaaccttagaaaagctggttcctcatttgggaactcttgaagccgttaggagccagctacacgaggccaaggagcatgccaagaaaacggagaaggaattaagggaacgaattgctcagctccaggattcaaactacgagctgagtggttcatcaaaaggtaatctctagatctgtcccatttatgctgtcataactggatcctcaaacatttggatttcaaacagcgcaagccaccaggatggctcaaatggagaagcaaattgaagccttgagaaaagacaaaacagaactagctgctgaaagggactcggccttgaaggaggttgaaggtactgccagctgacaatctgaactttcctctttttaatgcagcagattcttattataaatgtgttttgtagaccgtaaaatcaaatctcaagctcagtttgacgtcctggttggtaagatccagaggcttgaaggagcaagagatgaagttgccaatgtcgctacaccacttgtccaagctatgttccttaataacagtggtccgagtgcacttgacgcaaccgaaatctttgacaagctgagagttgcaccggatgtatatttcaagaacatcaagaaagctggaagtatgggagctagcatggcattggcgatgaccaaatccttgtacccgagaattgaaatcgacaccattgatggatttgcagacgggacaagcgaagaggctgctcttgatcttatcaacaatgctcaaaatgcggctgacaagattgcaagtgacgttgtagagcaattccacaacaacgaccttcagccgagcaacaataactctgatgatgaaaggactgactctgactgagtatgaatgtaacaaatggaggctcaatttgtacaatactggtgtatttatgctgtgcttgatagttccagccaaatctttgatttcttaaaagcttttatcaagctttgttgagcctaaaacccaaagaagctattaaaaactttcagtcctcgcagactaagtagaaaaatcgaacaaggcaatgataaaccaagtaagcaaattgaattgataaaaaatcacactccattattatgataatagcccccgactgacaacttcaagaagaaaacttgatgttgacagtcaagatagggaagtacaatgataaacttaagcgtagaaacgacgaagatgttcaatgttccaagagttgtcgacgagagtaccatcttctcgcttgagtcgataggaacctggccgggtgacttcagagatgataaatggcccctcccataaaggagataacttgtgccgatcccgtgtagtttgaattttcctcaaaaccaggtcgccgactaaaaaggcacgggatcgaacattgcgattatgataacgccgcaacccttgtaagtatcgagccgaccgaatcaaagctgcttcacggacttcttccaaccggtgcaagtcatccactctgtcctcttcgtagcgttcttcacggaaatttcgaaagcgcaaagattcgaattcaacttcactcggcaacattgcttctgccccatagacaaggaaaaaaggtgactggcctgtggccctactgggtgtagttcgcaaagaccaaagcaccgatggcagctgttgcacccatttgccggcatagggttttagccggtcaaagacacgcgttttaatcccttgaagtatcatgccattggctcgctccacctgtccattgctcatggggtgtgccactgaggcatagcaaatcttaattccaaagtcctcacaaaagtctttaaaaactccgccagtgacttgtgtgccattatcagtgataatccgattgggcactccaaatctatgcacaatattgatgaagaagtctcgagcattatctgctgtgattgtgacaaccggtttagcttcaatccacttggaaaatttatcaatggccacaaagagatgcgtgtaaccaccgactgcctttttaaacggaccaaccatgtcgagcccccaaaccgcaaacggccaagacagcgggatagtttgcaactcttgagctggtaaatgaatttgtctggcaaaaaattggcaaccttcgcacgtgcgcacaattttgtcggcgtcggacactgcagtaggccagaaaaaaccctgccggtaagctttgccgacaatggtgcgtgcagcagcgtgatttccgcatatcccagaatgtatgtctttcagcaattgtctcccttcctctaaagatacgcagcgttgcagaattcctgaagggcttttcttgtataactcagcttcatgcataacataaagtttgctccgccttgaaacccgctcggcttcatctttgtcttaagggagttcttgagaagtcaaaaatcgtatgaggggatctcgccagtcggcttcaatcatagctacgtcat

SEQ ID NO: 57560 - DNA, 2851 bp, Oryza sativa
  unsure (1)..(2851): unsure at all n locations
ttttggagtcggttaggacctcgctgacaaaataaatcggtcgctggactttctggacatggccttctttctcacgctcaacgaccaagacagtgctcacaacctgggaggtgccagatacatacagcaacaacggctcctgcgggtgtggtgaggctaggaccggtggctcggtgaggagtttcttgaaatcttcgaaggccttctgtgcttcaggtccccactggaaatcatctgttttctttagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcctctatgagacaccataaaaccaagcagcttccctgacggtactccgaaggtgcacttttcagggtttaatttcatcctgaaagcacggatgctcgcgaaggtttcttccagatccgagatcaaatcatccttttgcttggtcttgacgactacatcatccacataggcttcaacgttgcggccaatctgcgttgagaagcatctctggatcatacgttgataagttgctcctgcgtttttgagtccaaatggcatggtgacgtagcagtatgccccgaagggcgtgatgaatgaagtcttcaagcagtcggattccttcagtcggatctggtgataccccgagtagcaatccaaaaaactgagaagctcacagccggcggtcgagtcaactacctggtcaatgcgaggcaacccanaaggatctttagggcaggatttgttgaggtcagtgtaatcaacacacatgcgccattgccctgttttcttccgaactagaactgggtttgccagccagtcgggatgaaggacttctttaatgaagcctgctgctaacagcttggttaattcctccttgatcgcgtccttcctgtcttgtgcgaatcggcggagtcgttgtttgataggcttggcgtcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactttttgaagtcttggtagcgggcacttctccttcgtccgccgtggctgcagccagtcggatatcctctcgagcagacgctatctcgcgggtttgggccatgtcgcaactctccttgtcgcatgtgacggcttgcttgatgtcactccgtagggataagactcctcggggaccaggcatcttcatcatcatgtaagtgtagtgcgggacggccatgaacttggctaatgccgggcgtccgagtatggcatggtatgctgtctcgaaatcggcgacttcgaagctgatattctctgtgcgaaagttttcccgagtgccaaaagtgaccgggagggtgatctggccgagtggagttgcggataatcctggaattacgccgtgaaaaggcgcattgcttggttttaactcggagcgaggaatctgcatatcatccaaggtcttggcgaaaaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccgtttagactcataagccagggggccgccgaagatatggttgagctccttgcggtggtcttgaaaacctgccggggtgtcgccgtcgtccttcttcctcgacgtgctttgttcttcgtcggagttcttccgtgtagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttctgcaggcttacgcttgcggtccttatgattgttacttccacctcctcccgaagccggcgtatccttttttggcttccaactgggacccgactgctttgacgcggtgacggcgtcttcagctttggcgtactcgttggctttttcaaacatgagcttgactgtcctgggaggcttacgcccgaatttgccaaccaattcttcgtggcgaatccctttggtgaatgcggcgatgatgacgtcgtcggtgatgtcggagatcttgttacgctgttcagaaaatcgccggatgtaatctcgaagggattctccggacttctgaatgacgttgtagaggtcgtattgtgtgccgggacgctcgaaggtgccttgaaagttggcgatgaagtggtcacgtaactcggcccaagatccgattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccatcgtacttctctattccagtcggcttgaagccggctggccagtccactcgacgcaggtcgtcggtgaaggctgctactccgtcaaggtcatcgtc

SEQ ID NO: 57561 - DNA, 2880 bp, Oryza sativa
gtaaccgttcttgttcttgtgcttgatgctcctcttccaagtcggcggcgttcagtctcgcgacgcgcttcggtctcccgggcttggcgttgctcctccgtctcgttattggccatgaagacgccaaaatagagaggggtgtagttgtcatctaggcttccgtcgaagtcgtcgagatccgggtcgtggtagcgagagcaaactcgtcgtactccacgatgtcggtggggcgcgagtcgacggtaggagagctgtagtcgccatctagctgatccgtcgaaaccgtgccgagtggttggaggatgacgccaacttccctgaagctaggcgaaatcggtgttgaagccgacttccgtaggcctacgggaaagagacgctgtcgtgatggagacggccgccaaatcgtcggggagcttcatcaggatcggtgggtaagccccatcatcttgatctggtgacgttggtgaagatgccatctcgcccgagtggtttgaagccgactcggtcgagatggtcttgaagtaactttcagccgcgtttgggagtccaaacggggccgaaatctggttctctcccgactggtccgactccgagtcaaggagagagatcttgccgaagttgttggtgacgaagtcgaggctgccgaaccgaaacgtctgcccgggtgggaagacgaggtcgtcgatgccggagatggaacccattgcactgatcggcgaaaagcttgacgcaacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttggggaaaaacaacatatgcccctagaggcacccggaccccccttatatatggggaggagtccgtgttacaaaagacaatctatatccctaacggaatatgcagatacatataaaatacagtcgtgaccgactaagtctcagggtatttccttgatgcacaagttgagaaacaaacccaagatacccataagatattctatctatattgggtatcctatattcagcccaaatatcatcgccgtgtagatatgggatatccataatctccacaataacataacatgcaatgattgcagaaaacaacaaggaacaccaacgtctcgattttcagggcacatgcagtcgtgttgtgacctggagggcaagaaatcgaccaagaacaatgtctttcggctcaatatccttcaacgcaacccctactgccagtctgtagttgctcaaaatcagctccagaaattgcactgaattttgagctgacaagagtgttgccccagctgttaagagggccaccaggaaattttgggctgtggccacattagtcgctgcagatcagctttagaaacagagctgctagcttgcagagatggaatagccctggccctccaatggactctgctgcccatcgtcgttgaatccgattgccaagaagcaatccagctgatcaagtcagtgaataaggtattgtctgctgatgcgtgcgtagtcaacgaggtgattgaacttatttttcgcaaaaagaccagccccggtactgtaggactgtagcaaaaatccgacgtggcacgtcccagcgtccgccccttcttccccccttaatcttccccgatggctggaacaagggtgattgcacttaataaagtgcacaggactcagaatagcattaatcatttcttagcaaataaaggccgaagtgaatccttaacttacttctggccggatgactcttgtattgctatctcacatttgctttgtgagaactcctattctgagtaatatatccttgtttccccgcaaaaaaaaaaagttataacaaaacctatacggacctacctagttgaaccgcctgaatcaaaggtgaaccaactgttgtaaataactagagatatgcaggttgcaatgtcattttcagatggcatgaaaaacgactttgttatacaagtcaaagtgtgagtttgttatactcacaactcacgacggcatgtagctcctttcaaaaattaaaatcaaaagtgtgatgtatttgtagaagagacaacaactactttggagagttgagagatttcagtttctgctctctttggctgaggtctgggcctttgtgctgctctgtaaaattcaggcttgtaatcttatcttaaggaaaaagtacaccgaaagaacaagctgcaaccctgcacttcggcccatgctcttaattgtgttacatgggcccatttattggataaaatctgtcacttcacctaagctgcaagaatacagcccacgatgcatcacagccatgtaagagtctaatgggccgagaagcaaatgatccaagcaacccgggaccaaactaggcccgatctaactacttgggccatgaattcagccatgagggtcttaaaacgggccgtaatttctggaataaatcgtggaagcccatgaggggagcgggagggcaaactcgtaaatccggtgaactaaaaccctacaccaactagtatatatagcctctccaaccctcgctctcccactcttgtcatctcggcggcggcgcggcgcggagcagaggaggacgaagcagcaggcggcggcggcagagcacggcgacctagcccgacctcgcaaccatggtgagccccctaccccctctcctccgtcctatgcttctcccccccgcgcgctctctcgcgtctgcggatctggctgatctgtggcatccttctcgttcgtagcttcggtgggattagttccattc

SEQ ID NO: 57562 - DNA, 9626 bp, Oryza sativa
aagctttgcaaggttcggtctgtgcagtttggccagaagggaatcccctacctgaacacctatgatggtcgcaccatccgctaccctgacccgatcatcaaggcaaacgacacaatcaagatcgatctggagaccaacaagattgtcgacttcatcaagtttgatgttggcaatgttgtcatggtgactggaggaaggaacacaggccgtgttggtgtgatcaagaacagggagaagcataaaggcagcttcgagaccatccacgttgaggatgccctgggccaccaattcgccacccgtctgggcaatgtgttcaccattggcaagggcaacaagccttgggtgagcctgcccaagggcaagggcatcaagctcagcatcatcgaggagcaaaggaagcgggatgctgccgcccaggctgctgccaacgcttaaaatctgctgctgcgtctgcctggagttttgctatagcgagttgtttgcaaggatatagaactatctgccccagactatccttttttgagctcttttgcctaatgttatgttgatcaattcgcgaactcatgtttgctgctagctgtaatgcgactgtttaccttatttaaggcgccttttaagaacctccaaaccaaattgtctttgcctgttgctgagatggtatggttttgagcattcagcctatggcctttttgttcatagtcgcgttgcttctgttctgtttgcccgttgcatcattgttctgttagtctctattcgaagctcgtatactcgagcttaattactgggtgtcagttgttcgccattgaggatggatggagtagcatgctgtttgtctccgtgaagtcatggtaccatctctagcgattctgcatcgtgtctaggggtgcaagtggggcgggctttttttgcggcccgcagtcccgcccccacaaaaatgcccgcgaattgcaaaattttttggcccattagggcacgattgcactagacggggagacgtcgctgggcagcgagacggcaacgcagccgccgctactctcgtcaccgacgccgacttactcgtcgcccatccatccagcagcgaacgccgtccatcgctgcgatgctgcccatgctgccgcctccagctctaagggctccatcggcgtgggagcaggcaactacttcgagctccattggcagatctgccatggaagagagttgcagttccaattggccggccacaccttgtgcagcagcgacgacggccggtcagttctttttcctccttcttcttcggttcgtgttcaagatttgtttgatgtgccactctactcctgcgatttgtttgatgtgtgcaatcaaatatgctgtgtattgaccgatcaatttatacttcagcgcagggaatcgaatttaaaccatactacgaagagtgagattgagaattttctaatcatgatattacacaaagttgagcaatgtcgatctgtgttaggattgtagctgtttgatgtagttttcaagaaagattgtagctgtttgatgttgttaatcacttgacatgtcatttagcaatattagtgcttgtggctctgctgaatctatgagttctcttgcatgttcttgagctagtagctttcaatctgtttcctattcactgctctcttgttttttttttgtttttgcaattttgtattttcttccctctcttggtaggtttccctctcttgttcctagtttgatttgggacagggagtactcatgtgcttgtgtaaatattttcacgtgaaataatccagtcttgttgctggttgacgaacctaattaaacgaatgtctgcacattgcgggctgtcctacgacgcccgtcgggctgaacctaattaatcgtgcccaatccatcgtgctgtagtagtagtttctatttgaatatttgtttttttaagtcgttaaggactctgctgtagcagtagtttctatttgagactcataaaattgttttttattactaataatccgttttgacatatagtaaagtccagctccaatcgaataaaaaacgagttggagaggaaaccagaaacagaactctcatactagaagagctatatagataggtaggagagtctgagatccaagggccaaggggggagagagagttatcgtcgtcctgaatgccatctgccatgtcctccgtggccgtgcaacgcgagcagcggtggcaaaacctagccctagccccagccctgcccatgagtaagcctcaactccctttgcctcccagccctgtctctggttcgtctcacctggatcagttcttgttcgctaatcggttcatgttgactaatgttagatggataccgaattataatttgcacaacattcaactcgttgctgctttgctaggttaggtcaccgattcagctccttttaaccccataatatctgcatttattcgttgaaaaattcttgatctttttatcccaataaaccattggtcggtagccccctacgttgtttgtctctctctctctctctaatgtgttcttgtcagtctgatgggctattataattataatcgcgctggttcacctgcagataaatcgaattgtacagtgggtagcactaataactccccctctgaacaagttggccatggcgattcactgatttattcactcccgtaccttcctgaggtatgctaacagcactgtaaaattctgacgcaagcttagattgtaagctttaactgctttaatcatcctaattcaccccactgcgctagttgattattatttatagtcacaaaatatatatgcaatcgaacattgtcctaaactcctagtgaattattatttatggtcattgttcaaaggctggcaatatcttcattgcgttcttattatccgtatgcattccattcttttctcactagtcctccaggccagagcctgagcatatctactgataatgagacatgactgttgattctttcatggtactcctgataaaaatatatagtataatcatacaccctaggatctctcacttgtgggctgtctatttgactgatgttactagcctttgcagatgaaccattattgtagcagctgtgtctaagtctttcaggaagcagtaatataatataacgcttgttcttaaacatattgaaacggctttcatcttttcccatcagtatgtctttaaacacatctttaaccacagaatatgtcaaaatattgtcagctacctctgtatcgctgcacttaccatacatttaggactatttctagctctcttagaaggcccagcctaataagatgcgtagttgctttgttttttttttttttaatgttgggcaatggccataaggcgtggcatgcatcagtagttgcattttcctcttaagtccaacaactgtaacatgtgctccctcctgatataagcaattgggagccatgcctaagtatgaatgatttcattataagtttgagcaggcctaatcatgtcaatcatgcatattcatttaagacgaatatgaaaaatatccagttttgattacttacataggcatatgatgctttactgcagtgatgatactgaaatgttgctgtatccaagttcttacaagcattaattgacatattcagtctataaaaatagtgatccctatttcttttggcttcactattcatgctaggcattgatgtttttattttgctacctaaatccatacgaaatgacaggttgaactgctttcatgatgtccttttatatggttttttcaatatgttatatttttcattgcatttagcaaggtttatgtctatcttacaataaacatgtcaagacttctagtttcacgagattctgcttacaccctgtgctgaagttacaaattatgtttctttgctatactgatctatttataatatgctatgcacaataaactaatcatcgatgtgcattttggttgaacaaatgcacataaacttatatcatggactacaatcaattgcaccatcctgcaccttgtgcaatcatatagagagcaacctggggcagagatactccatgtggttctcctgttctttttttttctcttgttgtaattccatttggccttaatttgagattttatcccatgcttatggatgcaggacatctggcgtcacatacattccttaatgccgatgagtgctgctgctcgtgctgcttgcctttctcattcctttctgaattcctggagatttcatcccaacctcagcttgaatttcaaaacactttgcccgaggacatctaggggaaatttcaagtgcaaaattgacagcattctgagaaaccacttgggcactgcgaagatattgaagcttaatgtagctgatgaggacagtacatatccttacattgatagatggcttgaggttgctgttacaccagggattgaagagctcactcttacgctacataaaaagtacatctttgcatgctcacttttatctgatggtgttcgagactcaattcgatgtcttcagcttaccttctgtgccttccatcccatggctgaacttggccccttgagaagcctaacaaaactgcatctgtgtggtgtgcatattacaggtgacgagttagagtcccttcttttgaactcccttgttttggagcagttgagacttaatgtatgcaacagataagtttcctgaagataccgtgtgtgctgcagcatctcagctgcctgagtgttatggcatgccgcaggatgcaagtgattgtgtgtgaagctccgaatttgtccagtatttcccttagtggagggatcaagttctcacttggagaaacactgacaatgaaggtcttgtccatgatccgaccgaatgtcgtgtgctatgctcgtgctcagcttccatccattatgccaaatcttgagagtatggtattaagttcagactctgaggtatgttctaagattttatgtgctgcatagtagctatagatgacagtagaaataatctgcacgtgacaatgtatttcttgtgcaggcagtcaatataccaatgctgcctaccaaattcctctgcctcaagcacctgaccattcagattgcgcgagggaccttttccccatcctatgattatttctttctggtttctttccttcacgcgtctccttccttggagactttatacttggatgtaagggccaccctgttcaacatcctgcatatatatatctgctgggccattgattcatattctttaattgttcacctccaggtttttcaggaagatatgaggcatgaatcgattgttgaagattcttccgcacatttgaggcagctgcccgagctcagccatgaatgcctgaagagtgtggagatcatagggttcaactccgcgaagagcttggttgagctaacatgttgcattgtcaaagccgctgcctcacttgagcgtcttgtgttggacacacttagaggtggtgataggtgttctggggaaagtaatgggaagatttgctggcctgttagcaacgctgtgctcaaggaatccgcaagagctgccattgctgtacgaaggtacatcgaggataaagttgcacctacaacaactctgactcttgtggggacttgcacacgctgtcattcccttgcctttggatgatccctatgctgctggaaggtggaagatgtcataacttatcttagttgtgatatgtatttcaataaatgatagtatatgttagtcataagatctttgtagtttcatctttaactatcccttattattttcttaagactatgcgataagctatctgaaatgcacaatgttgtcgctttaatcaaattatagataaaccatgctttgtttcttggataatttggacctgttcgtttgctgagggattgataactgagttttcagtttaagtttccagctcccagttgggagtcatgtcgtcgttggtgcgttcttaaatcgcaagtgggaactgcttttactatatactccgtatgtcatggttgcagtgcaatgttttcttgcttagttttatgtgcataaaatttatatagggccaagacgcatcttcatatatacatttgagagctacttcctccgtcctaaaatagaaaggcttttgattgtatgagatatatcataatattatgattttgattggatgatatatatcctaatattatgattctacacaggaacttagaatgtgtctcattcaactaaaatctcttacattttaggatggacgttagaatgtgtcttattcaactaaaatctcttacattttagaacggatggagtagcaatgagcttagcttcttgatccaagctcaagctcggctaggcttttgacagacactagtagaacaatattcttcgacttttacactgatagaacaatatgaataaatgaatttgttggtcgaatataccaataaattgttcccttgtcgaatataccaatgaactcaaattctctggtctttcagggaagcctgctcgtagcccttgtttaacgtcagagcagagcagagcagcatgctatgataaggccaacacaaaaaatctgaagatacatgttgtagccacactgcccatagtggtactagttgccatggcccaagtaacctcaatggtaaaaggccctgcgcccctgcctatccctccttgagacgtctgaaatttcagtcaagcatcatcataaattcgacaatggtgtaaaattgcagcaaggagtagtacttactcctactacgtattcaacacacaggtccatcatcattcaacaaatcacatgaaaccagatcaggacagcacaccagcaaaagttgtgatctggaccctgacaaatgcaacatgatcacccgtacattctcttcaaatgcaactgaaccctgacaaaactccatgcaaatgcaacatgttaaaatttaagtactactactccacaagtgattcaacagcacaaccaaccatccatctaagtacagtaaataggagtaacttctaagctgtaccccagaaatcatgcagccaacaagatcacacttatattatgctcacaaaagataaactgacacaaactcatacagtagatggcacaaactcataaaacaatccaaccatattatatggaaccaccaaggtatactagaatgggtcttgttaagcatgaaaacttgatatttccttaaccaaaacagagtggccaaattaagtgacagtcagaaattcaggacaatgagcgaaactctctcttcgggaagctttggagcgactatccaaagaggagatactctccatgtccatggcgataaatggcctacgacacagcctcctccctactactacctccctcttgcaagtattgtgcacagcatcaacaacatttccgtatccttcgattgtgtcagcatcaactagtatttgaaaactttgacttaaccaagggaacggattttaatcccatatcgaccaagagcaagagccttgaagcagattgagcatcaggtccaggtgtgtttgtcttgttgcctccagccgcacagagcataatgagacaaattccagaaaacagtcacccaagatctgtccatttgtcctatactccacgcaagaacaatgtctgcatacaaaccttgcaacacagtgcaacatcttgagaaacaagcatagctgcatatggggatgactcatcacaatcagctttgatcttcatgccacctcccacctgcaataattcagaggatgatcaatttcagctagagaaccaaccaaaataatctagaagtacacagtaatgccatcctgacaagtcagtgaataggtggttagactggagactgcaggaattagtactagtagctggccaaaacagtagttaaaatgaatgtgtcatttgaaggatgcgaagatatgagcaactccaaacatgcacgtagtatagtactctccttcacggtcagtgggtcgaagagtatcattccccaccttgggctccctggacttcctcttgagtattttactatagctattaagtgaggaaaaactgactatagctactactccctccgtcccaaaaaaaacccaatcctaggtttgaacctggaacccaatcctaggtttgaacctggagttcaaacccaggattgggttttttttgggacggagagagtacacaacaattacaagttgtgtcaaaatcaatttcatgccaaaacatcccatgcaactgcccagtaggaaaactgaacacgttaccaatccacatcccaaccagcaaaatgtaagaaatgttcctgctcctcatcaagtaaacacaaataaaccttcctacatcatcgatcgagagcgtgctaaacatgaaaccgtgaatcaaaaggcacatctatcatgtgtttagagctctcttcaaacagcagaagtaattgtcaccttttcatcctcattataatcaaaacatacggcaatcaagacatactagtggtgaaacttgtatatgagcaaaacaaattgttctcaacgtacagcaaggcaatatgttagttcaaactcaacagaattccaaaaataggtaacccaagatatgtccgtttgtcctacgcaagaacaatgcctgcatacaaatcttgaaacaacagtacaacatagtattgagaagcaagaatagcagcatacggggatggttcgtcacaatcagatttgatattcatgccacctcccacctgcaatgattcagaggatgatcaattttactatagtaactgcagctagagaaccatctgacataatctacacagtaatgcaaccaagtgtttcccttccagacaagcaagcaaatgaagtaggtggttagactgaagactgcaggatatgtattaactagcagaaacaatactaaagtccacaacccaaacagcaatctcattaagtaaaacacagagaaaaacttgctaaatactagtatgaaactgtgaatcaggagggaggcaaacagcagaagtaattgtcacctttctcattctcattataatctggcacaaggcaatcaaaacatattccacttactaggtgttgtggcacatggcagatcgggttgccggggaaggacttggaactgcatctctaccgctccaaagcccctgccaggaagagggcgggggacgcctacatcggaggaacgagcaaaaaaccggaggaaatcagaatcgatgtgtgcgagaaaaaaaaccatcaaggtaggagaaaggatttactaccacaagctagcagagagcacggtggccagcagactaatcctgcaagaaactgaaacacaatcgaccggacgattctatacacagacagaaacatctaaaaatttgggtgaaaagacgcgaaccagatctgtgtacacaaaccggacagaacagaagctaggggaaaagaagattcagaagacggacgatttgccaccacaggattcagaaaaaacaatttcacagcaagattcaaaaacaacttcacaagaagattcagaagagagatgacttgccaccaacgaactgaaaccaagcaggcaacacgattgagaacaaattcaaaccaacttatggtggttccatatatttcacacttgtctatactgtgg

SEQ ID NO: 57563 - DNA, 1279 bp, Oryza sativa
catcgacaccgagctggatcgccattaactcgtcgatgacagcagcgtcgcctgcctggatgtcggagatgatgacgacgcggcgggggcccggggcgacgccgacctcgcgcacgacttcggcgagaccgctcagctggagagccatttctctctctctcgatcgaattgggggcgattgattccctacttgtgccgggtatttatactagaaattgggctgaatattttgaaccggggagcgggaaatctgaaaatgaatttgagacagcgaacgaatccgtggcgcagcaacagttcagattgctcggatcaacgcgcgatccgtggctcaacaatccaacggtcgttgtgcgatgggactgggaggaggcgctatccgtgtcgaagactctggaagtccggaagtttctggaagagtggatgcatgggcctcgtgggctggtagtatatggggccgaagtaagggagcaggccgggtagaatccacgccagcccgccccggatttcaagaaatggtataagttcatctgagatcccttaattttacaacgaatcggattttcgccctttaaaccttagtaaaaaaagccggaccgatggatgacccggacgaactctcgtttcagcggtccacttgtccgaccggtgagccgggcggtccaaccgccattcacaatctacatgtatactacatactccctcctgtccacatgcagttggtgcactagttgtgattttttttttaatttttaattttatttattgaaatatttacaaaagtgttgacagaaaacacgtggcccgggagatctgcttaactccagtgcaggtccaaagctcaccttcaggtgtgttagcgtgccagttgatttgatcctgtaatcaacaagaaatagaagcaaagaaaccgtggttaaatctataaatgatagccgatcggctagatgccgatgacatatcatttacctttgagccgatgtcatctgtgtatcgatcggcagacatgaataagtaaagaagaactaaatctactcgatcggctgtagatattaacgatatatactccttatatcgatatatacttaaatcaaatgattgggatagatcagtcaccatgccgagacagtataaatcacttagattgaaatatatatcaataacaggactatatatgtttatagcgtagccgatcaaatagatctaacatgtatcggctaatactctgatactactctatatcaggatattaaagcatgtataatatatcaaacaaagg

SEQ ID NO: 57564 - DNA, 744 bp, Oryza sativa
cctgcagcccggttaagaatgttgtacactgactaatgtgtgttattcgcagcccattgtatttccaacatcaagggcattccagaaccatagttgggatccaaaagcaaaatggtcaacatgggaatcaagatcgatttacccttttgattttggaccctggccatgtaagctgtcgctactattcatttttttaaaagaaaaaggaaaaagaaagttgttattattcactttgtagtatatcattaatttttgttcaattgtgcatattttttattattcaatcttctgtaaacatccagaaaatttgttctacatttctctgccaaattaagatataaactttgctctaacggtttacagagaacgtcagatttggagagggctcttcgaagcaagacaggatggcagcgtctagtgaaaagaggtgtccacactcttaggaagccacagtatcaggtacatcaaatcacccaaaatttatgaactttgaaagggttgtgcagttcatacaattctgatatgccttcgatttttcagttgtgctatgtggatcctggaattgctagttcagaagaaatggagcagctgacaactattgatagtatcctggtcaggttctagaatgctggtgcgtacaatgagtaatcgtgtcttactttgtcacatgctaatagaggaaaatgatacagtttgctcgctcatgtatatgaaaagtcaaaagataatcaatgatgtacttga

SEQ ID NO: 57565 - DNA, 1965 bp, Oryza sativa
tcactgtaatggatgaacagtccagatagccgatatataatattttgacagtggtacatgctgtcatgcagaagtgctgacaaaattcagatccattttgaggtccactcccttcgtcccacaaaaaatcaacctagtactagatgtgacatatcctactattataaatctaaacatatctctgttcagatttattctactaaaaatacgtcacatccaattctagattcattttttttagggacggagggagtaattcacattagttcagcatttcacttggcagaaagtaaatgagtgccagcaaatgactctggctgctaagcccaattcgattgaccatgtcatatctggtatggaactgggatttggtatatttttaagctagctgtctttgtagcgtcccagcataagttcagttacttgtgtcattagattaagaggtaaacatatttaattgagaagaaaataatttgcactctttagaccagcctccacaaacgaacaggatccgccgcactctctagaccacggcactactcagcgttctttctcatttttaaagaccctgtcagcttcattcattttttttatgaagatatccttagcattattagagctttatccatgctgtgtggtacacagaaaatctctgaaaattatatggttctctactaaaacgaccatattctatctttggaatttcgatcgaatttaaggagccgagcacacgcgtgtaaatataaagcttttactagtatttttctgctttgagaagaagagcaatttagttgcacgtccaactcttcctgtaggcaggcataatgtagccgttgaaattaaatccctgacgaggatagttactgattaattattggtgacagcggtagttaactactcaaaccgtggtagtggagacagcagtgtactctatttaccagcaatttaacactatgtaatattgttcttcctttcattgagcagtttgaaacagatcatttgatcagattatttatactaaattatctacacgattatatacataaattaactattataataaataaacttaacaaatagcttaaatcaataaatctaagcaatcgatagaattttttatagaaaatatataattttaaagacttaaaacaaacaatcagcaataataatgttttattttgagatggtagatgacgacagaatcacgaaaaagacgtatcaatgaatttaagcaatcaatatttttttagaaaatatataatttgaaacaaataatgggggacaataatgttttatgttgagatagcaggtgatgacagaatcacgaaaaagagaggctaccgtggcttatctctgtgggccccattggtcagtaggatattagggagacatgggcccacgcgtcatcctcacgggagcttcttgtcttctctttacaagagaatagagaaagaagacgaccacgccaccaccgctcgtctccaccgcgagcgaaacccaaaaaggcaatggcgaccgacggcgacgccctcgagtcccaggcggcggcggcggccgaggcggcgcgggagctgcgcgaggccgccgcgtccctcgtcgcccgccgctccgccgacgaggacgcgctccgccgccgcgccacggcgctcgacgccgacctccgccgcctccaggcctccctctccaccctcgcccccaccacgctcgacaaggtgactgcatctcgttcttctcttctactcatctcctcttcctcttcctctccccgcgcttgcttccaattcgatctctctctctctctcactcacgcgtcgcctcgtacgggtttcggcggcttggaattgaaacctacgagctgctagtacgttagatcgtgattcgtttcgtgattatctcgcaaagcagaacgcttacgcgcttcacgccttcgcctggaggattgagatgtaaagtttgcacgcccgc

SEQ ID NO: 57566 - DNA, 7176 bp, Oryza sativa
cacgcacaagtgacaaaatttgacctgtttctaaattgatataagagtctccgtccgcatgtccaagtttatcgcactcctttttagattttctacttaccttttgtacctcttttctaatatatagttttcttctgtacttctgttgtgtcatctgtgagaattgtctcattctgccatttatctatataggttgaggaggaactggagcgtgccagggtaacaatctcagatagtgacgtggctgcatttctcccaagcaagcggaatggtatgctatgatttatctcaccccccatgcccgtctcggggaaatataactgttatttatggaattcacttctccttgaaatttagggaagttcctcaagacctttgttggccctgtaaatgtgcgggtggcgagaaaagaagataagctcagagtgaaggacgagtacaacaactacagggtagattttagatgcttcttcgataatttttttttagaaagcttatgcatttactttggatatgatttcttggaccaatttaataaagctatctgtactttttattacttttattttgatgacttaagcattctaaatttccaatgattactccaattggtgtattctttaaattttgatctgtgataagaatcactattgaagagaactactaccattttctacaaaaatctaagtaaatttcagattatcaaggtcaacgagtatggtgtgtattcaatctcagacagcatgctgataaaaccttgaacctgttttgtatgtcatatggtttaattagtaaatacgggaaacatgcaattctggactaatactctagaaatcatgttgaaaggttatgtaagtgttccttttcatgtcgaattcaagcagtcctttctaaattgaacatagtggcttaactggtagagtatacttggtataattttcgctactataaatttttatgtcatgcctgacagtattgatggtttcatttatttgcaggatagggctgcctatatgtttctattgttcccatccattctcctcctacttagatggtggatatgggatggatgccttccagccttggcagttcagatgtaccaggtatttagtgccgtgcagtgattgaccctgaatatattttctctatgtatgactttgctgtccagcagaaacgatctaaagtttatttgttccacttaacaggcttggctactattcctttacacaagttttgctctgcgggagaatgtgttgattgtaaatggaagtgatattcgtccttggtatgtgtctgaatttcattgcttacagaaactgtcaactgcagcactcaacaattttatggcaaatacccatttttaatgcacggacagacaaaagtgcttgatttttttactatatgcgacttataatttgttggtatgggaaagatcttatatcaaaacatcttttaatgatattcgtaaaacccatgtttcgtttgttcacttaatctagcaaaatcaattcctttcttagaatgcattatcatcttttcaggtggatataccaccactatttagcaatgctaatggctctcgttagccttacatgggagataaaaggcagcctgattgttccagcaagcaggtaaatgatcatttttcagagaaaactagcactcactttgtcatcaaaccttcaaatttttggaacgctgaactcagacactatggctttcttttcagaggggggtacaacttttcctgcggtgggcaatcatgcaaggaattgcaatgcatctacagaataggtaccagcgtcaaagattgcgcacccggatagctctaggaaaggtaaggttctgtggttcacgtcttgcttcaagacagtactcaacaacatattcttttagtgccaagtgaaggtgtacaacatgttccaataataagattcaaatgagtatcatcttcaaatgatatgtatacaatgcagatgcttatcaaaagcaatttaatgcactaatttgcttgatgtttgttgatatttgcatatcagctaagagttcggaatatcactgaaactaatttagagaagatgctctggtcttttaatcaaactaagtcttataggcaatggttgttcatacagctcaatagactgttgaaatgatgctgtatattgtatcatctatgtacctttctcaagttttatcggtgttgttatttattctgtttcatatttaattgcatgcaggctaaaagaatggatgttgttgctggagaaacagctggtgtggaagggcagctcttgctactttacccggtccttttcacattacaggtatgtgtaaatgtgtcttgtgagctgaaagcatggcagatccaagttgttagtaattgtagccccccacccagaatatgttgtctcacgttgttggttcttgatattttagtcacttgtttcttttccttgatgaagtttgcttccgatttctggatgttagcacaaagatgattaattaaccattatatatatcttccatattctgcactaatgcgcttaatcttggatgctatgtgttgtcaggttttcgaaggatatgttggagtattacttcttaagacggctttgcacgggcttgcatcggaatggcaggcaagaattatcaactatgtaatgtttgcagttgatagttaatcagatcttcatgagacttaggctgagtttgtttcttagagttcccaattccccttattttccgcgtgcacgctcttcaaactattaaactgtgtttttttacaaaaaaaattctataggaaagttgctttaaaaaacaaattaatccatttttcacgtttttttagctaatactccctccggttctatattaattgacgttttgaacaatgttgaggtcaaacttttataactttgaccatcaataactttaaaaatatttagtttaaagaaactagaacaatatatataaatttgtctttcaaagcactataataaaagtaaacatgcatttatttattgtatatattataatagaaaaactagcatggtggcccgcgcagattgcgcggctagcatcattatattttctatcatataatagcatatatgttttctcattatattattcaaatatattaaaatgacaacataattttaaattttgcaatatgtgtaatattcatattatattttatatacatgttagttattaattatttttaatatcaaattttagttatttataaattgtatatattcctatatggactctagactcgtcttttaatatttcctttttttaattccgaattttctgtaaattgtatttctatatagactctatgctcttcttccaatattatttatttttatttctgaattttcatattatattttatatacgtgttagttattaatatcaaattttagttatttgtaaattatatatattcctatatggactctagactcgtcttttaatatttcttttttaaattccgaactttttgtaaattgtatttctatatagactatgctttttttttcaatattatttatttttatttctgaatttttattatttctaattgtatttctatgtggactctaaactcatctttcaatattcttcaatttttaatttcgaatttcagttactaataaattgtattcttatattgaccttaaactcttcttcccatatttttcttaatttcgaattttagttatttgtaaattgtattttttatacagactctagactctacttttaattttattatgtttattccaaattttagttagttttaaattcctatatggactctatactctacttctagtatttcttttttaaattccgaatttctattttttttcttaattgtatttctatatggactctatactctacttctaatattccttatttttaatttcaaatttctattatttcctaattgtatttctatatggactctatactctacttctaatatttcttgtttttaattccgaatttcagttatttcctaattgtatttctatatggactctatactctacttctaatattccttatttttaattccgaatttcagttattttctaattgtatttctatatggactctagtctcttcttctaatattccttattttttaattccgaatttcagttatttcctaattgtatttctatatggactctagtctcctcttctaatattccttattttttaattccgaatttcagctatttctaaattgtatttctatatggactctgctttttctttttctccgattaatgtgagaatttctaagccatgagagcgaatgtggaagctcctttttctattcctttaattatataatagataatttgtatataggaaacttttgcatcaaatacaccatttactagctaaaaatgagttggtccctctttaagaaacgaaacgcagctccagcattaaacaaatggagagaataaatcttagaatgactatcagaaagaacagtctaatctattatgatgtaatacggcatttttattattgaaccaaccagagagaaagatgtgaaggtgcatcagtagtgattaacactgaatagttacggggggaaaaagtccattttaaattgggcctaacatttcatcgctccacgattaattaaatagtggtgatattagggttctattgaacaattaatcatagtgctaattactattgactagacattattagtgacatgttagttgaggaaattgacaaaataatgaatgaaaaataaaaaaatgcaggcgtacatggtgggagagcacggggacagctcggtggcgatatggtcgagcatgagcgtggccgggatgccggtgctcaagtcgctgcgggagagccaccagagcttcgacgaggaggccctggagggaatccggcgagcggtggtggacagcgcgtacgaggtgatcagcctcaagggctacacctcctgggccatcggctactccgtcgccagcctcgccgcctccctcctccgcgaccagcaccgcatccaccccgtctccgtcctcgcctccggcttcccacggcatcccccaagaccacgaggtcttcctcagcctccccgcccgcctcggccgcgccggcgtcctcggcgtcgccgagatggagctcaccgaggaggaggcccgccgcctccgccgctccgccaagacgctctgggagaactgccagctgctcgacctctaataaatcttattattatcatcgtcgtcgtcgtctcgtcacggaattaattaaagtacctactccgtacttagctagctacaataataaggattcattgatcactacaagagtgatcgactcgactgtagtatgtgtgtgcaatataatgtgctgtctatcaacaactactagtattgtcatttttttcgaaccagggaactttttaatgataagaagaaaaagacaagtacttattgtcgagcactcgtggacaacactgtgattgattgccttgatcaatcttaccaatttttggtagctgtaaataatttacatagtttgttggggcggatgagcaagcaagcaagctgaatgggctgttgatccggacgaacgagccgcgcattccttgcttaattaatgggctgtcagtgggcgaacgaacttggtggggcggacgtcaatcttttggcccaaaatttcatgacaagtgcagtgcggtggaaggaaaggagttgggccaggccggtaggattatttatgatgggctgggccggaaaaggcagcgatgatatagagcgggctgggcctcccaatggctagcaactcttcataggagaagaatcgtgcaacaatacacgcccaagagaagaaaccgcggcatggaaggaacaaatcgtggtgcgctctctgcgtctgcgtgtgcgcatggcatcgtgcagtccacaggacaggagacggcggatcgcaagacatccgcgccgcatcgggattccatcctttccctcatgtatactatctccgttccaaaataagtgtagccataaatatccgtgtttagcagtttaaccatccgtcttatttaaaaaatattaaaaaaattagtcatacataaagtactatttatattttatcatctaataacaacaaaaatactaatcataaacttttttcaaataagacgaacggtgaaacgttaaacatgaataaagctaaaacagtacttattttagaacggagggatcagtactctgcgtgagtgctcgtggcgtgctggttggaaacgaccattgactgattacgtgctacacgtggcagacagacatgtgggccctccccactcccttccatgcttcagcttcacacgatcgatcgatcgatggagatgcggcgatagttgcgctcctcctcattcacagtccacactgccatcagccatggggggcagccaccacctcttccgcttcctcgccgccgacgaccaccctttcttccccaccttcccaacctcctcctcctccttcctcctcgacgacacccacccatttttcttccctccctcctcctcatgcccactcggtttcacctctcctccttcatcgtcttgcccactcggcttcacctcctcctacgacctcgacgccgccttccaccaccatctcgacctcgacctcgaccttgacctcttcctcccaaccccgaccccacctgtaaccacctcctgccccgccctccgcgatcccttccttctccaccactccctcgcccaccgcgtctccgcgcttgagctcgccgccccacgcagcaagtacacctacgaggccgaatccgccggcaggaagatcaagtggaccacccacgacaagcccgacggcgaccggaccttcaagtgggaggcccagatcgacacccccaacgacgatggcttcgaccgcaagtggaagtgggagtccaaggcctccgccgccggcaccaccaagctcaagtgggccaaggaggtcaagggcaagggcttcctccacccatggtcgcacgcctactccgtcgaggaggtcttcggggacgacgaccaccaccacaaggcagacaagacagcagaaaacaaggtcaagcagcacaacaaggatacttctgccaaggaggagaagaagaagacga

SEQ ID NO: 57567 - DNA, 848 bp, Oryza sativa
aacagatagtagatcgtcaattttcgtgtgcgctgtactgacaacacaacactggttttctcaaggcgtttgcaagcagctacgccaagggcaagagaaagcagctgtccccgcaggatgctgcattgttgatccagatgaactaccgggctcacctagcccaccgctcgcaagtgctgcgctgcctccgtcatctggcggtggccaaggccaagctcaaggacattaggtccttgtctacaacatctcttaccgccgccgcatttcgcatgactctgaagagcgtcagaggtttgccgacaaaatcattgccctgctcgccactgttgatgcccttgaggtattaagctcatcaccctttctgatcatgccgtttttcattaacaagtggcccccatcaaaattttgcattccagacaatttcttcttgttatatagttatttttatttattactatgggtgacgattggtaaccatgccaatgcatgtgttgttatttacgcgtttatcagcaatgttgtttactaccaaacgttatttgattgatgaaatcatcagtgtagacatgacagtaaaccacacccaattttcttccgatagtctagtttagggtcctgactgaatttatggatatcaatacctgcaacaacatggctctcatacagtacttccatgtaagataatctaggtgtaagtgaagaaggatgaaaacaccagaaaaatattttctagctttcttcttcccccaattcttcatcagaataaactctaaacaataacacatttgttgatagctacgtgagggtagtttcttaaaaagaaaagaaaaagcatctaacagccatag

SEQ ID NO: 57568 - DNA, 12324 bp, Oryza sativa
taaaatctgttttttgttcttttttttcattccaccacagtttcatcacttagaactttattttcttgtgatgaaatgaaatgaaaaacaaagaacttcgtatttaggtagtacaaaattggaataggccgtagaaggtgcctatgattctgggctctggctgtccgctgatccgctggccgtagaagtcaagcccatctcacagtctgcagatcgcttctttttacaacccaacgggccattttcagaggcgtcacccgtaaatccttgggccaatgtgacccaatcaatttcgtgaaaagtactccgtagcaaacaacgcgcgcgcgttccctgcaaaaaacgccggaaaacgcattgtcgatcgagccgtttcagcaaataagggatcggtagactttatcagtgactgtatgaaacttttatatatgtgtgtgttcttacgacttaaaagataatgctgaaaaatttatttcaaaatttaaattttggttttgacttattatatatttttggggcaaccgatggggctatgaggctatgagctatccatccatccatagcgcaacgtgtgacagcgtgaggtgacaagatggaaaaccgtgagccgcgccaccggtgtaaaccccctcccttcacgcgcgtttactttgcaagcaaaggacaaggaaaaaagccgtaattggcgaagaatgttcttggatttgattagcagcggtacggtaacacctctagcttgcatttgcatggtagggtgatttggctaggagagcaggatcatccgtgcattcaattttcctcatttctttttgcaggctcaatagaggagaggaggggcctagctagcaccaagataatgcagcaaaaaggagagaagagaacatgtcatccagtccaaagtgcaaacgtctctatacaaatggaacatatggagtggacctaagcctagttgcttctgtgtcccaagctcccaagtgtcaaagccttaatgtgcaaaaccacatctgtggggactcctgaaagcaaactaaatgattgcaaaagagttcgtttattcacctatttatttatttattttattttctttccatgtgtctgttgtttgatactttgattgatcatgtgctaaactgcagaaaaaaccaacaggcccagagtaccggcgaaaaggctcctcgatgaaaagtgcagggattctgggggagttgccagtgcgccaccgttggatttttgcacacatataaacaggggactctgctgcacctctcacacagtaacatatatagggacggttccaccaagcacgtttgggaaatggttttttgagcaacatctcatgcgaacaatttaggcactatttacttgtaccttcaccttgtacgtgtgctccatcccatagctgcattatttgcatcaatcattttaattgcatatatacatactccctctcgtatttattttttttaataaatgacatctttcactttttatcacacgtcttttaataagacgaaatatcaaacgtatgataaaaaaaatcaataacgccatctattaaaagacagattgagtatatgcgagacatttaattatttgccacctctcaacaatttaacactcgtgtgacataggagtagacgcatagggtaacaaattgctaaacgtcaagtaatctatgagtagcaactagcaaatacttaaatatctcctaatatgttagcattgcaccaaagtctataactatattgagctttgtcctgtccatggtaaagtgtggggttaaagtgttaaaaagctattggtagcagtatctagtatggcgtggcaggccggtgcagataaaaggggccccgggttttgcccggaaatgaggagaggacgccccggcagctagcggacgctttgcatttgcatgcatggtgctctctacttctccctccgttcccacggcaaattgcaaaacgcatgctagtatttggcaccattagcctaaggtagtagtatcagcgtgttacagaaagaaaatagttaagtagcagtaattaattaaagcctgtgattaaggtaaagcagcagtgcagttacaaaccgaaacaaacaagagtcagcgaactgaaaagaagaccgggaagaagaagaagaaaaaaaaagacccgaacagagttttgatgagcagtgtcaggtctgtcacatgagaagagagcgaagtagctcagctcagcccccactcgctcacatggaacgcctctgctcgcctcgactacttaaccagctaaacgctcggttgattaggagaggaaaaaaaacgagggaaaaaacgggtggaaacacacgcaaaaacacaacgccgtgcggccttgtaaatacgggcgacgccgacgcgcatcgctccccgaacaccaaacgcctcagcttgccttggctctcgccagtcgctacgcccgcgacgacacgaccgcgccgcgcgcgcgcgagcgagcgagcatgtcgggctcctctgccgacccctcgccatccgcctcgaccgcgggggcggcggtctcgccgctcgcgctgctccgcgcgcacggccacggccacgggcacctgactgctacgccgccgtcgggggcgacggggccggcgccgccgccgccgtcgccggcgtcggggtcggcgccgcgggactaccgcaaggggaactggacgctgcacgagacgctcatcctcatcaccgccaatcgtctggacgacgaccgccgcgccggcgttgggggcgcggcggctggtggcggcggcgccgggtcgccgccgacgccgaggtcggcggagcagcggtggaagtgggtggagaactactgctggaagaacggctgcctccgcagccagaaccagtgcaatgacaagtgggacaacctcctccgcgactacaagaaggtccgcgactacgagtcccgcgtcgccgccgccgccgccaccggcggcgcggccgccgccaactccgcccccctcccgtcgtactggacgatggagcggcacgagcgcaaggactgcaacctccccaccaacctggcgccggaggtctacgacgcgctctccgaggtgctctcccgccgcgcggcgcgacgcggcggcgccacgatcgcgcccaccccgccgccaccaccgctcgcgctgccgctgccgccgccgccgccgccctcgccgccgaagcctctcgtcgcgcagcagcagcaccaccatcacggccatcaccaccacccacctcctcctcagccgccgccgtcgtcgctgcagctccctccggcggtcgtggctccgccgccggcgtccgtttccggtaatggtcggtgcgcgcaccgtacacttaatactcatagtagctgttacatcccctcccctccaaaccatttactactgttctctcacactgatatgtgggcccacctcgcagcgagctgagctccgccactatacgttattaaaagcccgcgttatgattgggctagttacgttgttgagttgagctggtcgtaattatttactaccgctacattttttttacctttttaccgtggggttcgggagagggtggtcgcggtaataataatgtcctcaactcaggggttgggagaataaagctgcgtgcagtgtggtgcagttcatgcatgggaaaggtgatgcgaatccggatattttatgggggtttaattgaaagatttactccacgacgatactaccctctactcctgccatgctgcaagcatgcgtaatgcgttacattgcgaaatcactcgctttgaatgaaaaaaaagcctgaaactttggagaaaaaaaaagcaccttttgttttctcctcgtgcatgcatgccgcgctgcgtatcttgaactactttggacttttgtatcgatcaacaaaactatacctatattagcagtaattaatactacatttgtagatatcctttgaccgttctatcttatttttgataattaaaaaaattagttacatttaaaaatgctatttatattttattatctaataacaataagtgtattagttaaatattaaacgttggatatgaatagtttaaaacgttggatatgaatagtttaaaactgtattgttttggggcggagtgagtaattgattgatcgattaattaagtggttgactaatgtgtgtgtgatttatttgtgtagcggaggaggagatgtcggggtcgtcggagtcgggggaggaggaggaggggtcgggcggggagccggaggcgaagcggcggcggctgagccggctggggtcgagcgtggtgaggagcgcgacggtggtggcgaggacgctggtggcgtgcgaggagaagcgggagcgccggcaccgggagctgctgcagctggaggagcggcggctgcgcctcgaggaggagcgcaccgaggtccgccgccagggcttcgccggcctcatcgccgccgtcaacagcctctcctccgccatccacgccctcgtctccgaccaccgcagcggcgactcctccggccgatgatcgccattgcaatcatatgcaatgcagcaaggacgatcgatgtaaataacccatggagatgcatggatcgaggcatcggattattgtttggaatggctgcaagaagaggagtagctatatatttttttttttgagtgtgcatcgccatcgcgtcgtctgcgagtattgggagtacggtgcattgcatgcacaacgcctccgtttcttgatttctttctttctctcctgtgtcctgtgatttttttgttgtttattcttttcgtgcaattagtggagagactggcaggtgtgtggtgtgaatgatcgaaatggttagtgtggctgctgctgctggtgctgttgctgttgctgcgttttttcttctcgggtgttgggtttgtcgtggacggcgatcattagcggcacagtggatgagagagctgagctctagctgcaggtcgcttggtctcgctgcgctgtcatgtgatcactactgcgcatgggggccacggttaccgctatagctgctgcaactgcgtgcgagaacgagctcgtgctgagctatacaagctttgctgctacttctgcttgcttttgtgctatggtggtgttggccgaatcagatcagagtttgtgctaccactttacattcgagattccgcttttgcccccgtggtgtacttgcaatatactccgttcataattaaactaattaacattgaattgaattgtacataacctaatataataaattaaatctgatcatgcatatccaaatttattgtattagattgtgtcacattcaatcttaggttgatttattatgagagtacaaaaatatactccctccgtcctatttttaagtgtaattatgagattttgtgtctaacattagaccgtctgtcttatataaaaaatatgattttttttttaaaaaaagtcacgcataaagtatgttttatctataataaaaataaaagtattaatcaaaaaaaaattaaataagatagatggttaaacttcgttggacaaagaaacacactactgcttttttttttttgacaaaaggagtactagtacagtactacgttcgtgtggtgtaataattgttgagcacaagatagcatgagatcgagcacagcggagtacgtactcatgcaaatcacctgatacgacgacgcccgtccatgtccatcgagtacatggaattgacgtgcattgtaccgatccatgcatgcactggctacactcttctgtcaattaattaatggtatcactagtacggtactctagctagcacaatgttgtgatttgcagatggtaatctgagcaaatgacaattaattgtagggacgtgtgtctctctgcattgccgggtaagccaagtacgctgctcccatttcaagtccggattaatgcaacgcacgcatgcacgcacgcacgcacgcggccaagtgatcaagaccgcgattaccccacagtcccacacgtatctacgctcgccgacacacgcgctaaaccctcactcacctcacctgcttttgctcgcgtgcatgcatgtgtctcgtctcacagcattgaactcctggtcactgcaaacttaactgtggtttaagaaaaaaaaaagtgataagttccatcccttgagggatacaaccttactgtttactatatgttatctaaatagttattaaaaaattaaaaaataataatatagattaatacaaaatatatcacatgcaaaaccaaatttaatttctataagctgcaataaaaagaacaaactaaactgaaaatagttaccgtacattcacgtctacattggttatttttttttacaatttataggagttgaattttaatttgcatatttgtaaagtgatacatttcatattaatctatcttgctaaattttttaattttttttaactatttatatgatatgcacaaaatggaaggatacttcctcgagcggataagttgttctccacatgcataggtcggcggccggatcgaacagccgagctgagcagcagcgaacacacaaccacctctctagtatagctagccctgcatgcacgacacatatattactactagctcgttagtttagagacgatatcgtagacagattaatcatgtggtagtacgtagtacgtgctgattctccaggttaacaaccagctagctctcgtagatgctttgcttacgttacagacagtagtacgtagctcctcgatccctagctagcctgcatgattcctcacgatttgtttcttcttgtgaaaagaatttaattacttatacgaagtacgtagcttgtgttccaccgagaaattaacgcgagaaggaactagtaggggagagattctcttctctggtcgattccactagctactctgctgtgctgcctgtgtggtgggtagcgtagctttgccaaaagctcgcgatcgatggatcatcgcatgggacgcgcgcggtcaaaaaaggctcaaaacgcacacacgattctgcgattctgcgcgggcggcgtggtggtgaggagaaggccgtcgcgcgaggtaggcggccggcgaatcgcggggttggtgcgacggctgcgctttgctgggggatcaaccggcaccgccctgtgctgtactacctgggctattatgctaatctattctagcgagagagggaaggtagagactagagagagagagagagtgggtgtgggtggaccgctgtcttgtcgctttgctcccatcatctcacctcacctcacctcaccgtccccaaaggcagcgcagataggggcatttcggtcttttcattttgggcataaaaacaacctctaattttccattgtcttgcctggttattcaacggcgagaaaccaagttagggagaactgtaaaagaaagtctcagttataaaaagagttaacttctgataataaatctgaccaatatttatcttaattagattcattgttaaaaattagttttttgggacgtaaggtgtacttgtactccttggagatagatttgttttctttctcacatgatgttccctgtttcatgtatgttgtgtaaaaagttaaatttttcaaagaattgaataatacagatcaaaagatagcacatgatatgccactacacaaacatataaattaaaattcaacctataaatttagaaaaagaacccataaactatttattatatattcgtagtcaaatttattaatatttttgcttagcttgtattagttgaatctaatcttataaatatgtttgtgaagtggtatattatatgttgatttatcttattaattttttaactttttaagatgatatattacgacaacacaagttatggtaatctacatcgttcatcaacgctaagcaagcaaacagatcaggttaagatatcaggggtaaagtaaggtgctctcaataaaacatatacatctcagcaatagactagattaataataaaccatctcaatagtatgtctatatgggtatttatacctctttaatccattgcctcgtttttctctatagactatctccaggttagtagatagttttgctttctctcttcatttaatcttttccatataggaaaatatgctgacatggatcttttatatatagtctataagagcacccgcaatgttaaagtaaggtactatttataaaacatatacatctcagcaatagattagattaatagtataccacctcaatagtatatctacacatgagtatctatagctttctaatctattgcctcgtttttctctatagactatctctaggttagtagatagctttgctctctctctcttcatttaatctctttcaagtaagaaaatatgctgatatggatctcttatagagagcctatagataaccattgtgggtgccctaaataactattacggttgacctcatatactgagatggcggcacagcgtataggatagtactcgtacgtttggtggcgatcaggctttaattgattttggtggcgatggcgatgattttggtgtgggagagtgagaggagaggagagtggacaggacactggacactggacacaggcggtggtggtgaggttggcttggagtgctagtactacacgtactactactactactgggagtatatggattcctctccccgctttgtggtgtcagaaaaggccctgacaatctcccctagctgtcatccccgctcagagccgtagtcaaacccccttgaccggacagagtagataccatgccactcaactcactcatatccccgaaatgcccctcccttccaatcacaaaggtatacgtaaccctagttaaggacctgtttcgagaagtttaaaattatgagaaacagaaattaaatggtactctcctcgtttcacaatgtaaattaatttactatttctcacattcatatcgatattaatgaaactaaacatatatatttatctagattcattaacatcaatattaatatagaaaatggtataataacttacgttatgaaatggaggaaatagttagctttaaagaatttaaaaatatttaggtttctcggattctaactcctactttattttctggttctataactatatatatttttagaatctgaattataaactgaagcttcccgaatagggccgagtttagttttaaactttttattcaaactttcaacttttccatcacatcaaaattttcctacacataaacttttaactttttcgtcatatcgttccaatttcaaccaaactttcaattttagcgtgaactaaacacaccctagcatcacgtttagttccaaaatttttcttcaaacttccaacttttccatcacatcaaggtcctgttcactttggtaaagttgccaaaattttggtaatttgctaaaattttagcagaatttcttatatagttaccaaaatttgatagcaaactaaatgtagcaacttttttggtaactttactaaaatttggtaagattgtaaatggcatcaaagtgaacaggtcccaaaacttttctacacacaaacttctaatttttctattacatcgttccaatttcaaccaaatttttagttttgatgtgaattaaacacagtataggtcttaaagctaattccacatgtctctagctagaagtagccactactagtacgagttcaactttgctcctttcaattcacctcaccgatcatatcgatcacccttataattcaccgcccatgcaatgcatagccgcctacgagtagtttttttgacgttacgcttcgttgtcatcttgctgctacagtacagacagggcagtgtgctactaccccctaatctctattgtactacacaatgcattatgcatgtctctaattaagctcaaaaaatcgtaaaatttgtacttctactccttggactacaaatttctcaagagaaaatggtgtggcaacgctggagcaggggggcctacaggtgcgtacttgcaaagagcaaaagcattggagcattggatgctagtagctccactgaaatgggctctagagagagagagagccgcgctctgtaaaaaggcatgcagatgcagtgcgtgggcaggggatccggagctgagcgagctagcggtgcatgcaagctgtaaaaaaaaaaaaggcacagcctgcacgattctccacgcacacacgcacgcacgcacgcacgcacgcacaaggacccccgttcccgttccgtccaacaagtacggtgtacttatatttgccagaaaagagctttgtatgactcagaataaaaaccttaattcgtaagggaatgtttggtggtattttgcctgaattatgtgccacatatacagccccatcgttgggcttatatctggaataagccaaacaacatatttataaacgaaaaataatttataaataaaacttttatatatgtgtccttagtgatctaaaagcacagactgaaaaataaacttctataaaaaaactcaaaatcagctttaaatttaagattaaaaattcaaattttagctgataagtataagcgtaagcgaaaagatgagcccggtagaatggaatgatacatactgtttaactattcattaagaggaagtggaacacgtaccagcactagttgcaaaactgaactttcttcgagaaaaaaaatgtattggattattttcagttgaacacagtatgctctaattaagctagtactgaatttggctaactcaagtacgtatagcagtttttcaagctactaaacaaccccttaatgagccaattgtgagtcagctttaattgattttttttaaaaaagctagtacttcctgaaaaagaatatgaggtgcagctacaaacaacacactgtgaatgcatggttcgacggccagatcgacgagaaacgccgtacctatatagttaagacaacaataagctcatggatggacgtcagaggacgtggtgccattggaggagcgtaggccgggcccctacttacaacaatctgcctatacattcaggacataaattgagcttgtggccatttatttcaggcttttgggttggagccttgcacaaatagttgcattattatattggaggaaaagaaataaaacgaaagcatgaactgctggttatatccgagaaattagtacacacacagtgggttactgatgatcaggtgatttgtaaactagttgaagtgagctgcagaggcaagccgaactgataagtgatatacagtgttcttgcatctaaaaatattagtattttgtattattagtataagactttgactgataaattgctctacttatatactattcatgtgatgaaaagcataatcataaaaagtacttctgaatataaaactattaacaccaatttgatgtcgaaaaattatatgctaatggagtaattatcggtctaaatcatgtcttaacgtaacaaaatatgtcttaattttttgaacaaaaggagcccttaatcttgtgttattagtcgagagatcctggattgattgaccagaatatatagggtcctctagtacgacagtagcatagctagctagtcatacaagaatagaattacgatgctatcttaaacgaccacacacaggagtaattgaaatggagtttactggcagcgagacggtggtactggtacgtcgacggatgcgccggagatggcagcttgtataaatgcaatcccggcccatgggcaggggccaaaccgccaccaatcacccctcctctcctatccgggagggacacgggggccagtgaaaacgaagaagccaagccaaagccaacccacagctgcaataataacgcgtagccacagccactgccgatgccgctgctgcgagagggtgacaccggccaatgcaacagcggcagcagcagcagaagaggcaggcaaatcataaggcttgcccccacgcagctgcgtgccagtcaaacggagccagtcaaaactccaccgttctcttcccccacactgtgtttcagccccacacaaacccatccatccagcaccgtacgtgtacttgtccagcaagggtagcggcggtgacagtatatgacattattgtaccatggggagagagataattggctgtgtttagtacacgctgaagtttgaaagtttggttaaaattggtacgatgtgatagaaaagttgtgtgtgtatgaaagatttgatgtgatggaaagttgaaaggttagaaaaaaaaaaacttggttaaaagtttggaaaaaaaactttgaaactaaacagggtagtaatatataggttaggccactgg

SEQ ID NO: 57569 - DNA, 1269 bp, Oryza sativa
ttatggatgatagaaaaaactgaattttgtaaccattataggagaaaacaatcaaacgagttaagtattagtagaaagttaataacttggtttagaaaggaataacttatgacaagaaaattttatggacaaattagcatgagatctaacgtcatggaaaatctctgcaatttttcttgcaatctatccaaactgtcgttcgtgtaaaaacataaaattgcttgaaaatccatgttttacatttctatttttcttttaaaattttacatttttcatattaatgtgttttctcattcttgcatttttcttgtgttttatatatatggtcatttctcaaatgtttgaaaatcctcttttatatctgtcctaaatcgtgcgctaccttttactacattttcttaatcctacattaaaaaggtggtcttataattaaggaaattcatgaaaactgaactggttcctattaaattatttttttaaaaaaattactttgataaaaagagctgtagcattcttaccttttgcgtccaactacagtctacagtcagtcccggagacatttaaccgacatccgatatataatgatggttcacgtccagacaaagtcaacagtcaacatggcatgcaaagcaactgttcacgctcctcgatcagacaagataaaactgtgcccgtacggacatggctggtatggcagtagctctgatcaccaagagtactccctcggcacaattaactggagcctgcctgaacgaaacagaactcaagagtaccaaccaaaaccatcacacccttgtcttttcccaaaaagtaagatgcaggtaagcgcaaggattaccacgggcaccatggttattagtggactttctcttccagcatttgacaaagatccaaaggtaagaagaacaagattttatcagcatctgttcaggtataataatattatatgcattaaaagagaactggagtaaacctactcaagagttctataaacatactaggaaccactacaaaaggaatatgggcatttccacaccaaagaaaccagattcgtcatttggctccaagcaccaggagggaaaaagaaaaataagagaagcaattatgaaccctcacagaaaatcactcgataatcttgacttggagccaataaagaaataacatgagttgataaaataggcttttagtcccacaaaaggttgatcatcgagttggccacccggcttctttgaaagttttatcactctcgtactccagggctgcaggaat

SEQ ID NO: 57570 - DNA, 952 bp, Oryza sativa
attcctgcagccccatagctccaatatgatggcaatgctatggatttaaactaatagttttatgataacttcaatataaatagtagtttcgtgatattcggttttgtgataattttaacgttaaatatgtagttttatgacacataaattaaataagtatttttatgatagtttgatcaaaatattaatagttttgtgaaatttactcttaacaatattatatatgctattcaatagcaattgctgaccatacaaaaacataacacttaatttgcagtaaagaaattctctgattaattatacacagctgctaaattctctcctcacttcaatccaccgtgcaatacagctgtttttcaattcgcaacgacccccatcgctgaagatgaaagacaggtacgcatgtactattcttctactacaaatggagcttattgcagctttgtgggacagccaaacggtcagccccggcccggtggttgatctgaagatccattgcatttgcacctgacgcgctcacaacaatttgacaatttgaacctgatagtgcatgtctcaccaaactatatagtactatcaattttacatgcatgttcatcactgaattggagaaacatgcaatgaagagagatcgacatgacatatactagtacatactattccatatgcaactctagatctgaactcaacttgtgaaattgtggcctaaatagtctgtacttcagcagcacacaacactgttgaaactctctgagcttcgatctaggacaggcaaaattaattgaattagcagactggacacaccaatcaatcatcctatccaagtacatgcatcgtcgtcgtcgtcgtcgtcatcgtcatcaaccattgcagttgcagctagagagctgaatatatacacaagttgcagctctttccatgctctatcattctcaagttgggtttaactttt

SEQ ID NO: 57571 - DNA, 1206 bp, Oryza sativa
attcctgcagcccagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactgatgactgatcgatccatcgatcgagctatatctctcgacgagacgagatccagtacgtactctttcgtcggatgggtacagtttaattatcgattggtctaggtgcaggcgcattcacgtactacgcgagcaggtgcatcgctgtcgacgatgccggcgacgtacgggacagcgaggtttcagggaagcgatggacacacgatgccgatgcctggcagtgcatgatcacgacttctcagtcaagaccatcaattatcgtccgactagctagaggccgggtccttgtggtgtttttgctggagccgtaaatagtagtgcactccctccgta

SEQ ID NO: 57572 - DNA, 13016 bp, Oryza sativa
aataaagatgcagtcaacatctagctgctgattgatcattgctgatgagacatccagcctctagaaaactgcaggtttatcaatcaatgaatatacattttgattgcttagaatctatgataatatactgtacaattgacaaatccaacacataactaccctacggttcaagatcccagcgacaattgactgaggacatataagtttcgatacatttatcgtacacatcaacttaaaaaactgacacaagaaattctaaaaaaaacatatatgtacttctaatagtattgcacatatatgtataaagtctaaacttcatattacaaatgacagcagctagccaacagaacggtttacacttcagctgcacaaattacagttattcgaagtaagtgttacatagaggtaaattgagcagaagagttgcacacatagtaaatcattcagagtaactgcgataattggtagttgcaggaggatctatcacctatggcatctgtcaacagagttacctgggcgtcgtcatgctggatgctacccgtgcagatcagacaaacaacaagaacaggctacaagatacgcaacatgtccatacatatgagtaatgcaggccccagaagggcccttttcgttacaaataaactaatccaggcacctaccctatgaatgggatgtaattcggtatatgcaatcttttgaaacttccttattcattcccctgatatctttagattagaaaagccacaccatatcgttgtcatctcatacatgtctgattgttccccttgctgaaaagatatttggaaagttaacaaccgagaatgatgaacctaatctttggtagctaccctttctgtgtttttcttcaggcacatggtaaattgcctagaatattcagtgttagtactccacccagtccaactgatcttttaaaaccaacttatccataggaaacatgttctttggatgtggtaaaatacgcagaaaagcaaaagaccttcattaacatcctcatctgagcatctaaaagcaaggaaagagagaggttgcatggtcgtcatttcatgcgttgcacatcttacaccactaaatcttttgtgagcctttgctatcgcagttcacatttctcattgatgagctgaaaggtatggaaaccgaataatgctcttcaccggccgtcaactgggccaggatgaatcattcattcacatcattcttctcaggtttttatcataaggattgttactgcactggagtacccttcctccctgataaaagcagggaagatccagatggaatggaacagatgatagctgatcccaaaacaaaacagaagctgccaagttgatcagatacacactacataccctgttgtcggttttaacagataaaactctgaattcagtggaaatttccgctgttagacacagaaaaataggaaacagggtcgaaggaatatcgtccgtcacataaacgtagggatattttcgtctacaccttataaaaactcttgtaagtagtgtaccaggttcctccacccaatacattgatcccattcttgaactttaagatttactaaaacataaatttgtggcacagaatttcgcataagcaattgaatccgtgtgatgatcatgcgaggaagttaatgggtccaaacctgaaaacctgcatctctccggtgaaaccggccgcgggattgtcagctcaagaactcgttaacagcaaatgctctctgtcccgggacctgaactgagctaagcttgctgctgaattgtgacaaccaaaacaggtgtatacagttcgtggtgggcccactttgcagtgatatttttgcagcttgattgacgtggagagaatccggggaaggacgtgggccctacacagaaccaacggacaaccgaaaccagcttccctttgccttccttcctactagctttgtctgaattttctgatgctgctctttcgtctctcacgctgcaagcctgcaactgcagtatggagttgcacaatttgcatttgcacaccctccatcttggaatttggaaaactattgctgataacatgaatcatttcgtcttcatgtgagcgacgctgatgcattctatcttctactgcagtgactgcctcactgcaggtacagtcaccgagagaatcatctcgcaacagctaagctaatctctgaacgtgccgagaaaacacttagagactattcttaccttacgtggcattcatttttctatccagtttctttccctgctaaaactacatcaccatctaaattgaaagcagctgtgttgattcatgaatcagctaaaaaatatcatcgatctcgcgcgtgggccatgacaatcaatccaataattttgatggtggtggggtccggaggcctgcactttgcgcctcctcctcgacaaaacagctcgatcgatccatcaagagccagatgcgatcaatcatacctgcaattaacgtacaacctaattcccctttatatatggctataatcagctgcatcaactgccctggcatggcaatcgctgtagccgatcgccgttgctactgcgattgcctttcttgtttcctctactcttctgaagctcatcgcattttttttttcagtcggatgtgtacagatcacctaatgctaagttaaagatcacagtaaaatcactttttggaaactagctaactaattacttcatccgttctcgaataattgacactagcagtactattcaagctcaaatttgttttttcctgaaatttataaacacctaagggtgttatattagtcaaagtaagatgatcgtagtcatcagtggcagtaattcgagaaacgagggagtaaacaattggctcatatgattggagaatcattgtcatacatgtagcaatgaacgcatggattatacaagaactgaaagaggcagtaacatgctgcatggcacactaactgaaagtctgaaactctccaagagaatacactaccacatcgagtccagaaagcctggctgtccttttctctcccctagaatataccagctaatagatagcacaatttatcaaggaaaagcaggggaatataccctaaatatggagatccccatggaccatgcatgtctggtctacttgccgaatgtggagttgtccgtgtacgtctcggccaaccaccgggtctctcggctactctggagggccattttcttctgcagcttatggtgtctttgaaaccctctattaaacagcgcgttagccacgtggaacgggatgattcattaacatgtaattaattaagtatatattattataaacttaaaaatagatttatttaattttttaagaaaacttatatattaaaaaaaacatatcatttattagttcagaaaacgtgctaatgaaaaataataaagctgtagtttggagttgaagtttagaattcagctgacacaaataaggcggtatgtgaaaattactccagaaacccttgtgattaacaggcagtataatctagatttgacaggccttacattgctcgtggttgatgttaaatacagtactgaagaagtgttctctgtttgtagtgcattcgtttcatactggaccatcagattggctattctgtcactggtgtttgtctgctctgcagcttgattcttcttctcgtccggagaaaaaaaaactgtcacaatacaatactgtgctcttcaattttttttaaaaggaaatgctgtgctcttcatggtacagtatcagactatctacgctgttgctgacagtaacaaaggagcacatgcaccatgcattgagcccagaaaccaaagcacacgtgtcatggtcagttagaagctttcagaaaaagctgtgcgcagccttcgtaaaaaaaatgcgatgtgaagtctttcattctgacatggtcctacacaacactgatgataatgcacgcgtaaatttcataaaattaaaattatgagaaaactatatatttaaatcaatgtatcataaagtatataattagaactaaatttatcaccaaacaacaaatttagcaataaaattatcataaaaattttatgtcttccaccaagtacaaaactacaacttttataattaactttatcataacggtactgctagatatttaaacaatgtgataacttcaatattaaatttgtagttttgaaatacttgatcttaaatatataggtttacgataaattttgaaatacttgatcttaaatatataggtttacaataaattttgtataaagcatacctataattttataatacaacatattaaatatatacttttacgataacttaatcaacttccacacagttttgtaaagtttacccgtaaatcacaatgcatgcaacattgcaacactccaacacacaggattttcagcatcacattttttttaacaatgccgttgtattttggtttggttgtgagaattcacaagagccaagaactctgcatcgttctaaaaataattacaaaaaaactctgcatcgacggagagagtgagagtggatggaccacatggacaggtgcccatccagctcggctgttcaagccggctcgatctacgagccggccgtgtttcgaaataacccaaaaaaaagaggggtcaaaacgcaaaaggggcatcgctataaaaccgcggctccgcgggcgccaatccaccgcatcatcggcttccctccggctcgagccaatctctcgctgtgtctctctcgcgctctccactagcaccggctcggctcggctcgcgcggcggcggcggcggggcggcgtggcgccgagggaggggaacgccggtgtggggagggcggcggcgaggggactcgccggcgacgagctggtttgggtatgagaggggttacccatgcggcgccgaccacgagcgtcccccgccgcggctccatggacggcctcctcatcttcgtcttctacctctcgcttcctatacgtggtggccgcgaccactcgttaatctcctcctctaattgttagccgatctcgcctctcccccacactctctgatcccgctctctctctctgcttcgattcgattcgattcgatcttctccacctcgtcgccgtcgaacgcaactcggatcgggaggataatggaccagccttctaatggcttcgccgccggaggtgcgtctccgatcagaatactcccctgttcttttttttccatttttaggtagagaagtcattttttattttattatttttttgcaaattgatatgttcatcagtgctattcaatttcaaccatgcatacaaatcccacacgcaactttagattactatccaagtataaaatccaagttgattgtgttacggcaaatattgctgtcgacctgtcgtggactggcgtcccaatcgcaatcgattgtgtgagtatgacagtgcagtgctttagtgtcacaaatcgtaggggtcagaatgtttcgattcagtaaatgctgatatggagccatccttttttttctttttttttttggttccggtgaatacgcaaaaggggttgcgtagccatggattaaggtggtgaaagcaaagctaaaatcctatcgaatatgaaatgtgtacatatctttaactttataccttttttgttctatgtaataattatataaatacataaagtaggacccttcattactgttttcttttttaaaaaacgaaatgttgtaaaacgatcctttaattgattggggaccatcccccattgttttaaatcttgcaatatcagatgagtcacagtagtgtagataccatcaatcagcaagaatctagaggaaaggaagggattgtgatggcaatttgctagcaaaactgtgaaagagatgtggaacaaggttccaaaaattgaggtctctaaaagagtaaaaggtcaataggaaaaaaatggtatcccttgtccagaagaagtagcatccgaggccgaattgtttccttgttcttgattgcattttttgcagaatatgctgctgcatcgattaatccagactgctctgcgtcaaataactctatggatcattctgctcaatctaattcgaacatgacactttattgccaaaaaccaactgtaatgaataaatcactaacaaagattattcagttggccacttgtgggctcgaaagcacaactattttcagtcataaatttaacaaatgacacatggttgcactgaatgaaactttaaatgtgcttattcatgtacatgtttgagaaatatgtgatattagttgagctacaattccaaattgatttcaatatttaacccagaaatttactgtgcggtgcattcaggtctttttcttcgtcacattgatgggcaaaatgcctctcccccttctgtcattgtgattggtggagggatttcaggcattgcagctgctcgtgcgctgtctaatgcttcgtttaaggtaaatgctgtcattgaaagatgaaataactatatctctgtcttctatattctattagcttattgtccaaaaataagttaatgttttgatgcttcccgggccctttttcttagatacttttacataactacaggtcacactattagagtcacgggaccgacttggtggccgtgtgcatactgactattcttttggctgcccaattgacatgggagcatcttggttagttgcatcccagaagtagctattttcgccgccttgcaacgtgtttggttttcatctcatggttttatcatgtggttcaggttgcatggtgtatgcaatgagaattcattggcaccactgattaggttgcttggccttagattatatcgcaccagtggtgataactctgtgctatatgaccatgatctggagaggttaggagttattcctaacccataagtttatcctcaacttgatgggctttcattctcttacaattgttgtttttgttcatttagctatgctctctttgataaggatggtcgtcaagttccccaggagatagtgacaaaagtcggggaaacatttgagaaaattcttaaggaggtattgtcatcgtttgcatttcatttgttatccatcaaatgcttttatgcaactcttgtgagcttactttgttaatattgcagacggtgaaagtaagagctgaacatgaagatgacatgcctcttattcaagccatctcaattgtgcttgacaggaatccacacctaaagtaagtggaatttagcattcacctatatctggaatggtggtgctttagcgacggggtgaaatgttctaatgatatgcattcactcttacaggcttgatggtttgcaatatgaagtactgcagtggtgcatatgtaggctggaggcatggtttgccacagatgtggataatatatctctgaaaaattgggatcaggtatgcaatagggggcacttttgtatttacatgcgcacatgaagaattgttgtattcacgtagagcagtggactgacctttcaaatttacaggaacatgttcttactggtggccatgggcttatggtgcatggttatgatcctgttatcaaagctctcgcgcaagatcttgatatccacctgaaccacaggtatgcagttacatatcctcatggccaagtaattcacataagttctgtttcataggtttcatagttataatcccaaatctatagtatcttatctcttaactttcctccagggttaccaaaatcatccagaggtacaacaaaactatagtatgtgttgaagatgggacaagctttgttgcagatgctgctataataactgtccctcttggtgtacttaaagcaaatatcatcaagtttgaacctgagctcccagattggaagctttcatcaatatctgatcttggtattggcattgagaacaaaatagccctccgcttcaatagtgtattttggccaaatgtagaagtgctaggcagggttgccccaacatcaaatgcctgcggttactttcttaaccttcacaaagccacagggcatccggttcttgtatgcatggtagcaggaagattcgcatatgaattcgagaagctatccgatgaagaatccgtaaactttgtcatgtctcagctcaagaaaatgctaccaggagctactgaaccggtaaatcctcaaaattcattttcagaccatgtacagttgagtactgtcaatttcagactatgaacagtagctctaacacttgtgctacacaactgcaggtccagtatttggtttcaaggtggggaaccgacccgaattcgcttggttcttattcctgcgaccttgttgggaagccagctgacttgtatgaaagattctgtgctccggtgggcaacctgtttttcgctggggaggccgcctgcatcgatcactctgggtccgtgcatggagcttattcttcaggcattgttgctgcagaggattgccgaaggcatctgtcgacgcagctaggcatctccgaccttttccaggttgggaagattatcatgagggaggagatgactgaagtcatggtccccttccagatatccaggctgtgaaagaagaacaaagcctgcctatttagcaccgtgtttatcctgcagctgctatggttaatattgtagctgctgctctgtagtttcctaattatctcagatcctgtaccgtttcacagtttgatcgtttatgtgtattcaaataaaaacagaataattatatatcaacagaccttgttctctgaatccatggatattgcttttcatttacacattcccagtcagtactgctgaatttattttagttttcagtgtttgccttgagactggagggctgtagtaaactagtaatcgtctgatcgaacttggcttgcgcccccatttgcttcattttgcatgtatatagggttgtagatgcaggctagttgcagttcaatggtcataaacagtggaggtttttctttctttactttcatacgtagatctccactaataataaaccatacagcatcctgcatattcggaaacgattccaccatcgtgtgaaccatatcaaacgcattcattccactgtaacatctgctgccacaatttgcaatgtccatcccatcctgtagcatcagacttgtaaattgtaatagccacaaacagagaatacattaattccctcccccaccacctaaaaatcattttttttctttcaaaaatacatatttcattaaaaaatctattatttattttcattgtattttgttttatcataaaatgcattttaccatgatttgtattttacatatttacacaaaatatttaagacgaatattcaaacatatatgtctaaaagtcaacaaccacatattaaaaaacggactcaatactacctcctttttaaatagatgacgtcgttgagttttgaatacacgtttgactaatcgtattattaaaaaatacgtaattatcatttaccatattttttagttgttttatcattaaaattacttaaagcattatttatatgttacgtatttgcacaattttttaacaagacgatactcaaacgtaacgttatctattaaaatacaaagggagtatatatattatctgtgttctagtagttcctcttgtaaaaggaagaaaagataaaaacaaactggtgccgacgccaactatttccaccgcatttgggcccacatgtccgggagccaaacgcggctacgcgacccaaacgcaaacgcaaaggcggaagctgggatcccgtgtcgtcgccgactccgactcctcctcctccgctccatataagactcgccccaaccccctcatcaacttcataccaaaccgaaccgaaggaccccacccaaaatcacacgcgccaaccagatcaaacccacctcgcaggagaagagaagcgatctacctctcctcgaggtggtggtgaggatttggagttgaattgtggggagggggacctcgcgggtgttgccggtttggagcccaagatagggttatgagctgcttcgcggaccgccgctgctacgccgccagccgccgccaggacggcctcctcgtgttcatgttcttcatctcgattcccatacgtactagtagcagtagtagtaataattgtaattccagtagtagtattagtagtaatctcctgtaagcggagttcctcctcgcggctgcgtgtacggggacgggaggaccttcttcctcttcgtgttcatcttcttcttcttcttcctctcttccttcggcttcggcgctggcggctatggatcccaatagcctcaaaactggaggtatgaattattcccacttttttgtaatttttttttctgaaattttatctggtaggagtacttggtagtggtgcgtcgtgaaaggtgggaatatttcccattgatcatagtatttttagaaatctatctattgtactttagaattaaattttccacatagggaaggtgatcatcacactttagattttacaagattattagaatttataattctagttgggtacaaattggttagttagttggtaacttgggtatctacagtattatgtagattagtgagcttgatgttcaacgtgatttctctctcttatgattcacatacctgacagtaaaaaacattttttgttcaggcctcttgcttccgaccattgagaggcaatgtgcttcgcctccatccgtcatcgtgatcggtgggggaatttcaggggttgcagcagcccgtgctctctccaatgcttcgtttgaggtgactgttttggagtccagagatcgcgtaggcggtcgtgtccataccgattactctttcggatgcccaattgatatgggagcctcatggtcagtctcaccctgaattgttagtgtgagaaattcactttagattctgttcatacaagcttacttactgttcattccaaaaattcaggctccacggcgtttgtaatgagaactccttggcaccattgattggctatcttgggctgaaattatatcgcactagtggcgacaactctgttctgtatgatcatgatttagaaaggtaatcttttagctcttgatcttacgcttttctttaccgatccgcacaatccttgttgattcttacatcaactctgtcaattgattctgttacagttatgcactctttgataaggctggccatcaggtctcaaaggagacagttgctaaagttgaagaaacatttgaaagaattcttgatgaggtacataatgaactcatttatacttggtacttctggtgccgtttgaagagcatgttcagttcactatctaatttctgttgcattaatgttccaaaaaaaattttctgttgcattgcagacagttaaagtgcgtgatgagcaggaacatgacatgccccttctacaggcgatttcacttgttcttgagaggcacccccatctgaagtatgcacattcttgtaccatgctatcaatttactcacaacatacttaataaattcctaggatgcatcatgagaggttgactgatatggttaccattatttgtaggttacaagggatagatgatcaagtcttgcaatggtgtgtctgtcggcttgaggcatggtttgctgcagatgctgatgaaatatctctgaaaaactgggatcaggttagctgaaatcagtctatattagcacactgcacattcttatagtgacattagtttgcttagtgaaggatattggtaaattacatcgaattgtttgccatcttgcatagttagttacttatgtttgtattcctcttaactatgcaggagcatgttcttaccggtggccatggtctgatggtgaacggatactatcctataattcaggctcttgcacaaggtctagatatccggcttaatcaaaggtgtgttcttttacctcccgagcatacaaacacaacaattaatttcagcatactgaagtccctttttcagtgtattttggctccacaaaattacttgtcgtttcacttgtcaatattgctaaacagttttgcttactcgcttttgctactgctaaatcttcagggtaaccaaaattgcccgccaattcaatggagtgacagttaccactgaagatggaacaagttactctgccgatgcttgcatcattacagtaccgctcggtgtgctcaaggcaaacataatcaagttcgagcctgagttgccctcatggaagagctctgcaatcgcagaccttggtgtcggtatcgagaacaagatcgccatgcacttcgatacagtcttctggcctaatgttgaggtgctgggaatggttggcccaacgcctaaagcatgtgggtacttcctgaacctccacaaggccaccggcaatccggtcctcgtctacatggccgccggtagatttgctcaagaagtggaaaaactgtcagacaaggaggccgttgatctggtcatgtctcacctgaagaaaatgctacctgacgccactgaacctgtgagtttgccatctcagatcatggccacagttagttccattttcgagttcgcattatctgaatgaattcgttgttcttgcgactgacaatttgcacttgttgatttgtgttattgcagacgaagtatttggtttcacgctggggttctgacccgaactcgctgggttcctactcgtgcgacctggtcgggaagccggccgacgtgtcggcgcggttcgccgcaccggtggagaacctctacttcgccggcgaggcggccagcgccgaccactcggggtccgtccacggcgcctactcgtcggggatcgccgccgccgatgagtgccggaagcgcatcctgatgcagaagggcatccctgacctcgtccaggtcaaggcctacgaggagatggccggagtcattgctccccttcagatttgcaggacctgaaaaaactgaacctgctccaccctgccattgtcatggaatctggattgattcaattgccatgcctatgccctggaatcttgatgattcaatcactcatacaag

SEQ ID NO: 57573 - DNA, 756 bp, Oryza sativa
agatcatgcttgagatctttgtactgggacacagtttcaattaattaatgctagtaacaaccttggagtgaatgaatgtgagtagttgggctggagttgcttgttcgtcttttgctgctgtgattgcaacctgcgagggagaagtgcacggctgtctcgtctcatgcctttgcttgctttgagcctttgaccgtcgccggcggtggatggcagctgacctcgacgtcgacgtggtggaacacaaatttggcgccacgcatagttctgaagatgacaggtcatcttgtgactacaataaaacgctacttccttaaaaaaaattcagtttttaatacaacatttaactctccgttttatttaaaaatcttctaattagtatttttattttcgttagatgataaaatgtaaatagtattttatacgtaactatatttttaaatttttataaatactagaaaaaatgttcgtgctgaagtatattttaattgggtgaagtatattttaattttattattgttatatggattagttaagatgaaatttattgtgggagttcgcttggatatatatttttttagaaaatcatgagctgtggttaggagttcgagatcgtctcaaggtagtatgcgagttttttaaacagacttcttatatgattccttctgtattacaaaaataaataattttaaaaaccgactcaaatatatatatatatgtatctactccatcgtcacttgagatttgggagggagaccg

SEQ ID NO: 57574 - DNA, 1380 bp, Oryza sativa
tacccggcaacgggctctcggctgaagccaccagcacattagtgggcagttttcctcggtgggaatcgggaagttgaaattcactctgctcctgatcaatccccagaccgcagaggtaaagctgcagtcagcaaacaggtgctggcaatcttcctcttctctttggcaaagaacgcagtgatcctcgtggggccaatttcttttagcaagattgtcggccgttaagcattttcctttgagagctagccacatgaagaatcgaaccctggaaggtgctcttgagtgccacaagaggtcgcccacaggacagtcctctttggtcgtgaaaaagaagttgtaagttgccgatgctgagaattgcccgtcgggagagaccttccatcggatagagtcatcaccattctgcagcgtggtgtttctgacctcgtcccagagctgaaagaactcgcatagggccgcagcagacaacgaacccacctgtgattgatcatcgcctgagccaccgtcagacgtgatctcccaacataagaaaacaggatgggccatctccaagcgaaacctccctttcccgtccaattcgacgtccagaagttagtgtcagttccattgccgatgacgaaatccgccactcaattgaagatagcattgacgtcgctacccagatggtaggaaaccagagtccacggccttcctttctgctcaaggctcttggcatgccatttcaacctcaacgcttgcccgaacagatctaggtccatcaccccgaggccgcctttctcaatgggcatacagagcttgcgccaggagaccagacagtgaccaccattgactttttcttggcctttccaaaggaaaccgcgacacttacgctctatgtctttcaccgcccacttaggcaattgaagaactgtcatgaagtgcaccggcaaagcctgaagaacagagttcacgagacagaggcgtccatcaatggagaggagtttaggtttccagccagcaacctttttagccaatctatcaagaatcggttgaatctccgccttagtcggctttctggttgaaagagggaggcctaggtaggtaattggaaaatgctgaacctgacaatgcaaaatagcctccacagcttgtatctgcgacgggttgcactgtattggtgaaagaccaagaacagctatagagggggggggggggggggggaatatagcaattcaaatcttgcccccgaaaatactcatcaagccggatttctcaaaatccttactagaatcgcggctattagagaagccggatctagaaaagaagagagaaaaagaagagaaaaggaattcccgaaactagaggaggaagagaaaaggaattcccgaaactagaagtgag

SEQ ID NO: 57575 - DNA, 8158 bp, Oryza sativa
ctcatacttggttttctctacaggcttggtttgtctctggttttgcttgtgctcaacttgttttggatttttgggtctaggtaactctacaggcttagacttgctagtcataggtaccatctttggttctgaggttttgggtgtactagaactagtgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttgtaggtatgagttctctttcttagcagactcaagatcaactttcagagaaatgcatgaagaacaagaatcaatagatttgatagaatcaatgacagttttagcatcttttagttcagtttccaggatagcacaattagcacatgaagaatgaataggttccttagtagcaaaagattctaacaaatcattcttggtcctaagcatggcaacttgttgtcttaattcatcattgtcactagtgagaatgggacaattttcacacctaccaatcctatcatgaacaaatttttcttttagttctttcaattccatctcaagcaaacccatatcaactttcatttcatagcaagtagagcaagcagcactagcactagaaggattcccagctcctaaagcacatgatttcaacttatccttgaggagattaatttcagaaagatatgaagcacaagtagaacaggtatcctcctcaggaatcatggatcgaagcctagcaatttctagcgccattccatcattttcagattttagtttctcaattttatacttagaagacctatacttatcactaatttcaatcatcaagtgtgccattctttctttgcttagttcatcatcaacagagtcattatctgagcaagaatcatcacaaagagaaccatccaaggaagggatatcatcaagacatacctcaggatgctccgatgagtcatccttatcctcaagcgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatccttcttcccctttcgcccttgtccctcgggcttcttggtcgtcttgtcactcttcttcttcaacttgggacaattcactcttttgtggttaggctctccacactcaaaacacacaaatggttcattggtttttcctctttttctatctctcacatttttgtaagctcttgagaattttctagcaaaaagagcaagatcatcttcagggatcttctctaattgctcctcagtgactgagtgtaaagcggcaagagagaagccaccatacacaaaggctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatggcgagcattatcattatcagaaaattcttttccaacagatctcaacttcgaaataatttctccaaaacgtttgaaataagaatcaatggactctcctgggtgcatctcaaatctttgatattctttatgaaattgattctgacgaaccaattgaatatcattgtttccctcatggaaattgcacagagcagtccacatgtcatgagcggacttgtggtgttgaacacgattaaattcaccagaagaaattccaccaatgattgcatttcttgcacgataattaaaatcaacctgagccatatttgcaggcgtgatgtcagcatcatcgggcacagtataaggagatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgataccaattgaaagaccaagaacagctatagaggggggggtgaatatagcaattcaaatcttgcccccgaaaatactcatcaagccggatttctcaaaatccttactagaatcgcggctattagagaagccggatctagaaaagaagagagaaaaagaagagaaaaggaattcccgaaactagaggaggaagagaaaaggaattcccgaaactagaagtgaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacggaaactctctcaccgagcatctcaaaatgattaccaaaaggagcaacctccacccttgcatccatctctctatttatagcctaagacccctaagacattttctcaaatacccctagggcgaaaccctaactcagaacagatctggtccatccattgttccttctactcaaaggaaaagctccagatgattgccacctcatcgatccgaaccctcacatggtcttcttgctgatgaatccgcgtgctctccgtcttgacgaatccaaacttgccacgttgcccagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacgggggttgccgcgtacggtttttccgcgcgcgtccttgcgcatgcaagctgcctgcacctcctgagcccatgcgccatgggccgccgtcttgggccgtcgctgcttggacgatgcaggcctgccgagccgagccattcaccatcttgggccacgtggaacggctggattggcttggcctccctgccaaccaatcacagcgcacatgcacagctagctagcttgacttttccaccgagccatgctagtagcaaccagtacagtgcaagctcctccttgcacaagtacagtacgtgtacatgcatgtatgctacctacagcaagtactgtagcagcaatgcacttgcacagtcccttctgatttcttcgcgaatccgatgcttgcacacttggccttgtgaagcctgttgcaaagaccttttcacacggtgttcgtccaccgtgtgcaaccttgtgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacaatctcccccttgatgggaacattgacaatctcaagcaaaattttgaaaatttgatttttgattcacaaagcaaaccattttgcaaaagcgaactttggtcattttgaaatcgcgaaaaatcaagaccaagtgacaagaagaaaaaagggatgcaaatgcaaatgcaagaatgctccccctatgtgccaaactccccctttcaccaagatttaaagcaagttttaattttcaataagtgcaaatttctctccccctttgtcaatgatgccatcaagatcaaaagagacaaaaatgcaagataaaaatgagatgaaacttgcaaattttaggttttgagagctttgagagttatctaaaggcatcaaaaggtagacatggatcacacagatacaagcatgtgctcaagcctagctaagcatgtgcataagaagtatgaaacaagtcatgaatatcaagttagtatcgccagcaagcaaaaagctttcaagtgaattagtgatttagtgtgcaaagctatttctagaagaagcttaaaaggaagcaaaccagctcataatcatgcaagatttacataaacaaagcaatgaacccatgctaatgtgctaatgcccagttcataaagagtatcaacatgataacaaagcatagaacatgagcttttaatcttttctcatgacttttatttttatgattttttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaaacagagataaaacttgtaaagcatgattgatacaaagtatggacgcataagcatgagcattcataagcatgtactgacagttattgcgaaaagaatgtaaacatggcatgagtatgagaaggatacttcaatttaaacaaacttctagagcaagcattgcacattgattgagttcaaatgaatagttaatttaagcaggtttcaacacgcttgaacagcataacatgatcacacaagctacttaagcaaatgaaagctagacaagagatcaaactagcataagagtgatacatccatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacatgcactagcagcagctacgtactcagcctcagctgttgattgagcaacagaagactgcttacgagaggaccaagagaccaaagaagtgccaagaaaatgacaagtgccagaagtacttttgcgatcaatcttacacccagcaaaatcagcatctgaaaaagctcgaactgaaagggcagaagagcaggagtaccaaataccgtactcaagtgtagacttgatgtagcggaacatgcgcttgactgcttggcgatgtgatgttcttggagaagcctgaaacctcgcgcacaggcacacggagaagtggatgtccggccttgacgcagtcaggtagaggagggagccgatcatgcttctgtactcgcgctggtcaacttcttcaccgtcctcatcaggaccaagcgatgaagtagttgccatgggagtggcgattggcttgcagtcggccatgtcgaacttcttcaggagctctttggagtacttggtctgatgtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaagtttcttcaaagtccaagccctcaacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaaagctgaattgacaagttcataagaccgatttctagttaccctttcacccaggcctccgatcatcgagtcaggcggatgtcggttctggatgtgtcggggagctgtcggtcctgatgtgccaccatcaatctcctcagctgctgaagatgatgtagttggtgcatctcctgaaggtgatgtagtcgaaggagaaccggtttcttgcactggtggtgtactgtctagaggtggaggaatagaatcatcgtcatcatcatctgaatcctcatccacaaagatgctttcatctggaacacctgaaatttctggtctagctcctgggctagcctcatcaaaagtgacttcacaagtctccacaattttgttggttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagcagaaatagcttcagtccagaattttcttggagtcgtaaactcatcaagcatagttcgtgccatctccacaagggtgcggttcttcctctcaaccaccccattctgttgtgggacatatggcgaagaaaactggtgttcgactccagaagaatcacagaaagattcaaatgcagaatttttgaattcagagccattatcactgcgaatggctcgaagagcaccaggaaactccaaagccaaactacgagcaagagactgaaagaagccaaatgtttcctcctttgattcaagaaaatagacccaagagtagcgagagaaatcatccacaacaaccaagacataccacttccccccaactgactggacccgagcaggaccaaccgtatccatgtgaagcagttgtcccggtccatctgtcataaccattgtaacaggcttgtgggaagaagatgtcattttcccatgacgacatggtgcacacacaagatctttcggaactttcaacttaggcaaaccccgaatcaaatccataccactaatgcgagacaagtggtcaaagccaatatgaccaagacgtcgatgccagaaaaacaaatccctattctctgaggcaatgagacaacgagaaggaccaggagcagaagagtcgaagttagcaaagaaaactcgaccaactcgagaaatgtcaaaaacaggagattcagaagcatcaagaactcgagacctgtcctttttgaaacgaacttccagattttcatcacagagttgtgaaacagagagcaaattgtacttaagcttacttactagtgccacatctttcagcatgaat

SEQ ID NO: 57576 - DNA, 5446 bp, Oryza sativa
atcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacaattggcgtgatggcactctttgcgagatttgttttcaatccagtggcctccccaaacagatccagcacagcctgaataaccaacgcttcctgagtcaccgggcggaagaagacactgaagtgctgggcaaaaatctcgcagcattgagaggagagagcaatcccgtcgtcctggcttgggtcatgatagcctcaggcgtatccataaccaacacaaaaagaaggggtgacagcgggtcaccttgcctcaaccccctcgccagcttcaccggatcagaagtgatcccattgatcagaatacttgtctcagccgttagaagcagagcagacaggcatcttctccaaccagcaccaaatcccctgaattctaacatctccaaaaggaaactccaggaaacggtgtcgaatgccttagatatatccagcttgagcaagatcatgtctttcttccttctgtgaaattgctgcgccaaacctttgacaaaaatgaagttttcatgaaggtttctccctctgatgaaagctgtttgcgtgtgtgggattagatcatccatctttagggccagcctcagagccagctagagctatgtcttatgtgtagctttagtaagcctccagatcggagaaacgcccatcagtcttccggctaacttcataaggagggctagtcggcttgggttcgaaatctcacatcttatatttatttgatattaggtcattttctaatatttgcgtttttaggtaattagcctccacgtcttcagtccagtctcagtgtaacatcaatgtcagtaacagttaggagcagtgaaacagattcgtcggtgaatgctccaaaacttcagaaagtacaataagcggttacacaccatattcgatcttttggcgagaggttcttcaggcttcatcagcttacagttacaggggacgtaataacgtaactgaagatcacttatgttttttgttttttttttcaaaaacataactgaacatcacgacctaagaatagcattatgttttctggaagaatggcgtgtgagaaggataaggtagaagaagcggtagcgcagaaaggccaagggcacgctaggattaaagggctcggagctgccgtttcgtcgccatctttagcgtaagtggcgagcttttcttgaggcaaaattaggtggcaagattagcagcctcagatcatcatcatcatcatcatcaattcagtgtttatttcgttgccgcgcatgagcgaaaagccggcataatatattgaggtgcaatctttttgcgcgttcacgaaaaagcgaaaagccggcaaattaagcccaaagcttagctagaaagagtagcttagcttggagcaggcacacatacgtgatgtagtgcgtgcttgcgtggtgacctttctctgcttatctcatttcctgccgcttttggttccatcgatcggcaggtggcgctggtgccatgcgctttacccaaaccttaacagcgccgtacctaatttttgcaatattggagatgaaatgaaaggaagattcagagtttcagacgattaatttatacataggtgtgactattattactctgttactccctccctgctaaaaataatccaaattcatttgtactaatttggactagaatgtatcacatccacccaaaatcttttacttcattcgtttcacaatataagtcattctagcatttctcacagtctagatttattaacatcaatattaatatgggaaatgctagaatgactactccatccgttttacaatgtaagacacatatatgtgtatagattcattaacatctatataaatgtggataattttagaaagtcttacgttacgaaacggaggaaatggtataaagagcaaatcgatcgaagaagctctgcaagctctgtagcctgcagaaagaggagggatgggaaagggtggtggacgtctgtcgagaaggaaggtacaaaaagcaagagggagaaggacccggcgccatagcctctaaggggaatttcaaaggacttggatttctaaggattaatttctatgaaatccatttggttcgaagaaatctagatataggaaaacaaaaaaattctttcctacaagttataaaaagaaaacataaaaaaattcatccgctctgaccaattggaaaattcctatggattgaagttcgcatgcattcctattccttcacttctcctattcttatgtgttattttttaaaaaaaaatgaataggccctgagagatggagatcagaggagaggagaacagccaactcaggtggtttgaccaagggcaatatgccgtcagtgaataccaccttcaatactactttgaagttattttataccggtttaagaagtcgtcatagctgcgttcaagggatacaaattaaattcaacctatatggctgcgttcgttcaagtgacattgagtgagaaatcacatcgttttcctcgcgcacacgtcccaaactactaaacggtgtgttttttaaaaaaaatatagaaaagttgctttaaaaaaatcatattaatctatttttgaaatttataataatttatactcaattaatcatgcgctaatggctcaccccgttttacgtatctttccaatcttctcaatcctcttctcctcaaactcagtcttagggagtagcgttggactttttccttctccgatcgctctcgcggtgatgggctgactttagtgggccgcacggtgaagcacggcccaagaagtactgcccaggtcggcgagaggcgagagctcatgaaattcaactgcagttcatatcatacacaggcaatccccaggtgcagctccttctgctcgtacagacataatactataaacacgcaaacccttttagtaattatcttattatttcaagcacaaaaaacgacagcagactggtacagtatcggtaagactgtatatatcttagacgaaagcccaaagctgtgtcttgctatatcgcgtgcaaaaacgctgggacctgacctctcgttgcttcagaaggagaccttgatgccaagcaatgccatgagctgggagatgaactccgggtggccaggccatgccgcgccggtcacaaggttgccgtcggtgaagcagcggtcaatgggattgggctccagccatgtcgccccgccaagcaccacgttcagcttcaccgcaggatacgccgtgcatttccttccctgcatatcatattatcatccacaattagggagactggggagcatcgctgcgtgcatcaaacaggtttgtgtccatttgtgtgagattttcggaagcaattcagtgatcctgaataactacgctaagaaggatagtgacatactgatactgtaatagtacgtcttgttgcctaccttaccacactatgaaaatgcttttactttgcaggaatgatttaatcatttaattatccattaatcaagaatagatattgttgcattatttttgttttgttcaaggtaaattttcctatcgctaggtattgagttgcatgcaccgaccagttcaatccaaaagcttaagctgatgaggaaagacggacaattcactttatattccaacactaggtatagaagtaatcaagtaagtacgattaatgtagagcaatggtagaaaattaatcattatcatgtacctgaaggactccagcagcagataaaatctgttggccatggcaaattgaggcgactggctttgctttatccatgaagcccttcacaaggctaatgactttatcgttcagtgcaaggtactcaggagcccgtccaccaggaattacaagtgcatcatagcttgatgcatccacattgtcaaatgatgctgtcaaagcaaaatcgtgaccaggcttctcgctgtatgtttggtcaccttcaaagtcatgtatggcagttgggcatttctccccagcacccttgtcagggcaaactgcatcaacatggcaaccaagggcttgaagagactgaaatggtaccataacctcataatcttccatgtaatcctgttataagcatgtagttaagcaaagaggttcagcagagatggtatgacttatgaaaaatgaagaaaataagaaagtagtcatacgaattcaattgaatgaaatttccctaaacataccccacaaaggaacaatatccgtttgtttgagccagttacagagcctccaagcgctttcacaaaaaggctgatgaattcaggatgtgcatcgtaagccactgcagtgacaagatttccatcaactgtgcatttgtccatagtatcagcttcttcccacttagcaccagcagcaaccaaaactggtttaacagcaggatatgcggtgcatttacggttctggactactccagctgctgccaaaatcaactgtccatggcaaactgatgcaataggtttcttcgcatcagagaatttccttactaaatcaagaaccttttcatccatggcgagatactctggtgcacggcctccaggaattaccaagccatcatattcattgatattaacctcatcaaacgaagcattaagtgcgaaattgtggccccttgactcagcatatgtctgcatgatgaatcaaaatgaatctaatttaatttgtcaaagcaaacttatgttagaaagacgaaaagtaccaccatactatcacacctaaaagaaccaacaatacagacgatccttataatcgagtgcttcagagaaaacaaagattccattactaaagggagtagtagtccagtagacaaagaggacccccaaattagttttgaaagaagcaacaccatctaaagagaagcaggaactaatgcaataatatgggaaacagacaaggatatgaatttataagaaatctctacagcaacagttaacccccaaatcatgaaccaatcaacagttcacttaagtgacgaaagaaataagaatggctgtctaagtatattcagtatccaaaatgttcaaatgatttttccattcaatcatgcagaagagctatcccattttgtagacagttaaggaatatttctgctcatgactgattattccgtcaaacttatctcgcaatgctaaaccagatatttggagaatagaaagaataacagataaagctaatggatcaatcataccaagaaatctgtcatttcattatgagctctcaaaaataaacctagttgcacatatgtttt

SEQ ID NO: 57577 - DNA, 1298 bp, Oryza sativa
cagcgcttggaacggaaccatggcctgatccacaagattccaagaaaaccccattggaatcgcgaggacacgaatcgaacacacaagacacggaacaagaggaagatttgcctcacctcgtagtcctccatgtagtctccgcagagcaggagcaccttcttgggagccatctccgatcacttcttgttcttgggttggtgagcttccctagtctagaagccgagagactgagagtagtacagtagtaatccagtttttatatatgccactgaaggctcatcctcttcttgtcttcttcttctcatgatgcaaactgtttcattcttttgagaatttctttttcagtttttgcgatcgtgatttatcctatctttttttataatgaaattgttactggtattttttagtacttgctaaatgccgaaattcttaattaggagtaacatccaatgttgtttctttggggaaaaaccacaagccgattgtattttacagaaaacattgcatttcaggattactctctcaatcctctctctctctctctctctctctttttgaattttaatttgaattgtaatttttgatctaacggaagaaatacacatgcgccctaatacaattttgaagggcatttgatgatgtgcaacaatatatgcatttggttgttggtttccccgtccagaaaggtgtgcatttgttgctcttaagaaggccatagaatctcacgattgcgttcaatgatcatgcaggcagataatttagcatatagcagtacagtttgcaagggtatacatgtgagcttcccaggagacttaatatactgataatctcgtggtttgcgaggattgattttcagtcctgtgatgattcaatgcggaacattttggtcagaagcagagatccagtaggcgcggcacgatcacgagtatatttaaaagatactaattaagactagagaaaaaaataagctcgcgcgttacaacgggtgaaggttattttaatttagagtaaagtgcattggcagtccttaaactcgtaaggttatgttataaaggtctctaaaatctcaaaatacatatccaggtcccataacttgtcaaagtgtatcatctatgtcccaaattgatacatcccctctagaatcctacgtgacgctgatgtggcaatgccacatggacgtgacatgtctttttctctttttttttcttcttttatttttctttttcggtttcttcccattcttttttttctttttttctacacgggtcatagagaaaagagaataaatgggaaaaaag

SEQ ID NO: 57578 - DNA, 2396 bp, Oryza sativa
tgctgcatgcaacaaaaccaggagaaggcccacagagctcaagagaaaacaacccctactttccgagcaaaatcatcatcgtcatcatactcttcatcatcatcttcataagcattctcgtcatcggatttgtagtcctggccttcgataggctcatagtaggactccccctccctctggtcataattatcagcatcttgattttccacgggatccacctcaataatatcttcagcctcaagtttgtcaccatgagatgaagattgcccatggccctccacagggatgtggccttcgtctctgaattcttcatcgccagatccacttttgtattcatcagaactaattatgttgtcaccttccttctcagcttcagccagagaagcttgcctgtgtgagacctcggcagatttatcttgtttggggctacaggcagatgtgccattggcccatgctgcctctcttttccgctgtaagatgacactaaggggctttgggccctcaaaatcaagcgatgcttcaggctcaacacttccattggccttactggagtccctcgagtttttgcgatgagggaagttgtgtgagtcaggcacatcctttgtcaaatgctggccatctgcattcctggaacctaaagcaagttcacttgatctccgctgggtctgctcttcatgttgtcctgcctccctatgcctggtaccctgaaattccgtgcgcctaactggagacagcctgtcccggagtcttcttctatctcgctctttctcggagcgagtatcaactctgtcaggagatcttccaggaagctttattctgccttgcagacgagagctaagagtgcttcctcgagagctctggtgatgatccctgtgtgaacggtgaccatgtgccctttccctgtagcgctcatccctccgccgttgctctccattgcgttctggactaattgccaatgaagactcatttattcttctcctacggagccgatgacgtaaatccgatccatccatctcgacacggtctctatctctttgcagaaaccttctttctgagtggaaaggccgttccatgctcctctcagatgatctacgccgttttctctcgtagccatcatacatatgtcccatctggtcttgctcatccataccattgaaccgctctctttcatgatgtgcacgaacatcaaaatcagctggagcatattcataatcttccactggatacatatctcctccaaaatcttcatcatgtaaataagcagcaccatctgcatcattgtccacgagaacatcaaaacctggtgaagattcacccaaaagttcatcagcctccctactgttctggggcagatcatctgcagggggcatttcataactttggttccaatctcgcacaggatcactatccattggaaaatggttctggtagcactcaggatgatccccacctgaagaagtagtgaagctttccttaagtgctgctggcgtactactttttaccttctctgacttaggacaagacattgcattggaagcaaccggtattgcaactgtagctgtcctggcagaattaaccgttgaccgatcaacggctgttttgcccctctcattagttattggagcaccatgctgaatggaattagtagactgcacagaatctttaatgcccaacaaatcattcttttgagtctgaagctgctccaaaggtaaggaagaaacttttaccacctgttctgatggattatttcccactgattgtggtccatgataaaatgcgcatctgtcacctttcaagcagtttccctttttaaagtaatagcatggaaccaactgctttccagagttaaatggagcgtagtgtgaagaaactgcaggcattccagtagttggagcaccaaacataccatcaattggctgggtaaaagtagaagacagaattagactccaaataacttcactggacaaaatgaccaaataatattaagcttaataactaggagcaaacaccctgttagtttctgatgaacagaaacataacagcaaatttactagtcttagacaatgctgcttgctggcaagtattgataaaaaaacataataccagtgcataaggggaaaaaggaaggaaagggacataccggatggcgaaacggacattttggattcaagcaattgctatttaaccagtaccagcagtctctagggttcatacgagcattatcactgtgacgaaaatcacattcgttcccctgatgtaaggaacaaaaagaatcattatcaattaaaatattcaagctagaagttagtaacaaatccatgatggacaaaatattcatggtaaataagacacaaaagcccataaggattaatgtagcatttttttagtgttacatt

SEQ ID NO: 57579 - DNA, 3764 bp, Oryza sativa
gaattctgagccgagcaaggattcccaaagagaaacaaaaaaattgtgaagcaatgatcttgaataactagactaataaggatactaacatattgttatagtgctcctggtgacaagggaagcattacaattcctaccttaccgtactactaaaagccatgtagccactgcaatagcgatatattgggaacaaatgcgatagtaaattacattgttttcacttttcacccgaaggagcatcaattcaggacaaccataccattcaaattttaaattatagagccgattcagaatttgacctagcatagaaaccctgaaaaattcaggggctaacaccaagaggcaacaaataccccgaacctgaaggcactacgaacttatattattacgttatctacattaagcatcacatcttggatgagggggaatagccatatgaaaagattccatcttgaaccaaagaaattcgtgtttacttagctcagaaatcaagattcccgaaacgaggtgcggaattcaaattctaagctccaatcgagaaaagacgaattaccaccccgccccaaaaaccaaaccagcttatatacgagggaaaagagacgacgaatcgtcgagagagaacgagcacacaccttcttgcatgtgaggggcgaggcgaggaagtagacgcagtcggtgttgcgccgcagcgcctcctcctctggcgccaggggcctcgcgccggcctccgtgctcgcctcccccgccgccgccgcagccgcggcaccgtccgcctccatggcccccgtctcgagaggagccgccgtcgggccctcctcctcctcctcctcctcccaaccccaccccgcacgaacgcggcggcgggaggacgccgatcgcgcgcgcgcgcgcctccggcggcggcggggagggaggtggggcgggctagggttcggcggtggcggcgggattggatctacgtggaggggaggcgggttagggttgggcgcgacgggggaaggaggggttcgcgttgcgttgcgcccttcgcctctcttggctgcgcgtgtcgacttggggaaaaagggttgggttggtggacgccgcaggttttttttaaaaaaataaataaatagataaaataattgggaaaaggtcggtattataggcaacggcaacgggagggtttttctgtaaatccgatttgggttgcgcttgcgcctctctgtctatgcaataggttgaccgttgaatagcacagtgctactccggtttgagtacctctgtgatgtctttgactcactgctcggtgatgttagtgactttttccatctatttaactcaaaataattttttatttaattatttattcatcatatcaaagtttgtatagtaagacataaatacattgaaaatagataaaaacaacaataattatattaggatttaataaagtgggatattatactatttttatttttgttcgtacgtgcataatgagtgaaatataaatttattttgagaagaggggagtagtacaccactactagtagaacaactctattttacattttcctttttttctctctagggaatacgttttacatttgaattcacttgttcaattattggatttgttcatacggcctagctgtggttgcactacaaccaggcatctagcagcaagcagcagcttcctgcgccatgtgtttgtgcagccgaacggctaagctgtgcaacacagcttaaaacgctgtagcaaaagtctaccgaacaaatccgttaactcatcacaacacccttgtaaaagaatttattatctacacttctcaaacatcttttatggtagcccttgcctaatgtgatgttattgtctccaactataacagggccagcaatgacgtatccagaaaaaaatagcaggatgtctaagaaattagacaaaggaacagcagctccatttccatctatgtatggcaaaaaaaaaattgtagagattatgtgagttgtccataatcctcgcatcaatagtagaggctcgagccacatcactcttctgatagaattgccccaaagaactaggatttacaaaactagtgaaaaccggatggtgacaaaaactcgatttctcgggctggttcgaggacataaaccgcttagtttaacaatcaaattcaaaaaaagttcaaagtagatttttatttttttatataaaaattaatcagattttgtcgggatcaaaaagttttttaaacggctttggtgaaaaagaaattgctccctcttttttttctccttttttgatcgggaacagtttagtactatgtggtcagaaaaaataaggaggggggggcaatcggattgggattcggtgacattccccatgacattctcgtgtcacgggggaatatcacataatcccaatggggggcaatccaggtttcctcgtcagaaaggaggtgcgaaaacaactgcgacagatcgtacattccaatcctttataacggcatacgccgccatggagcctgtgttggatcatggatcccatctcactccacgcgaaagctcccacaaattacagcttcctccaccaccagttgattccctcgccgtcgtcccggataagaaactcggcgcacacgacggtggcaggcggcgcaaggagaaaggcaaacacaaacgagcccacgcaaaacggtatttgctcactctgcctcaaatcttactctcttgccagttcgtcgatctatgtattctgtagagtgaaccatcgggaattctgttctttagatttggatattcaacaacagaaaatatcacaacagtatatgattagcattaataataaaagcaaaatattaggcactacagaaaaaacttcagattgacagctcctctcgaaactgacataaccggacaatcggtgaaaatccagatcctacaacacgaattgaaacaatcctcgtgcgcttcgattattgcagttttttttggttgaaagcatgtagaggaatctcaatacacataaatcctgatacaatatcaactaagtttaatgtctaggaagactcgatgaaacatgaaaacagtggactgccgtgcgagttacaaatcatctaggataagagttaaaccgatactgattcctaagtggaacctacaaaatatcaggtttcgtggttccggtggcctgcaccgaataggtaacagagagttctggaaacatgtacggcgtacatgcaagatacaaatttgggacttctgacgacgtgcattgtcgagagcaagagtgccaccatgcactgcagaatcctcctggaagccctgtgatagtataccaggacatgttagtatgcagagatgaatatgcataaaaagactctaaattaaatttgagtcgtcaattaagatgtgagttattccgagcaataaaaattagagcaaacagacattcttcaacccgcacaatgagaccattttacattcaataagggacaaaaaacacatgatgccaatatgtcaacaactatcgaagtacacaacatgataacagatttactcagaaaagaacatctctatccagtcataggtttttaaggattagtgtgggatttggtaatcgttacaataaatataattatgacatcttaccagaaatggcaccatgttctctcacttcaggacagataccgtggatcatttccttgctttcccatcttatgcacatcctcaggtgaaagtatcttgatgtaccatacactattcacaaaggacctacatcatat

SEQ ID NO: 57580 - DNA, 2675 bp, Oryza sativa
aggaagtataagacagccacttttgcacttgctagtcaaccaaattttgttgatcttaggcacgtttaatatctttaaattatttagatatacaatgaagttacaatgcctgatgtagatttgaaatttttacttagcatgttaacttggccgttttgaggccaacatcaattaagagattcagtttgtagtgtgcacacatggacagggtatgccaagtgtagtactaaaatttaagcagatttttttgcaaccaaatcatagaacggtaagatgaaacttaaatttatattgcttactaaaacttgaatttgtagtgcgcatgcatggatattgattactaaaactaataaataaatcagaattctgagaatatttcttactcccaagggtcgtctccaaggagaagcacatcattctccctgtcgacgaatacaagctgccagcctgatctatcagggtcgtccaattgacccttaatgccgaacatctgacccagttcttctcgaagttcagcataattagagaaccgggttatgtccaacgacctcccaaccgaacctgacttgtaaacctgcaattttacaatggttccatgaaaagaagaatatatattttttggaggaaaaagaggagctcatatttgacctagcaacaatgcaaattatactagttaccttcacaaatgttctggttgctggatcgttctctcctgtattttgcaataaaccagaagagtcgtccaagcaaccatacattgcattctgcagataagttgatccagaagggatcgttgataagttgccatccgaaacattcgaagtcagattaggaaccatgttgtacaggagggatgaagagtcaacttgtggactaaaaagggactggttttgcacatcacgaccaattttgttttcaacagaaccatctttgcttgtgggtgagttatgcaaaaccgagcccccaaaagacactgactgtgaacccataaacttctgcttccatgcctgttgctgctgctgctgctgctcactagctacaggctgattaaatcgagataagtccacagctttcgaacttccctgaaggaagctcgaatccaacatgttatcactactgctagaggtgatgaagcttgaagaattcgcattaggatcagagaagccaaatttttctcgcaaatgactcggtaatgatgttggacttgggagaactgcacttgtaggaacttggtagctttgatctggttgaatcttctgcttctgatcattctgaacttgctgcatttgctgtagttgctggagttgctgttgtatagcacttgggctcaacatcgtttggatattttgggcatcaggattaattatctgttgctggcttgcttgctgcagaatttgttgctgcaataatgggttgaggttgcagtgttcttgaggggactgcataggttgctgaaggtgcaagaattgctgttttaagtaaccaccagattgggaagcagcagcagcagcaactactgcttggtactgatcgtgatcgctgctcagtaaggatggatggagcctctgttgtccccaggagccaataccaggtgactgaaagttcagagactgaaaacctccctcaccagcaactcctctcagccacattaaagcattgctgtcatcttaagtgtgatacagcagttaataaaagaacagaaatatgaatgagagatactagaaaatggaattatgtcaggcagatcaatgcattctccataacaagaatgcacagaaagacaatgaataaaaagaatgcatattatagaacgttacatttgctacggaagagccttatcaaataacattgatccaccttgggtgcttaagaaatggaaggaagagatcaacttttcacttacaccataacttgttttacttttagcctatatgagcattttataaagttccctgatcaatctctgtatccagaaccatcatttgaggcatattgttcacagtagagaacactgacttgaactatagcctcttgctcttgcaccacaatctcaacttcaggttattttagttagaatcatcagctggttgatgtggcaggttcagaaatttattaaggctgtggcttcagtaatttgagtgtgatggctaaaacactatgtaaatgcaccaaataaacttccacatgataggcgcacacacatagcaagcatacagcaaaatagcttcaaaactagtttatgcctgacacacagtaacaagaatcttaagcgtaccatgcagggaagcaactcctgaataccaaggatgcttaactctcagtgggaacagagatggatacattggaaaggttgtcaatggttcaatttcccataaagaaactcttggtggtctttcccctgcagttgattcatcccaaccaacctgaaaatatcacactagttagtggaactgtggaagcaagcactagtgcaataacatctgaaggcagttccatgattgttataatgaaaaccagaggtacagatcataagaaaatgcaactaaagaagatgaagataatcaggaaagacaacacaaatcacgtttaaacccccacagctctttagaacaacctcaagtaatataaaaataccttcacagatctccaataggaactaggccaacggactgggt

SEQ ID NO: 57581 - DNA, 24864 bp, Oryza sativa
  unsure (1)..(24864): unsure at all n locations
attcctgcagccccgggtgtgaaaaacagccttgatgtattttgacagtggtatgacaaattctgatggacttgccctacaaacactctttctattaacggtgtacatggggaggaaaaacaacaatgcatatatactaatttaaaagtccaacttaccgggggttgtagaaaatagtgaaacggctgtttgtagcagcagcatgagctgctgctgcaaggagacctatgtgcatgctatcgcttgaaagaacagaggaaggcatcacagtctgtggccgactggcacgtcttattccaagtaaaagctggtttttctcgttcctgagtcagagaatcaacaatgcgccctactcattagcacaggtaaaaaagaaaatcacaaatgcaagagagatggaaaacaaaccatatgaaaagcacagaatctccagcaacaagtctcttagcactgacaaaaacgctccagccagtggttagcaggtgtcgtttgggttggcctgtcaaaaacagcatattactacaaaagatagtaacatggcatgttcaaaaatataaaactactaaacacaattactaacaacatcattagtgttgagcagatcccatttcataatcaatacagcacaagtacctcaagcatatgtactatcaacatttatgttaagacaacatttttttagttattgtgatcaatacaaagtacattctgtgtcagaaaacacactaacaataagttcaaccctgcagaaagatgggaattcaaggcatacaaaaagaagcctacaccgagaattatactgtccagtacagtgattgctcattgtgcaattttgtaagacctgcgaactctagtaaatatttcagtacgcctctgaaagtatcatgtattcatatgtcaattgtaacttgatccactgctaactatcctaacatattaaaatttgatattttttatgtgcttatccaattaatgatctcgtaacttcatttctatgcataaccctaattcaatcaagtatctcttgctccattcacaccaactgatttttaagtgaaaaagacgcttacatcacattgtgtgagaatggttgaagtttttctcagaacacttgaaaacgtttttattaggaaggttttaagccatgattacaaagggtgaacttatcgaatggaaaaggggcagagatgattattaggaaattccctttaagaatatcataattcaccgttatgaagaattcaagactgccataagctctacagatttttaagaagttacctcgaaagatgtgcctgaacttccactcgatgtcatgaatatcccgtgcaattagctcctgggctggaggctgctgtgtgaaatcctacaaaccacactataccacctgttattggcaacagcaaaacccaaccacccaagaagtacaagaaaggagcacagccccaaattacaccactcatcacaccaaaggagggaagacgcgctcagcagcacggcggggcacggagaaccccccgtgcgtgctggtgtcgctcgccgtcaatgtcttgcagaagtaattcgtcggctgcttgctcattatccccatctccgcgggaaggtacgcatcgttctgctcctgctgcacgaatgaacacatccaaaaaaaccatcaaattaaccgcttagaatatttcacgccttcaaaccatcaaaacctcagcactgcaaacatcatgcaaaaaccccaggcgccttactgggttcagtggctggagcgtcatctgcgcgtacacctcgtcagtctccacatccgcctgcaaaaaaattgccagcccaagtcagcaccgacagccatggagataaaccggaggagtggagtggaggtgacgccgcatcgatctgagaaatgccccgagaaattagggcaaggaaccacgtacatgcattgtgacatcgtggagctggcagatcagctgcgccggcaggttggggtagttcgggatgtgaccctccacctccttgttcgtcgacgccgccaccttcacgtatgcaaagctcacccgcgtcagaaacaagagaaaccagcagagatagagagagagaagcaaagcaagcgcgcccacgagacggctgaggaggtgagctcagcctcacctgctcgctgtggccttgcgggaagtagacgacgcgcgtgccgacggtggggaggcagacgagcgggccggcgcaggcgtgccatagctccgagttgaggcacttcttctctgcagcagcagcagcagcagcagatcgagtcatcaaccaaacgagaagggaagtaaagcgaaccgcgaagcgaagcggcggaaacaaacctagccacccaccttcctcgggcggcgcggggggcggcggcggctgcggcggcccgatgctggccgccgacgacgagctcatctcctcctcctccgaccaaaccagagaagcacaaactcttaatctatcccctcacaaatccacccgaaaaccccatccccctcctcaaatcggccgcattctgcaccaccaccaccaacaccaacaccaacaacaagcatcaacaaaccacagagcaaagcaaagcaaaatcaatccaacccccaccccgccggcaagggaccaaccaacctttctcttccgctcacccgagctcggagatcgccaccatggtggggagaaagggtggggttggagagagagagagagagcgcaagaggggtggaaatgattaggtttgtggcatttaagcgagagagagagagagagagaaagagaggggttcgcgtggttcgagtagtgcgagtgcgtgtgtgcgtgtgcgcgacgagggggggcgcagcgcagggggccgtacagtagcgtgagctcccgcacagtgtctgaagagtttttaaaaagttgggaagcgagggggttttgaaaaagccgtattttatgggctcatgtaagcggctgtcgggtcggtgtaaccacggccgtaagagcaagtttaatagtataatagtatagttcactactagctttaattcatctataaccaatttaatagctaattcgtacaataattatttaatatattattaatatatggtctcacatattacatatattgtgtcttgaagttcgtgctgcagctggctacatatctatagcccgcgatcacttatcttattaaaatatgtttatatctggctaatagtctgctattatatatgctctaatggtgatgagagagatccatccaccatcccggcatatgcagctctccatcgcacgcagcgcagactggtgttcccgtggggcaccactgttgtatcactggagtactactaccgttccttgtaacctgtagcccgtgttggtttgtgaactcctccccgtctgtgttacagctagtactgctcctcctacgtgtttgtccagtcccgtcctccagattctaccggtatcatgaagtattgatttcattatttgggttaacaatatggtcttatggtgctaattttgttatatgttcccttcgtcctaaataaaatcaacttctatagtttaaattttgtcccataaaaaatcaacttctaccatcctacctaaccttggcacataaaacgaaaagttttctcccttaaaaaccctttacctacctttcaacattactatttttttcaataataaaagggtattttagtcatttttactcttcactagtctcaccttagcatgataggaatgggttttatgtgggacggagggagtactcctactacatagaatgttaatcgctcaacagaatatattcaaccaggtgtaggcaatattttatatacgtagagctccggtgaacagagaggggagcattaggtatcttgggacatactttctcgatgcgctgactatagtgcttacagtctgtctaataaaagccatggtaaaagtaggaacgggtccatcgagttagtacataaatatctcgagacattactttctatgttaataagagacatatattataggtataaaaaattatgtacttgatgcttctattttatgagttggaaatcacaattagtcaaaaataccataatcatgacaagactaatcaagtactatctttttttttccacttaaagagctgcctgcggattagcgactagtagtacttaattaactgggagccacttgtgatgcttatataatcagtccttgtatgcttgtcctcctacgtacacatatgtttgattacagctaaccttgcctccttaacccatgtcgtcgtcgtcatcatcatcatcatcatccacaccccaaacgggcaacctgtcctagagcctttgattccacgagtccggccggtttttaccatccccaacaacagcaacgtaacgtcccctacgtgacagcgcacaaacagggggtcattttttaaaaaaggaggaaagggatgggggtgtgtacgtacggagcaatcttgtcacatcaacccaaccctagtgtgcgcgacatgccggtcgtaccgtgacgtgaccaatccaaccgtgaaagaaaaagaaaaaaaaagaactcgagattttttaatttttttatttttttgctcttgtcgaccactgcatgccatgtccatggcgtcctcgtcctctttcgccgattaaaaaaagaagacgcgacatagacatggaaaacacgtttgactcgtactacatggatgacttgacgttacgtcgcaggaggggaaaaaaaatcttttaactcgtcgtaagaaaaaacacaagtggaatacagaaacacatttaaagtattaaatatatattatctaataacaaaataaattaaagattttgccagaaaactgtgagacaaatttattaagcctaatgaatccatatttagaaaatgtttaatgtaacaccacattatcaaatcatagcgcaattatgtttaaaagatttgtcttgcaatttacacgtaaaatatgtaattgattttttttcacgtttaatactcaatgcatatgttaaaacattctatgtgttgggtaaaaaccttttttttaaaaaaaaaaagaagaatggtactagtcgaccagtgtacgttgcatgcatttgcccctatctactgatcgagtgaatattttgcccgtagtttcgtactcgtgctgtgcatcggattagtgcataagtactttctaagaatttcggattggccctcttgatgatctctcgctttctccatagctgtacaagcctgttcgatcgctgtaccgatagtaacactgaaattgcttcgacgtgatcatagtcttcattgccaagactgtcgacatccctatatctgtagattgacgtcaatatatatggatgggagtcttaatttcttgatgttgttgtgctagctatagcttccaacgtctgcaaaaaagatgagtcatgttaattatggtggtaatgggggggtgtaaagtgtaaattaaccttccaaaggaaatgtgacctgaaaagttgatgacaagtgaggctcatgctttatatcctacttacctgggtccaaactggtaaagtttatggcatattcaggttaatcttttgtgttatgttaacccaaaaattaaaacagaaaagatcatctcagctccaaacgagaggctccggagccatccgtacaaatgagcttttgaccgtgcgtatcaacttaaatagcttgacaaggagtactagtatgaattgggtgcagcagttcagtgtactggtgctccggcctgcactacagtactcctatgtactgtatgtactgtacgcgagcaagttgggtttatttgttgagaatgataaagagtgggagtatatgcttttatttaccttgggtttattaggatagtagactttgtaccagctagctgctctattgatcaatactcctatgtttgttcccagaagtgcagatgaacagtaaattatcagcagaagttctactaattaagatatggaccagtctgtgtacactctatacagctatattttgttgtgtagccgtatttttcttattaaaaatttggaggatcaagactgagattagggacagaaggaagttgtttagatggaatctccctattttaatgagtaagtacagttgcaacaaatatcctaagacatggagcatggtagctggatttcatcagctagcaaacatatccagcgcctactatcagaggatgattttctgtttcccatcactggcctgcgtccacgattcctgtcgcgtggaccgagcttaaacggggaacatgggcttgaaaatgtggtttcctgtcacacttagccgaactaaactttagacaagcttgactatttgtgtctcgacgtgtttcacggttatagcatggcatgcatgtcgtgccatggtatacgtttgattagtcctctttactctttactatttgcgatagtactctttttaatcacagatagtatttgatgtttttgataaaatttaatcaaactctttcaacttttaactattaataatctcttaaatatttagttttaaaaaatgatgtgtagattcgtcttaaaaactaccaccacacaatattaagaaattataagaatttatacactataactaatataaaattaacaataaaagttaaattaaatcttgtcctgtaccccttttttttctttttgataggtcaaacatcaaatatttgtagccgaagacagattgaccatctcatgtcaaattttggtagatgagttaatataattaacatcagttttataacaccaaaatccgagtcacatgtctgctacatgcatatggctcactgagaacgtataataggagttttgtacaagactactgtagttattatttcaaaatccatatttttctacctctaatactaagggcttattcgtttctgagtttggtaagacacccatgaaaactcattaacatatgattaattaagtattaacaactatataaactaaaaaaataatttatttaaaatttaaaataaattctatatagaaatatttagaaaatatatcatttagcaagatgcatgtgaaacgtgccaaggaaattatcgtttaggttccagttgaatagcatgattgaaaaacaaagtaatagaaaaaacacgggattctaacatgaatgtaagtgtaaaataaagaaatgaaaaacatggaaaaaatataggaatgatcgtttgattaaaccacatgaaaaatgtatgaatcagataagagggatagactcaaagaattttttttaagtggttgaacctcctgctaacttttgttcaaaatctttataggattacttatttcataaaaattttaaagaataagatatgattaaatcatttgttacaaagattttcatacgatcgaaatcatccaaaaaaattattttttctgaacagatcaatggtatatgtagctaggtggcggtccatcaggtggaggcggtggacggcgtccaggaaggaacccggcgccggcgggcgggacagcgcaggaacagcaccacccccttctgaattttccacgctcaacagagccgggggagcagcgcgctggcccaccccgctgcgccaaaagctgcgggctcctcctcctctccaccctctcgctctctgccgacgaccaccgtacgtgcgcccctcctggccatcccctgcgctgcgccaagccaccagcttgcacccgttcaacttcaactcgccgcccatggctggccaccgcgcgctggcgtggctgatgaattcgcagcacgcacaggcacacagcagcggagcggcaagcctcttagctattgcttgactagactagctaccactcgcttctgttccttctgtacccgcgcgtgcaggggcatgactgacgacgagtcatgctcatctcgtcgcgtccgtctcctacagctacagccttattcctcccgttcgatcggttcgttccatgccgcactcgcgcgtgcgtgcgtgcatacgtgggcggcatgtgcgactggggcgcccgtgcacgtgtgcgatctgtttgcggtgcacatacccccgagcgtgtcctcacaaagctagggattcggatggccaatcatcagggtttctgtggaggatcgccttgaatttacctgtgcctttgtaaccggtggtaccacacgtactagtgctactactacttccggccacggcgttaactgttacatgcacgtgtctgctgcacggagcacatagtagcctcctgtttggttgtctacacggagtggcatcaaattcagtttgattatcttatgaagaaagcttgtagtaaccccacaattgatcgatcccgggtttctcaagtccaagccgatgcatgatagatcgagcaaatatatgccagtagataatgttttcgagcaaagggcgaagaaagttggcagcccaaagttgggcaggttcacagccacaaaagggagaagcacgatctggaaaaagctacccacaatgttgggcggcacactggatcagatcagcagtcggcccgtgtctccaagaaaaaaaattgaaaaaaaaaaagatcgatcgatcactactcatcgagagcccacgaggccccaccggccactcgcgcagtcgcaaacaccaacaccaacagatcacaaaatggtgatccatcgatgagatgagagggaaaagcttgtgtggttttttagtatggtccccgtattnttnnannnnccccccccaccccccccccccccggggcggtcgaggcaagttgccgtgcaccatcccccaactttagcggcaaaactctgaatgattcgtccataattcacccagcacacatcagtgagaagctatagcttagcctgctgctccaggaggcagcatagatctccgtctacgtcccgttttgctcttttgctcctggaggcagcagctgcaacattagtggtactgatcctagctactccagctagccatgcatcctccagaataataataatagtcaaaattctcctattgccacaacacatacggctgttggtctctttcttcttacaacctccgccccaaaatacccaaaatatgagttttagatttgacatactaggtattaaaaaagtaggtaaaactaaacgtgtaattgttgtgattggttaaaagagaaggtaggtggggatattaagaggtggaagtttgttattgggtgagaaaaaaaataagttgttatattttttagataaatgttgaagtctataagttactccctccgtcctaaaatataagaagttttagagttggacacaattattaataaagtagttagaagtgaatagtggagggttatgattggatgagtagtggaggtaggtgggaaaagtgaatgcactactggagaactcctcatatctcccggttcgcaaccccctttactcccgggtagcgaaccgggagggagaatccgggactaaagatgtcggtttttaatccctgttcaaataaccgggactaaagatgccaggccagcatcgatcgctacttttttttattgcctttaacattgaatattgatttcactccatccccaaatcaccccaaataaatcatcacagattacaaatccaaatcacataacaaaaattatctccaaatcctcaaatcgatcatctccaaatacaacacaaattctaaaaaattacatcacaagttctacaaaaatcatcacaaatacatcacatgaatacatcacacacaaatcaaatgcatctcagatctccaatcacaaattatatagaaaaaatcgctgacccgccgcctgccgccctcccggcctcctccgcgcgcgcgggccgccgcctccgctgtcgccagctcctcgccggctctatgagaaaagaggataaaactgtgagagagagagagaggggaggaggaggaggaataggaagataaggagaggataagagcgaggaggaagagtagatagaaatttttgaggatacgtgcaaagggattatatacggtatattgatttttactccaggttggttttaccaaccgaataccaatcgggattaaagatctctataaactttagttccggttaggaacaacaaccaggactaaagttaagatctaccaactaggactaaagatctttgaggacctgatagcctctgacacgaggtgaacctggattaaagatcacatagtccccttgcacaaataaacctggaccagagatcatttttagtcccggcttttcaagcaaccggggctattgtggaaatcggccgacccagcaaagatcacttctccagtagtgatggtggagggttgtgattggttgggaatggaatgttaacggatatgttattatattttgggacagatgaagtattataatttggaacagagggaataactcccagtcaccaaataacaatgtttccgctcgcgttgctctgatttaggagcagcgaaaacaataattcgagctatcccaggaatctcctgtggatcgccattactactcccaggaaggagtacgtctcaataacattgttggtgtactacctccattccatattactttttaagtttttgtttgtcaatgtttgatcattcgttttatttaaaaagttttaaaattattatttattttgtttgtcatttgctttattatcaaaagtactttacatatgacttatttttttatatttgtactaattttttaaataaaataaatggtcaaacgttacaaataaaaagtcaaaaacgtcatctattatgggacggagggagtagcttgcgttggtctgctagtactaggatctgcccaacagggaacgtaagcctagtttgctcggtgacgcaagccccagtagcctttgtattgattgtacaagtagtacaggagtatacggagtactcctatatactagcactacttctacagtagcagtattggtagtctaggagttagatcaatacaagtgattagtttgctactactcctagatgatatgacatgtaatagtccttcaaaggggaaaaaaatgcatgtttactggccacttttaagatgataaatttaaagtttagaacttaattttgaagtttcatgacttagctttaacatttggaccactaaaaagggtgtaaagtttttgcctaaatattactaccatatatgtttagctgttttggtcacatgtcttctattaaaaaaaattcgaggtcttgataatttaagtttgaaggggataattaatacttaccgagcatgcatgtatgcatccttgatcctactaggaatggctgaggacaacttttgtgcttgggagcttaagatgcaatgagccaataacatggcatccccatgaagaggcacgatcacgaattgtggatctacagcaatagcctcgctaaataattgctgcatacttgagaaccaacaccttatgcaatcccagaaagtgctcgtcacacaccacccaacaagcgagtcagccagcatccccaagggaaaggaaagggcaagttcagtggagatgtcccgttaacccgtccaaaaccacaactatctcgtagactcgatcgctttgcaaacctgatctgtgctcggggcatcttccgtttcctctccctcctggtgtccctttccttgccttcccgaacatgaacatgatttgataatgcagtggcattggttggcgtcggctcttcgtggttgatctagaaaaccaagaaaaaatgcgatgaaaaaacacctaaaaaatttaaaataaagtttgaaaatttaaaattttgctgcggtttataagccaataagcaacaaacgaatcaacgataacactttttatatctctctcgatttttccttctttcttttttcttcggttttgctatttcacttacgatagacttttaggtttttatatttcgtatgatgcacttacacttacacttaattactcctacatagcaattacgcttagttacagcacatttacactcagttaaaagtgcatcaaaactagaattttacaaatgtttttctcttaatttatggatttttttttccttttgggggtgtgtgttgaaccacatgcaccgcctactgcgtgcttgggcaggcacgccattgatcagtgtggttgtctttgagaaaaagaagaggggggatgggggaaaaccgaaaagaaaacgctctcaaatcgatcagtggtggctgatgggtcgatgccgtgcgtgcgtgcgtgcgtgcgtgcgtgcgtgcaactggagtatgtgtagtatggtggtggtgcggtgggggcggcgtggtgatcgatcggccaacttttggccaggtgcgcggcgcagtggggggaagcggcaccgcgggctgcaggcacacacaggctttggctgctgcgagtgtgagaccccaacatggcaacgcatcgcatgcatgggtgcatgggcctcctctcgcctgcgctgcgccactgcgcccactgctgctgcttggcttgcctgggggaggagaggacttgccttggcttcgccttggcttgagttttgggattagcgctacctccgtcatatcgtagatgtcgctttgactttttaattgtaacgtttgaccattcgtcttatttaaaaaattagtgtaaatataaaaaatgataaatcatacttagaatactttttataataaagtaagtcacaaataaaataaataataattttaaaatatttttaataagacaaatgatcaaaatttataaataaaaattcaaagcgacgagtatcatgagacggagtaagtagaaagcaaaagtagccacccaccaatccaccatcactataaacccgccctctgagatctgctccctcgtctgcaccgcaatgcagtccatccaatgacgcactgcgtttgcaacttgcaagtcgcaactacatgctggtccttgtagagagagaaggagagatggaaatggtggctaaagaacaaatcatttacctctcaaaaagaaagaacaaatcaatttttttttcatatcactactactatagtagaagtagtacaactctatacatggatgatggatcgtccaagctttggattccagggcaccgtcggatgtgccccgagcacatactatcagcggaccaaatgttgtaccaacgtgatcgaggtgtgggtcacccgctggcgtggcggcgatcggcttccgcttgccgcttgcgctgtgcgtgcgcgtagccgggccgaggggcaccaccaccattgttgcggtcgagagtccttggtggtaataatggtggccggagaggaccagagagagatgttgcactgcatcccctctggccccctgcatcgtgagatgacaatgcaatgccaatgccattgccgccaagtactactgctactgctgctgctgctgctgctgctgctgctaccggggtcccccacccagccagcctgcagcctgcccctgcttccgtgttgcattgccttctcctatgtggatgggagatgaaattattcccatggctccctttttccgatttactcgatatagagaaatttacttagggtgtgtttagttcacattaaaattagaagtttgggccgtgtttagtttctccctattctcaactttctatcacatcatatcacatcaaaaactttcctacatacataaacttctaactttttttttaaactcccaactttcttcaaacttttaacttttttcatgaactaaacacacccttggtttaaattggaacaatgtgacggaaaagttgaaagtttatgtgcgtaggaaagttttgatgtgatggaaaagttagaagtttgaagaaaaactttggatctaaacttggccttaggccttgtttagttgggaaaaaaatttaggtttgattgtcacattagatatacgaacacacatttgaagtattaaacgtagtctaataacaaaataaattacagaattcgtcagaaaactgcgagaagaatttattaagtctaattaatccatcactagcaaatgtttactgtagcactacattattaaatcatggcgcaattaggcttaatcgattcatctcgtaatttacacgtgaactgtgtaattgtttttttttctacatttagtacttaatgcatgtacctgaacattcgatgtgatgggtggaattttttttcttttgggaagtaaacagggccttacacgatcgactagctcgaagcctcgaaggcgaaaccccacgctgtcagtgtttagtgcgtgttattgcctctgtttggcttactgcacgctgtgttctggttgatttttatgaggtgcgaccaccaccatcttgtacaactaggagtttgtgtgtaaaccgatggattcagactacgtgggggcaagtacagtctgtacagattgcagaggtgaaaaagaggagagaggagcgagagtctgcactgcttaagttttatgggacaggagagaagagctttggctaaataggctccacagtgctggatcgagatctaataactttacaggcctaatccactccacgtaggtaaggatgcccgttgctaagattaagatttagcggtccaaccaagcacatatatatagttatcaaaaaaagcaaccatatatacgtacactacacaagtgaagaagtgtcgtgtgatactcgaaacagcagggcagcaggctacagcgagcagctgtagtcgtacgaccagcattggtcaggtgttgctgttgttgagcttatctgcatctgcttgtagttcccgttttttggcccaaccagtggaaaataccaagagaagagaatgcgaataggcttattttgggccgagccgctcgcgtgagaataggccgaaaggccgccagccagccacgcgggctttgccgttcggattcgtccggctctatctcctctccccctctttacgccgcctacgccgagggcttgcctttgcctgtgatgtgctcgggttcaacttgagggagcgaggccggaagaaaccattaaccatggagccgcgcgcgcgacgggcggcctcgccggctaatcccctgcacgcgccgtcgattcacgggtggtggttgatctggtacgctgtaccacgccgttctctgctccttccgtgtttttcctctgcactgtagaacggtcgacaattttgtgcatgagcaaaggagaggcctatccagaataggtcatagctttttttaaaaaaagaaaaaaaaaggcttgggtactacaagttcccttctaaacttctactcgcttcaaaaatattttttttaaaaaaaaacctataggaaaattgtttcaaaaatcaaattaatccatttttcaaatttattttagctataatacttatttattcctgttctaataagtatcctgttttacctacacgaaaaagagttcccaacctaaatctttcgaacaaatatgagagaacagcatgcaacgtggaagaaatcacccctgccaaagcactgcagtgccagtactgaatgctggcaaggtcaaaccatcagccaaatgaagacaatggagctactacaagatcataaaagataaaaccatacagcaatttaccagtataggctgaatgaattccagaacaatgtaactggccataccatctgtatctgactctgatatggcggtgctcgcattctgcagcgctgcataagaccttgatttctcatattttacatgcagtgagaaggatcagatgtgaaaaatggaaaatggacatataagatagcactagctggagcaaatcactgaaaacaaatgccccacaaaagttcattcataccatagcagtagctgaaattacagaacatacaataaatctgtagaaaagccggttatgtaactgctagggtgttatcctgagggtttaaacctacaatgcattttttacattgtggtgatcttgcaaccaccttatgaagaaaggaaagaggatgatatgaactattacttgaagggtggcatgagaaggaaattgaactcttggcatttcacgctatgtaaatattatttacagaactaatcatcttaagaaactatcaggatggatcttgatcgatcaaactgaaaccatttaagaacttgactgaaccttaaccttcagcgatatggtcaagccattcgactagctgctgcgatgttggtcttgacttaggagcagcagtcacacaaagcagtgctatctccaggattctgatcaactggctttcattctccttgtcatatatggttggatcaaatacttcagtttccctgtcttccttcttcatctgaagcacccaggacactacatctctgctcccttttggcctgcacatgtccacaggccgccgcccagtgagtagctccagaagaacaattccaaagctgtacacatcacccttgtaagtagccacaggtgactgcccatattcaggtggaatgtagcccaaggttcccactacatctgttgtgacatgcgtctcgtatgcgcatatgagccttgccaacccgaaatcagccaaatgagcttcaaagttctcatccaagaggatattgcttgacttgatatctcggtgcaatatatggggctcacacgacaggtgcaagtatgccagcccccttgccgatccctgtgcaatccgtagcctcttctgccaatccagcagggcaccaccatcagccctctcatgaagccagtaatccaagctgccattctccatgtatgcatagatcagtagtctgtcattgcctatcttgcaatagccttctagcagaacaaggttgtcatgctgggcacgtgatagtgtttccacttcagcttgaaactcccgctcaatctgagagtaatcgcctgaaagccgcttgattgcaactctcctcccatctggtagtgttgacttgtaaacaagtccaaaaccaccacaaccaactatataggcttgatcaaagttgttggttgacttcaatatatcttcaataccaagatccttgttgttctggaaaagcagcaccaagcttgagttcggagactctgagcagtcatcagcattcgctactgcctttggattatgctcctgcattcttgaatgaataatccttgatataaccacagaagcaatacacaagacaaaaataacccccactgcagtaccaagtccaagggccacaagggttgctttgttcttcttacgatgtggtgcttccgtatcaggagaattctttgtgctggaggaattccgaggaaagtgtagtgcgtgattgcctgcaaaatcctcactagtgaacgtggagaattggcctcctgccgggatatctccagacaaattgttgtacgaaacatcaaacttggacagaaagttcagcttcgttagagatgatggtatgctcccactgagatcattgtgggctaaatccaatatttccaagctcgacatatttgataactcatcaggaattggcccagaaaaattgttaaagctcaagtccagcacatgaagcttcactagacggccaaaggctggcaatattggcccaacaagcttgttatttgagaggatcagtgatgacgggaagctactgagttggttgtactgcaagcctttaccagtggaagtcgaattcttcttgacgaataatgggaggtctcctgttgacgcctgcccacttgagccattacttgaaattaaactcttcatctgtgtaaaggttgcaggaagctccccactgaatgagttgttggacagatcgatgtagaaaagactgtcgaggttgcctaaccatggcgggatctccccatgcaaattgttccatgaaatatccagcacactgaggctcttcaagctctgcagccaaggtggaaccgtgcccaagagtgcacagttcgccaggacaagaacctgcattctcttgaacccttcgatgccgtccattggcatggtttcaccaccacggaagttattggtgagcaccaagctagttaagttgggcaggtgctgcaagacttgcaatgctgatgacaagttggtaaaaccattccccgtaagagaaaggtatgacagtgatgtcaaattcttgaagctctccggtagctccccctgaagcttgttccttgcaaggttcagcgtcctcaactcagtgcacgaggcaaggcgaggcggtatagcaccacgcagcttgttggtcccagcatcaaagttgttcagcctcgtgagcaatctgcagtcaatggtaatctcaccggacagcgaattgttcctcaggctgaccactctaagcatcgggcagctcgacagggatagaggcaatgtgccattcaattggttggaagccaagtttaaggactccaagctcctcaatttcccaaacacatcagggatattgccattgaacatgttatatgacaagtcaatctgcgtaatctcagtgaggttaccgaggtcgtcgtcgaggctgccggagagcttattctcctgcaaacttagttttctcagcgctggcatcatgtacagatctttggggaggctcccagtaaggccattgccatcaaggaagaggtcgttgagcagcttgcactgaccaaagccggccggcacatcaccagagaaggcattcgccgagaaccgcaggaccttgaccggcgaagcgcagagcgcggtgacgttgatgccgccggagaaggcgttgccggtgatatcaagaaccgtcaggttcggcgcgccggggaacgcggggtgcggcccggtgaacccgttggaggagacgttcaccacctcgatcgccgggaagccgcccgccgggaacgcgccggcgaggccgttcgcgctgaggtcgaggcgccgcaggctcggcagccggccgagccgcgccaccgcctcgccgccgcgaagcgagttccgggagaggctccggttggagagatccagcgccaccaccctcccgagatcacaggacacgcccgtccacgagcagcaggcggcgtcgccggggccccacccgaccatcccggcggccttcgtgtccaggccatcggagaaggccaggagcgccgccaggtcggtggggtcgcacgtctggctctcggagcggccgccatggacgtggagcagaacggacaccaccaagaaatggaagaagcagtagtaacctctcatctccgccgtcgacggaatcagaaaatgaaccccttcttcctgcagggcatgaacaacttcaagaatccaggaaaacaactcacaccaccttgcaacgaggcagcatgaatctaatcaccaagaacgaacacgctcgcaagagtcaagactcctcctctgggcaagaaatccaggagcgcaagaacgggaaattccctctcattccgtccgccacatgagctggatcgcaagattgtgaggcgccgaaagaggaggatggcatcacaggaggaagaagaagaagaggaggagagtgggggaaagtcagacgagagaaagagacggttggttttgactccaatgcggctctcatcagcagccgttcttcttcctcccaacctcttcaccagatttgtttattcattcatcgcaaacttaaaaaaaatcaatttcctctctctctctctctaaagctttctcgtgtcctcttttctctcactcgcagactcgctcactggtaggccgcaccagtgctagttgcgcatttgatatggtgacgcaaagcaaaggcgggggaaatttaataagcggcgcgtattttagtggagaaaatgggtgaggaaaataaatgccgggtacttcgtgggctgcttggactttgaagagagatagactgagggggtgttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttacatcgaaacgtttcaacaccagtataaaatattaaatataggttaaaaaataactagttgtataaaatacgactaatttatgagacgaatattttaagtctacttgcttcatgtcaacacccgtataaaatattaaatataggttaaaaaataactagttgtacagaatgcgactaatttacgagacgaatattttaagtctacttgtttcatgttttgacaattttactaatgatggattaattatgtttaataaatttatctcatggtttactgacgaattatgtaattggttttctttgtagtgtatgaactccccatataacaccttatataataccttatatgacacgttaaactttacaccttgatctaaacaccctctcttgggccgtgtttagatccaaacttccaactttttccatcacgttaatctatcatacataactttttagtcacatcgtatcaattttaatccaaactagtaactttggaagtacctaaacacactcttgaagaataagagaaagagaaaggggcaggtcagagtcaagtcgatggcgactgcaacgggtggagcaattggtggacgggttactgttaccactaagctacgagtaacgacgggtctgcgctgcaacatcaatgcgtggatggatggatccgatgctgctgctggtggtggtagaactgtggagacagtagaggattatttttccccgatcatttcacacatattaatacatagtaataaaaagactacaatatatgtattttggcctggtttagttcccaattatttcttcaaactttcaatttttccattacatcaaaactttcttacaaacacaaactttcaacttttccgtcacatcgttccaatttcaatcaaatttctaattttgacgtgaactcaacacactctttatcaaattatattgtaactattctttatttatctattttcaatgtaattattctctgttttcatagactccaatgtaataactatttaaaaataaacttatttttggataaatgggagaaaaatgaatttactatgaagcgatgaactaagtggtagtaactgttcacttgctcagtattaatatgagcttttgcttacgctgggagaaccaagaacagtggagtataatgtccatcttttttttttaagaaaatgtcatgatacaaattcctgtgttttaaagaagaccaccattgttgttggaaaatatgcaattttttatgtagttgctgaaaatgttcactacatgtatgcacaaaatttactgtggttttagacctggtttgatgctaaattttgccacacttccgatcagtttttcttcttttgggggaatcgtatttttttttttggattgacaattgtgctagttcttttcattttcttcactggataattttttcctaatgctgtatgtttggactacatgttctaagctactccttccgttccaaaatattactaaaagtttttgttggatgagatatatcctgatactatgaatctcgacaagtaatatgtccaaattcgtagtgctagtatgtgtccaatccaaccaaaactttttatattttatgatggagggaatattccatatactaagtatatttttaaaatatttaatttatcactatgacgaataaggccatgtttagattccaacttttttttcaaacttccaacttttccgtcatatcaaaattttctacatataaactttcaacttttccgtcacatcgaactttcctacacacaaattttcaactttagagtcacatcgttctaatctcttcatacttccaattttggtgtgaaactaaacacaatctaacctgtttcacgctgtcttagttaatggctgccagattaatcctacattgacgaattgatgagatactagtactacgttaaacgctatggtcatttgcagaatactcctactactctatcctaaaaagaatccaatcctagtaatgaatctgaacacatatgtgtctaggttcgctgctagtattggttttttttttatggaggggtacacttctagtacccctggtacgtactgctgctcctcttttggttttgatatggacctttgcatgcatcactgaattctcttttccatccgctgaattttgtctgcgtgtaggtaatgctcgtctttatgaatgtgcagaattttaggtgaatggctggctagttcagctgcttgggacatccaagagtaaagcatccaaaggcaaagtcagagctgtgtccagcgaaaaaaaaaagattaaaagacgggtcgtgaaattgaaaagatgagaaggaatgaaatggcaaaaggaaagtaaagcgggaaggtccaagctaggcagtgttaggctcagggttttccaaaccaccgaaaccgggattaagcacggttaccgcgcggtaaccgtataaaaccgtgtaaaatttatcaaaaatttaaattattttttaaatttatttaaatttaaggaggttaccatgatatttctattaccgtacctcgcggtaagggcggttaccaacggtaatgtaaacgctggttaggcctaccaattaccttgctggcgatgcaaagattttactccagctggtactccaggtaacaacgctagataggagtatcaaagttgtagattctggtacagtacgcgaaaaattgtcctgaaaacatatgctactccactattcaacttgttgtaacgtggaaacaaaaacagcaacagcctattcaggttgtgtgtttgtcgatgttgttgtggacgataagcggaggacaaattatcatctgcatttggctagctagctgtccgtgcaacaaacgaactgtagacctaaccgatgctgctaggtgatcactctgtcagtcacggagacagacttggttgttactctaccggttgttggattttctcaaccatctttgtggcaacagttcgttgataatcatttttttttcctttggagaaaaaaaaaaggggaaaaaacgcattcctactttggtcaagcacgctcgtctacttggcgcatgggcttaaacgccttcgctgtggtgaacagttggacgtacgcatggcgcgagacgccgtggcgtggcgtgcgcgtgccgacgcgtggagggcgttttccgcgtgcgaacgaaacgctcgctcgtgcgccgcggccgccgcgccgcgcgccgaggcgaggcgagcgagcagccggcgcgcgtcgcgcgtcgcgggcgcgtatgctacgtatgttcagttcgacgcgcgcgttgcgcgcgcgcacgccacctcgtcggtttctttccgcgccaccgctcgcagctcgcctcggtggaggggtggatctcggggcctatatttgttctctgactcccatattcgtcctcggattcctcctctcgagtcctatattcgtcctctaggattccatattcatcttctagggtttcatattcgttctctggaatcccatattcattttctagggtttcatactcctcctctcgagtcctatattcatcttctagggttttacatgagtcagctcaacccatagggctcggttgtttgagctcattatcttaacgactctgctcggttcgttagcgctaacaagctataaaagattaggttggtttggaagctactcttttttttcacattataaattattttacatcttttgatcaattttttttaagtttgatcaagtttataaaaaatatactaatattttcaattcaaaagaaacatattatcaatatatttaatattaactttaataaaactaatttggtattatacatgttactattttttttataaatttgatgaaacataaagaatattgactatgaaaaagtcaaataacttataatataaaacagagagagtagctagataaattcgttaggctatcgagctatacctctaagtatatatgaagactatgagttcaaatcaatccgaatcacgagcttttaagtttttttttgtccacacctacctcggtggctggcttggctttgctttttccgcctatattctttgctccgccctgcaagcaaagcggcttctcaaattgcccatgcatccgtttccactggaccttctcctacgcaaattgctcatgcatctgtttccactagaccgggcacgttttcgcgacccgtttttggaccgattctctcgtccgttattttcagcgaatttctctagaaacggcgactgcgattcgggccgtcctatttttactcggtctgaaactaagaaacacatgcatggacgacgttgctagctaatactaatatttagtattacacggtttgacactatatattcacaacaaattaagacgactgtatatgaaagcgattaaattagtgaggactcagggtcgacccggttcttcatttctttgcatcttattcaccagaatattgaaacggattgtttgctcatatttcaaatattatgttttcttaaaaacttccctttagcttagaccatttattttaactagggctgcaggaatt

SEQ ID NO: 57582 - DNA, 3265 bp, Oryza sativa
  unsure (1)..(3265): unsure at all n locations
ctgcagtctgaacatatatgctactatgcctcaaatgctgaaacattgaagaattgaagcaaagccatgcttactgctcaagttatacataggtaatcaagctaggtgtttcttacaccgaggtgaatattaataacacgttgacgcagcttaacatccgcggcgtccgtgacggccacgtcggggacacatgatcatgacattttctgcaattttgacccagaaaatctgcagaattcagccaaaagcaagagcctactggttgctgggaacgagacgtgtgtttaacgtttatgcatctgatactagaatatggagtatagatcatatagactgaacaagtacagagaactttgcattctccaattgcagaaaagagagatatatgtgcattgctgcattgcttccatggcaagcatgtttccttcagctttccacgaaaggttaattactgcactatctagctactagtattagtataatcaatcgcagttagctatctctaagctcactggatggtgtgttaaaaatggcagcttggtgctgctgctgcgttgacgtcgccaagtcaatatctcgaacgtggtgtaaccgttgtgctagctccgataatactatactacattactaatataatcgactagctttgcctgggatcacggttcagaaagttcagaaatgcagaatcacatgcagttgattaatttaattaattaaccttcttcttctactactaccccaatagtatcgattcgaagaacaacctggctgtcgatttgcatgcagatcgtgtcctgttcccatatggtgatgacagtgagaaaagggctgggatcatacagtggtcagtggagttgctagatcatgtcagaccagaactgcatgccaagaagatagtgcaagcgttgatcctgaaaaagaaaccgaatagattatccaagttttggtcgacacacatgaccaccaactcctcacctagtcaccttgttctgcccccacacaatacaagtcaacttcccaacttgttttgttgatgagcaggaatccaattattatggcatgatatattgcaaatcaatataggatggaaaaggctattacatttttcgattttccttaatttgtcaagaacaaataaagaggcaagattaactaaggacgaggcttgcaaggaattcatcagttcagagtgtaacagtggcagaagagatcgattaattaaatcccctaaatcatgcccttgattacggtaagaaattaattcatatgggtggatcgatcacgtacgcactaagccagtctatgcagagaaacatgccaatgcatgctagctgaattaagctttgcattgcatgtgagtatgtgacgccaaggcaggcactttgagctagctagatgagacattagctgctaattaataacttattaaaactaagtagaactggttacagctaatatttaagctcagttctcacccattaacaattagggtaggttgatccgttaggtgcaaacccacaaaattgtcaaaaccaaaacaagattcgattcatacaaaacttaggtttctatatgcccataggactctaaccaagaaaacaggacgacaaaaaaatcagataactttgacttcagcgccagttagttaaacctgcatttttcatacatggaatctttaatttactccatatatatatatatatgcataatactacatcattaatttctgttgcttgcagtatcatacagttgaaagcgtctttttttctctttttgaaaaaaaggttcattttacttccaaactatttctgttgaacacttaacccctaagcaatttttttcagcttattttacaccctaaattatttaaagcggttcaacttgctttctaataatatttatttttttaatgaatggactggaacggccaatacatgaatgatatgtgataattattcgagaatataaataaataaattaactgttatgaaactgaaaggtggatttaaaacatataagtataaaagaacatatattaaaagttcttttaaaaaaggggaatttgcaaatttgccaccggttttttcaatattacaaggatgccactcgaatgatagttctagtggcatttttgcaattttctagtgacagtcttgcaataatgatttaaagtagtggtaaatttgcaattgcccctttaaaaaaataacataccatttagaagctcagaaaaagcatgctgccatttgcattctcctattacgaacaggttataaataatctagaagcaagaagagcttgaagtaaacgctacattgaaacgtttacatctgaaagcgagatgaatttaagtttagatctgcaagacggcagcaagttcagtcaacacatgccggcggcgcacgtggacagtcgtcgcacgctgcatgcgatggatggttaatttgctcgtcatttcgatcgccagccacactgccgctggagctaacgtagccacgtacgtacgcatcaagattaggagaataatctctcggacaaacggaagcttacgcgaaaattttgaccaaaacttgtttgtctgatctgcatatgcacttggcagctggtcagtggcagcagtcgtagtcggcgatctaacgatgttgtggtctccagcgagtcttaattagggggaaaaaatgatgagatcaccagatcgatcagacagctgctgcttaatcgttcattaaaataccagtcattgtcgaacaagtacaggttttagtattgcaaatttagctggattttgaacttgatgttgagagggaaagaagaaaatttgattaataaggtctgagtttatttcaaggaaggtatatatgagaatcgtacgttggaccggctgtacgttgaaggcttgaaacgcgttgagccgctcacctatatgtccgtacctaagctctcttctgtcaaaacattatctaagaaatttgttaattataggtttggagaaagaataatgtttatgcaatttatgattgatggtccttaatactctctatgatctctcttttagcgtttgagtgtgtgtttggctgtgtgcattttagtgatgccgagtttgggagtgctctcggtgtaattggatcacctcgatgtatacttgactgagataagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57583 - DNA, 5461 bp, Oryza sativa
  unsure (1)..(5461): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgaaaattaccatgtggatgcatatgttttttctcttgagaatagaagctgcttgcaactccatatgaccagcccaagtcccatcctcaagcatagagtcacaatatttctcaaacggttcctcgtcctcaatgaatggctcaaaatccacacggtgctcctgtaagatgcatacaagaaagattatgaagtgtaaataggccaatgcttgcttgcagcatgtcttttagataaaagaacaacccagcctggcagcctgtactctacgcccagatcagatgtacacagccaaagtttgcagcatgtgcaataccttattgattcaatggcaccctaattacagttcttaagtcacagtgttacaagatgtttcttggtcatagccaaagcttgcagtatttctaataccttattgattcaatggcaccctaactacagttattaagtcacagtgttacaagatgtttgttttggtcatctcatctgatgcataccttaatgtattgcacaatcattgcacggtacttcatgtgctcttcctcgttgccttcgagctggtcgcccattgccctgcagactacgatgagtaaccatataacacaagactgcataatgcatatactattcctcctttcataaactaacagtactctaacatatcgtacaacatcgattagcctcttcttgtaaaaagtggcaagaatttgagtaatggaatcgaaaagaagacctaaagaagcagttgccatccgcactaacttcgataatcttcaaccccagcgagtccagctgcgcccggaactccgtcatgtcggccttcttcgcgaacttcttctcctcctaacaaatcaatcaccaaaaggaaaaaaaaacgagaaaatatattagctaaagctcaattccccttccaccaaaaacgatccaatctccagctgactgaggcgcggggtattactgcatcacgcttcggcttccgggctttgggcgccgccacggctaccttcttcttgttccgagccattacgacacgtgcggtagtagtggagtctcgcctagatttccccgcggcggcggcggcggcgagggggaggggaggcggaatcgcagatagtatcaaatcgtactctaccagaagcccggagaagaaatcggatgggaaaaggaagaggagaagagaagagaagtcgtcaggtgatatttcgtgggccaaatgggccgggccgtaacacctcaatccccaatctgctacggcccgtgtgtgaacgtgacacgtcatcctatttagaatcgaataccgaacctgaacgtgacacgtcagatttaggagtagaaacgagtacactctacacgatacagatccaatacgagaccgacacgtcgtcagcgaccaagtaaaattcggtcacgaaccgtacgccaccaacctgtataaattcatcgaccgccaagcctctccagaacatagcacaagccaaccaaacaccgcacgatttcgtatccacacatacttctacgtgatttcgtttcgacgatctcgaggcgccgcggcgtgacgtgacgtcgacgacaaccatggcaggcggtggcggcaagtccgtagcggcggcgctggccatggcctgcttcctcctcatcctcgccgccttcgctcccccggcggcggcggcgccgccggacatcatgtcgatcatcaggtacaacgcggagcacggggtgcgggggctggagcggacggaggccgaggcgcgcgccgcgtacgacctgtggttggcgcggcaccggcgcggcggcggcggcggctcgcgcaacgggttcatcggcgagcacgagcgccggttccgcgtgttctgggacaacctcaagttcgtcgacgcccacaacgcccgcgccgacgagcgcggcgggttccgcctcgggatgaaccgcttcgccgacctcaccaacggcgagttccgcgccacctacctcggcaccacgcccgccggcagggggcgccgcgtcggggaggcgtaccgccacgacggcgtcgaggcgctgccggactccgtggactggagggacaagggcgccgtcgtcgcccccgtcaagaaccagggccagtgcggtagctgctgggcgttctcggcggtcgccgccgtggagggcatcaacaagatcgtcaccggcgagctggtgtcgctgtcggagcaggagctggtggagtgcgcgaggaacgggcagaacagcggctgcaacggtgggatcatggacgacgcgttcgccttcatcgcccggaacggcggcctcgacacggaggaggactacccgtacacggccatggacggcaagtgcaacctcgccaagaggagccgcaaggtggtgtccatcgacggcttcgaggacgtgcccgagaacgacgagctgtcgctccagaaggccgtggcgcaccagcccgtcagcgtcgccatcgacgccggcggccgcgagttccagctctacgactccggcgtgttcaccggccggtgcggcaccaacctggaccacggcgtggtggcggtggggtacggcacggacgccgccaccggcgccgcctactggacggtgcgcaactcgtgggggcccgactggggcgagaacggctacatccgcatggagcgcaacgtcaccgcgcgcaccggcaagtgcggcatcgccatgatggcgtcctacccgatcaagaaggggcccaacccgaagccgtcgccgccgtctccggcgccatcgccgccgcagcaatgcgaccggtacagcaagtgcccggcggggaccacctgctgctgcaactacgggatcaggaaccactgcatcgtgtggggatgctgccccgtcgagggcgccacctgctgcaaggatcactccacctgctgccccaaggagtatcccgtctgcaacgccaaggctcgcacttgctccaaggttttaaatttaaattttatgtttacttttaatttttagagttgattttagcgtttttataagtaatttctttttcatcattgacttttttttaagttgttaagaacatatgtaaaagttacattggccgctaatacgtgttatgtctgtgtgtgttatgtgctcacacgttgccatgttttttccttgacagagcaagaacagcccgtacaatatcaggactccggcggcgatggcacgaagtgttccggaacaacctgattcaatctcttttgtagttttgaatagggaagatctagtatagaagccttatctttgttactgttaccgagtcctttattattatcgctctttttttttcgcaagatgtataaagtcctaaacagttactgttactattactgaagttattatctatctttggatatgagttctcccaagtacagcatcacgtgttgttacagctctatcgtttgttttttagggtgtgtttagtttacgaaaaaaaaattggtatcacatcgaacgtttgatcgacgttgaaaggggttttcggatacgaatgaaaaaactaatttcataactcgcttggaaaccgcgagacgaatttattaagtctaattaatccgtcattagcacatgttggttactgtagcatttatgactaatcatggactaattaggctcaaaagattcgtctcacgatttccatgtaaactgtgcaattagttttttaatctatatttaacgcccgatgcatgtgtccaaagattcgatgtaatatttttagagaaaaaaattgggaactaaattattaataaacgttacagctgacaaatgggattgtagcttttgactgagttgacaggaacagcttcctccatatggagaaccctgtcctgaaatatcaggagaaccatctcgtatttggctcatcccaataatccttctttctataaaactaatacctattaaacacctaaaacttaacatcaaaatatactacctctgtttcaatttataagactttctagcattccccacattcatataatatatctatatatatatatatatatatatatatatatatatatatatatatatatatatatatatatatatatatagattctactcattaaacacgcaaaacttataacatataaacatatagtaattatatttacaattatttcattataaaactaaatatatacatgctaaaccatcatccttcaatcattttcataatatttcagttcaaatcatttcatcgtttcttcaatatctaacgtatatattctgcagcaaagcgcgagagatcatccagtgcatgttatgcttgtgctttgaacgatagtttcagcgcaactaattgcattggtactctgtttcatggtgtggaataaaactgccatgtttagtttccttcctattcccaattttccatcacatcatatcacatcaaaaaaaaacttttctacacatataaacttcaaactttttttctaaactctcaactttctttgaacttttattttttttcaggaactaaacacacccctgctagcatgagtttccaaaatataaatatcaggagaatcctatttccaacaaagatattacgtacactctaggagggttggacgagccctcctattttcggaaaaagatacagtagtacacagtaccgtggataggtgggacgaatcgcttccacaaaactacaaaagtgccccgtctcaacgagaaacccgcgcgcgccccgacaaaaattcgcggtggcctaccagcgatttcgcttcactgcagtccgtctaccgaatggccgcgcggcgcggcccgtcgacggggtccgccacttcccgtgctcctcctcggtcgccgcctcctcctccttgctgctgtcgcgctccaagtccaggctcgcgtctcctgcggcggcggcggcgagctccatgcggcgaaggcttgtgctcggcgtgggcgccgccgccgccccggccgtggcggcgctcgcggcctcggcgacgcccgcggcgctgcgggactgcgccgccacgctgctcatcaccgcgggcgcgtactccctggtgcgcgccttcgacgggctcacggcgcggcggctcatcgaacaggtgtcggatctcgtttttcctttttttttgtatttcttttttttttgaggtggagctgaagctttgatctccgccattcttcaaaaaatatcaattctttagctctgttgactgttatccggagagtaaaatatggtatatacaattcaggggatgtgatctgtatcttgaatttattttcaattgctgggaagatctgactggttcagatggactgctac

SEQ ID NO: 57584 - DNA, 8577 bp, Oryza sativa
ttgtcccgttgctgaactgcataaggcttctgacctacgggctccgcctttccactgatgaagctctagtaaaatcggtgacccgtgaaggaaaaccagagttcgtgctatgatccttatttctgatactccttcattcaaaaatcaaaatagtattccttgacatgatctttggttgcttacagggaattgctgagaggtcctctgtactatgtcattgtgctgctggtcagtgttttggtcttctggcgccagtctcctattgggattgtttcgttgtcgatgatgagtggtggtgatggtaagatgttggatctcctgggaatttaggaaaatctgcagtttttttttgtaataccccagttcacttgatgaaatgaatgcttctgctaagtatatccaccttcttggttcttattttttcaggctttgctgacattgttgggagaaggtatggctccgcgaagctgccattcaatgagaacaagagctggataggaagcatctcaatgttcatttctggcttccttctatctgcactgtaggtttttgcttcagaatgcattgctggttcttttgcattgttactccttgttattgttaactcatggatcttttgcatcacaggatgctgttctacttctcttgccttggttacttcactgtctgctgggatctggcacttggtaaactggctcttgttgcattagcagctactgtagtggagtgtattcctgtcaatgatgttgtggatgacaatatctccgttcctttggccaccatgttggcagcctatctgttatttggctacagttcatgttgttgagactataaaatttctcccttttgcttttcatgtcctgaatttggtactgccaaacatcatagattggatctctttctgttgaatcaaaaggtattttgctcatgatcatgcatgcattttgggtgaacgctagccaaatcatttagaagcaacaaatataagggactacgtactgtctcaagcttctctctgagtaatatggaaaattgtctgccgaatgggcagattcatatatgaattctcatggcagtgaaccaacaaacctcacacatggagcaatgcggggaatcactccagacgaaatacaattgacaacaagagcataaacctactgttgaaatttctctcatatttgcactacaaacaatccataaattggcagggaatgctaactaactcctcccatgggggattgattgctaatactaacaatcatgtctcgcgagtcatgtacaatggcaccgaagagggatcgatgttccatcaggttttcgcttctctcgggtaaccgcttcttgaatcatcggcaacttctggtgaatctttttccagatgtggttcacagcaccatcttgtgcagcagaggccatcctacctgggtaaatactatcatactcaaatataggctggacgtgagccatgtttcttcggaattcatctttctgctgcctggggacatttcttaagtagtttgtgagccattttggtctcatagaattattgactgagacaaaaatggcgaattctgtgtaatctatcatcccttcaaagggcagctcaatctcatcgctgacaatgacaggtatgcacagactagcaacagcatcaaagagacgacatgaagttggggtgtcaccagctgggtgcaagcaaaactctgatgtccgcatcccttttattgattgttcacgtcctgtggcattaggataaccttcttccatgacaacatcaggctcattaaccatcaagtcccatagtttctcccgtaccaaaccaccctgaaagaaaatttcagaagttatagtaagataaagctgtatagagatgcacagtagtacagaacaacaatctcataagtcataaacaaagctggtttgtaaataaaagttctgttgagagcataatgcttcaaatggcaatagtttccttgtagatacataaataatagagtaaagtccatcaccagtccctaaacttgtaccgctgtgtcatcccggtccctaaactcgcaaatcgaccgttcaggtccttaaacttgttcgactgtatcatcccggtccctaaacttgcagatcactcgtttaggtcctccaacttgttcagttgtgtcacgccggtctctaaacaggacggtctaaaaactttatatcaaaaaataattcataactttttcatgtgaactctaataaagacaaactttatatcaaaattgtagcgctcgacgcgacctacaactttgtagttgaaaattttttgaattaaaactgtttagggtcccaaaatattgttgcatgtttatagattttgtaattttaaaattaaaattacattctgggacaaaaaatgacttaaaataaaaaaaaatatcaactacaaagttgtagatcgcgtcgagggctacaagtttgatataaagtttgtcttcattagagttcacatgaaaaagttatgaattatttttaaatataaagtctttaaaccgtcctatttgacccagatgatattcaaatccaagtttagggactgaggtgacacaactgaacaagttggaggacctatacgagtgatctacaagtttagggaccgggatgacacagtcgaacaagtttgagaacctgaacggtcgatttgcgagtttagggaccgggatgacacaacgatacaagtttagggaccggtgatggactttactctaaataatatcaaagagctgtggattcagactcaacaggttctaaaataaaattttaagatagcccatatcatactaacatgttcttttattccattttcatttccaattgcttagattcagatactacaaagaagataaatattgccatgcatacattaaatgcttattagtatgataaatggtacgaacccgatgcctgtgtttggctcccttgaagtacagaagagtggggcggtccttattctctgataagtgcattgtagggagcaaatgagtgtaaggtacaatgacatctttgagcaatgacacttgcgtatgctgtatcatatgagaaacattgctgcttgcagagtttgaatcaagtttgtaccatccgccaaaatcaaccaccaaaagaattgcaggagcaatctctttacggacatgccacatcgccacagggtctgtcaaagaatgcctcaatatttaacaaaacctgagcatacaaaagaataataagctactatgcagatcaattacaacgaaaacataaacagtatatcttgtattcctacattgcttgcaaaacagttgtgtcttttgctccgaaacactgaggattaccaatatccccttgatgacaaatgtacagaaagtcacatggttcaaaattgtttttctttaatgatggcatttcaagggtatgccactcccttacacaagaaaacatgtaaagcgtgcctaagaaaccaaaaccagctaccttgacccccctattccaagtatgcacataactaatttcaaatttatgagtgcattgtgaggttcctatcatggttaaatctacatgtcaatgtgctcactgttctgggcacactccctctgtttggaaaagggaacttggtaagtcttacactgaggcgccgagcaacaaatcacatgtatagccggtaactaacagaacacacaaaatgatttcaagcctaaatcagctcacagtttttagagttgagtagctaaaccctgtagatatcagtcagaaagtgggattgagtatggaggagaaaaaactagtttccaatcatatactagttgagagttgggattgagtatataatagacggacaacaagcataacttaacctatcgaatgcttaacatataacccacaccaattgggagcaatggagggttaatatgatcaacagcccgttccattatgccattttgatcacttaagttcactcaggaaaaaataaaaagcacatttccaatttccaactgaatcacagtacctgtcaagacgaagacgtggtcacggccaccggagcgccgccacgctgggtgggcggtgacgcggtcgacgacctcccgctggcggcggtagtcctcgttcccctccttcctgcggaacgcgcccttggcgccccacccgagctccatctccgcggacagcgtcgcgaagaaggggacgaacaccacatccgcgtccctccagtccgcgaccaccctgacggcgggcgcggacgacgagcccggctggagggaggcgaggagccagtactcggcgctgtactgcttaatcagtgggctatccgggtacggcgagtgcgcgcgcggaggccgcggcggcgggtggtcggggtcggaggaggccgggatgcgggagtcggcggcggggagcgaccagtagaggtcgaggaggccgtggttgagcgcgcgggggagctccgcaacgtagaccctgaggaggcggcggcggtcggggccggacgccgcttgctgccgcgagaaggggagcggcggggaggcggggcgcaggaggaggaaggagagggagaggaggagcgcgacggggacggcgaggagcgcgaggcgcgccatggccgccttccagatctcgctctgcttgcttcggatgggaggaggaggaggagccgccatggccgcactgctgcttgtgcgatgcgttcgtgggcctgaaactagtatacttaactgggccgggcttttcactgtgtccgtggtccatttgccgcgaaaaaacaaaaaaaaatcctcgtcttctctctcgccggaaaccgcttaagccagcgccaccgtgtcccatgcgctgcaccggccaccgaatcaatttttgtttatctttttaaccttttttattttaaaatttatttatatataagatctaaacattttaacaacgttatttgggttagcgtggcaagacaatactactacgtcgatctggctaatagtacgtctattatcttgacattgcagcagtgagaagggcacgagagaaatagaagtcgtcatcgacgtcgcctactcccttctgctgctcccgcttctcacctccgcagccatcctcctagtcctctccatcgtgaagccgcctgtggacaagagtggctgcggcggctggtctgccactttctctaacgacgcccaccttgcattcatgtccaccgccatgctccggctcaacttctttcctacctcaccccgctggtctcctccccctcctcctcgatctgccggcctgctcagacgaggagaagaggacagggtaatgacttggtcaccatgacatgcggagcctacgtgggtcctgtgctgactcagctgctttgttgaacaaaaccagggtcaatatcacctaaagaccaagaataattcggttctgtaagttgacaattttgtaattcgctgagggacctcagttgtactgtttactggaatctgaccaactggacaaacgacccattttatacttcctaggcccatatactacgtggcatggtccacgaactgatcgaatcacgaggcccacggcatgagcatttctgggctcgggatgggccctttcttcccttccaagccgtactccccccaacacttataccatctccaatcctatacttccccatcgcatcgcatcgcacattcgcactcgtctcgtcttactcaccccgcacgtttccacttcccctctcccccacctcaccaacactcctcgccgtcccaccaaaccctactaaccgccgcgcgcgagagggtcccatccccgacttcgccgccatggccggcgctcccccgacggaggcggagaaggagtccctcgtcacctccttcctcgagatcgccgccggccagacgcccgagacggccacccagttcctccaggtccgtcgtctcgttcctcccccctctagagtctagcttctgatcgattcgaagggtttgatgcgatcccgtctctcccagatgacgagctggcatctggaggaggcgttgcagctgttctacatcgacggcgaggccgcccttgcggcgcatccggccccatcgccggctgctgcggcggaagcggcggcggcggcggtggcagcagctgctgaggtggaggacgcgatgaggtaggtcataggtggatcggcgcgagatttctcgggtttgggctttggtttttgggtccttgagttttctgttggtttgtgtacgcttaccgtgtgctgtgatgggcaggttcgctccgcccccagctgctgcactgggtgatggaatgctgcagggacttggggaggaagaggatgtgcgggcaccgctgcccacaaagcgggagactctctacggcgatgcccccatggtcgtgtaagtctagtgcttggttagcaaactctttatgatagttgggttcctgggattgagttcctcagtataagtgttaagactttgtgtgagacaacttctagttcaatgcaatatctgtgctgcccctgtggtgattgtggtttatgtgatgtactgatacatgtaaatagccaaatagggtgtatcggtggcacaaaatcggtactagtaatgcctagaatcattggtttggttcaaagagaaattgggataggttacatggggcatgtgattgtctaaaaaaactcttatccgacaatgttaaggccatgctgtttaggggagctttaagtttttgatggcttcaaatcgaagcttaagtcctcataaaaggcatgtgtgtgtttggttggtgatgaatagatgtcactaacctatagtaattttgttctcgtccaatggaattagcatgtgttgttggtaatcattgttggcttgctgatgggatataaaccttttggcctaaattgcacctttggctatgttaatagctagcaccattttctagtaccactaatttgcagtcaagcctcctgccctctcttcccctgccaagtggactaacatctctttcatatagtttgcaaccaatgagattattggtatttggttggtcaccaacaaatttcgttcatggctacaagttagatatctttacttgtcaccaacagatatgatgacaatcactagctcgaactcaaccagaatttactgatcagaagaaacatctagtcatttcatttgctgccaattattttcaaaacaggagagattgttgcctcctgaaaaagataaagttaggaatgtttttattcggggtgttatccttctacccattaggacaacacaatgaccattaacatatcagtcacagctcttattttatcccttattctctatgataccgatggcatatctgggactgccccaatggcactgcaaattaagggggtatacttagatatatatacttaaatgcgctgtgccaagtatttattataattggggttgattttgctgatgtttagccatttctttggtagatgcaacatctcttgaatacatatgacattattactatggttctttgttatagtccacttttgttaaatctggaaggaatagcgctgagccacacctaatgacctaaagtgtgggaagtgatgcaatttttgttctactctttcttttggagatgataaggcccaaattttgttgtactcttttcttttgggccgacatgctttgttaggcttctatgtcttgctttgctaaaaccaaaattctaaaacaacagccttttactctaaagaaaattagaataggctagagatgaaactcaagttgagccacagtaaccaaagagaagtatagcactaatagaaccaaactttttgcatgattttcctggaacgtggactactaatttaaaatctatcattttctaaatttgaaacggttttatgacttcttttcagcgttcggcctaattcaacagttgcatttcgtaactttgaagaggagtcaaggcaatctgctgtttgggattctgagcagaatgctgcatctagttctcgtgataatctggcggcattgtatcgtccaccatttgctttgatgttcaatggacccttcgacaaggtcagctatcctttttttcttatttaacgtctggtgttacctttttatctctaacatgaccatgtgctgcctttgcctgcaaacttcaataacctgctttgtctgtgggcatttggtatgcattgggaaaattgcaatattctattagtgacatactgaattgttatcatggagcagcacgccatgtaacccacgaactcttcatttatctcagctgctaacaatcctacctgtcaaataattagttcggtttattagctgctaaggttcagtttattactcaagcaaacattgcctcccttttgtcaacaagaggcatggtcaaacatgcttcttaatgttctttgttcacactatttatcattgaaagtacattgatgtttttattagttgttgcaaattcatttgttgtctaatgaccagtgcacgagaactagtaaactgctactaattttcatgtgaaagcctggagctgatgaacttcataatactaatttgattatcctttaattttctataa

SEQ ID NO: 57585 - DNA, 915 bp, Oryza sativa
tgccgaaaggaagaaccgcacactgattgacttggtgaatgccatgttgcataccgcggaactacttaaggcatggtggaggaggcattgttgacgtcgaatcatgtgttaaacagagttcctaacagaaacaagaacaaaacaccagacgagatatggattgggagaaaaccatcactttcttacttgtgcacacgggggtgcttggcgaaagtcaatgtaccaataacgaagaagcgcaaacttagacctaagactgtggacagtgtcttcctgggatatgctcatcacagtactgcctatagatttttaatagttaaatctgaggtacattttatgcatgttggtacagttatggtgtctcgtgacgctaccttctttgagagcttttttttccaatgaaggatacacatagtacttctagccaaccctctgaaataattcccagttcaatcacaccaccagaacaaaatgaacatacacatgaacatgtcattaaggaggatggcagtgaagctcgtcggaggagtgagagataaaggatggctaagtcttttggtgatgatttcactgtgtacctcgtgaatgacactccgcagtcaatttcagaagcatatgcatctcctgatgcagactactggaaggaggttgtccgtagtgaaatggattccattatcgctaacgggacttgggaggtaacagagcgaccctatgggtgtagacctatggggtgcaattgggtgttcaagaagaagtttacgcctgacggtactattgaaaagtacaaggctcagcttgttgaaaagggctatactcagaaagaaggcgaagatttctttgacacttactcacttattgctagattgaccacaattcgcgtactactttccctaagcctcacatggtcttgtcgtt

SEQ ID NO: 57586 - DNA, 718 bp, Oryza sativa
cctgcagcccacacagattacgtgcaaattgtgagacgaattttttaagcctaatttcttcatgatttgacaaacctaagatccaactcattgcctcccatatccgaagaacaaagagatgctaatgcatagggagcactaatgggagcaacgcgcaggagttcagcgagaaaagaaaatcgaaaatatcgatgccagccgtagtctggactccttgtggaagaggacattaatgctgcaccgcccagcttcacctagcctgccatgccaccttttgctggcccatgcctccttttgctcgttgccctgggccacctggttccccttgcgctgtgttttgctcgcctctccgtcgcccaggcgaggccgaccactagtcagcttgcacgctgctgccatgctgctccagttagggttggccattaattggctagggatcagatcggcgaggagccatatcgggatggactcgaaccaatggacgtattatatttagtttgggagtataatggtccttttcatattttctcagaaatttcttctttttttaacacacttaatttgctcaccaaactaccatacagaatgagggcaaacagaagcttcgtattaaaaaggaagggaagaatcacaaccccagaaaagtaaacgtaaaattacaattgagttttacaataaggggtaaaattataattgagttttacaacaaggggaaaac

SEQ ID NO: 57587 - DNA, 1374 bp, Oryza sativa
aattccaggtagagaccaattagaattcaaaaaatatctccccatgcaaggaaacccgagatccgacgaaatttgtttcagactcggatttagccagtctgaccggcgacttgccgccggtcagactagcccatactcggagtttagactggccccttgaaggatatccgatgccttccaaactttggcaatattttcctacttcgaatctaggtgccaaatttgggagttaacacatgccccctgccttttgggtgaacttgtgaacctaaaagtgtataacatgtgatcttagggcgataaactaattaccggtcatatcacctcctaagcatcttgccaaatactcgggaagtactatctccgttttttaatagatgacgccgttgacttttcctcacatgtttgaccattcgtcttattcaaaaaatttacgtaattataatttattttgttacgagttgttttatcactcatagtactttaagtgtgatttatatcttatacatttccataaaatttttgaataaggcgaatagtcaaacatgtaagaaaaagtcaacggagggagtaattttttgcaaggatttcccattgaccgctctctaaaatcatcctccctgtaaagtttcaagaaaatatgcattttctcgaatgattccacatattcgataaggaccctcccaactaggtaaccatttaccgaactccttagatctagaaccgaaagaaaaattgtcttccataccaagtctcctacttgaagcgtctttgctcttacttttttgttataggctttgactactcttttttttttctccttttctatctcctctaaagcctttaaactcttatcgatcacatcatcaagattgtgtgtcatcaatttttattttcctcaaccgataaatcctctaatttcaacacatatagattttcaaatcctctgattcaagataaattaacaataaattaaaattcaaaataaagtgaattatctccacatgagtcctgtttttgagtgtcatggcctcggcccacttgatgaagtaatccgtcgcaactagtacgtaccgatgcccttttgaggatgacaaataaatttgacctatgaaatcctaagcccaaccttggaacaaccatggtttgataataagattcagcaaggcggttgccgaaccattgacaagcatcacaccctctatagtacttgaaaaaacaatttatcttgtgggccgattgatgagtaccacgaatcctttcatgaacttcccccatagcaaccttggatcgatcaccatctaagcacttaaatagtgccacatccatatttatgcaatataactcaccatcaagcagatatgtttaaacgct

SEQ ID NO: 57588 - DNA, 1838 bp, Oryza sativa
aagtgtggaatgcatcgacgttttgaaaaattactctgtatgcaacttgtgcaatgagattaatgtatgtctagtacaatctagatgtgagagatggaattttatcgctgcgtttgccatatccatttggtttagttaagagaaaaaattcatcttaattatgcatatgggttttaatggggatcccattttgatggatatctctataacttaataatgtacgggttgaatcgggatacagtaagacatcctcgattgtaactcgtatacctatcaaagtgtaatagtggcttgcccaaacccaactatcacagcatcacgtccagtgaggtgggggaaagctgtgcagaggccggcgaggcagaggccgcgtggcgtcagcgaccatgcggcgccggggttggtggcggcggccacctacccggatccatgcttcgaagtgggtgatgtgggtgatgcggtagccctagtgctacgacaacgagcagcatagaaggtggtgtagacggtgattctggtgccaaccagggaggccgagaatggcgtcaagaatcacacccaaggtaggcattacacccaaggtaggcatcataccttcaaatgctggctccttgattgatttcctcctttatcttcttcacgagcagtgctgataacgtgttgagaagaaacgagagagcgagagagattgagcaaaggaggagtttctttgtattcaattctaggttttacatggatgatttcaaatatttatagaccaggaggggatgtgaacatatcctgaaaaggcatgtccccttatgaagcacaattaagttgttctaattgatcactaagccatggctaatactcggttgccaatcccatccaaggtatggatgagatcacccaataatttcgtaacaaaagctaccaaatgccgtcgatctggtggatatagataaggccggcattgatggtcggtggatatcctactttcctattatttctattcaggtctttttcttcagtatataatatccatccaataatgtttcatattaccatgtaatcccaaccaaattacactagcggaaagattaaatatttatcatttttcctcagaattttccagctaatgtgccacctatagagcgaatgattttctcagaaattctgtgaagcttgatttaattggtgtgaaaaacgtataaacagtttcacaaagagttcttcagcctgttactatattttgacctattttgtataagttgtaaaaaaaacattcaatgaacatatttctaacaacgaaccttttggcgataaatgttcccatatatatacagtgatgtggcaaggtccttctcagggtgcatcaactattttattttgcattgaccatttcagtatggcaatgaggattcaggatagcgtcgtaaaacaatgtttgaatcagaaaacaatttttgggaggcttttattttcaaattttttggaaaaagctatatcaattaaaaatctgtttgttcccggctttaatatttaccacatgccaatcagttatgtaaatatagctagaaccaatatacgctaaaatcctgatcgatcatgatggtttctgtttgcattataaatttgaaattttaagagtcatatataatataacttcattcatatataacaacctctggaaattactatgaatataagaaaattggttgtgcattgatatgttgtaccttaacagtagcaaatgtcaagttgtttccatatgctatggtgaacctgtgcaacagatttggttacataaccaaacaacaatactaataacacaatcttcaaactcgggctgcaggaat

SEQ ID NO: 57589 - DNA, 1545 bp, Oryza sativa
atagaaatagatcgagtaggaagtagtaagtgaccagatatgcctcctcgtttctctgattgatgccttttgtgctccattttgtaattgatctgatctgttctgttatgaagtactagtataagtagtaagtattattttgttgtccgtggagttgagtagattactacatgtgcttctattgtgagctccggctaggtggtcgatgagctcgagctggtgcagtagagtgagaaagagcaacggaggaaaaagcagagtgaatgacattttttttttttgggaagagtgaatgacatgttgaccagctgtgtgcaatttttttatttttcgaactaaccacataacacgtaagtgccacatcaactaaaaccacaataggttaaggacaacctgtataaaattaattgtttaaaaggttgagcgatgaatagtatctggttttaactttggatgtttaggggcctaaaatcaacttattgctatttaaaacttcaaaaagtagctagtatccttttataggtcaagtatgtgttgaggcgtaacatcctgttatagcatggtattacgattaaatgaatactacatataacatccataggaaataagcaacaaatatgggagattcccgaaaaaaaattcctatattatgcttctgagcacacacaatgattcttctgtgctaccttgaaattcacgggaatatgggctactgttccattggaatttggtggaaagctagctaacacgagtattgcattgctattcctaatgtttcactgcagctactaaatgaagtttcaaagccccacattttgtacaagaagtgcatttatatgtctctcatcccaaaatttgagagcatggacagaaagatcctgaaagaggagcttggaatactaaagcatcgacctccgcgcccttcaatacaatgtgttgtaagtagaacttacctcaactatatggtaatggctagttataatctatgtaaagtgagtatagaaataatatagtcgaggaagtacattactttctgaaaatatataaaataatatatatggcatcctttatatcctaaaggatacaggaacagacgcttgtttaattttatgtttctatcttataccaatttagacctgaattaaaatgaactttcctattgcagagctattccaactatttgtcatatttttgggccaacgataacgtcacacgagagtatctcggaatcaagaaggtaaatttgtggttccttcatttttctagagatgaatacacgcttgtttgcagtttacatacaaaatgtatgaagttgtcttcgaattctatacatgctaatatttcagggaagcgtggatgaatggattagatgccacgataacgatctaccgtacaccaaagatatcaagagcagcatacagtaccatcacaatgttacattaaatggttatcgtgctttagtatacaggtaaagaaaaattatcaccaagttacttgctgaagcttacattaattgattttcagaagaaaaaaaaatctgtcata

SEQ ID NO: 57590 - DNA, 2567 bp, Oryza sativa
atcaccttagggtaaggattcttcttccctgctataaaaagagaggaaacaattaccaaaggtaaccacctaaatagattgtccagcgaactattaaatacatgcgattgtagaaaaaggaacacatcaacaatattacaggcttttcaaatgtgcacatcttcagttttccttaaaagaagaaagtctgacacattcttgaaatcagaagcatcatgtatttacatctaaagaaaagaagaacaatctgataaatctgcactatgtatatatatcatagaatggaaacataagattgtagtgcgccatgtaaattactgattgacaaagaagcaaaccctgcaaccagagaacaatatgcagattttgtcatttagatagtgaagtaactatctcatgatgtgtccagattcatcgtctgactccatcaaggattcaaagcaaaatagcacgcatgtaaaagaactcatttcatggttcatgtctagctattcagttcttctgagtgacatcactcgtatgattttgctcgaaaacaaacatgctttctaatttgaacacaccgagatgttacatccaatttctgaactttttgagagtaaggaattagaaggttccacataattagctcttatataaacgtgatctcacagcatgctgcatctagaatctgttaaaactgagtcacttgtagttgttcaccttctccaaaaaatatcatgattgagacgttatgtatttatctattgaacaatatatcagcaattcagaaaccggcctgcgtatgcaggttgaacaatgtgattgtgaaactgtaagatccaaattagttggctgcactgcaactaatcgtgagaatggttccaaaattttatatttccatctatatatacacgcgatcattttataaaaaaggttccaataataccacactatgttggaataaatgggctaggcccaatttaattcaattaaaatctcaagagcccacaagtaatgttagagagaataatactgcgaagagtatggaattattcatgagatgacgcctccctattcaccccagtcaaacggggtagccgaaagaaagaaccgcattctaactgagatggtgaatgccatgttagacactgcaggactttccaaggaatggtggggtgaggcaatattgactgcgtgtcatgtcctgaatagaattcctactaagcataaggaagtaacaccattcgaggaatgggaaaggaagaaattaaatctctctcacctgcgcacatggggctgtttgaccaaggtaaatgtacctatagccaaaaagcgtaaacttggaccaaagaccgtagattgtgtgttccttggttatgctatccacagtgtgggatataggttcttaatagtaaattctggagtacccgacatgtgtgttggtacaattactgagtccagagatgccacattttttgagaatgaatttcctatgaaaaatgcacctagcacttctagtcaagaacctattttatcccctgagcactttgtgccgatagaacatattgatcaaacgcttgaggaaaatcctgaggaggataactacattgtaagagacaaaggactgcaaagtcttttggagatgactacattgtatatcttgtggatgatactccaagaaccattaaagaggcatattcatcttctgatgctgactattggaaggaagcggtactcagtggatggactcaattatgtctaatggtacttgggaagtcgtcgagcatccatatgggtgcaagcctgtaggatgcaaatgggttttcaagaaaaagcttaggcctgatggtacaattgaaaagtacaaggcaagacttgtggccaagggttatacccaaaaagaaggcgaggactttttcgacacttattcaccggttgctcgcttgaccacgattcgagtactactcgctctggcagcctctcatggtctactcgtccatcagatggatgttaagacagctttcctcaatggagagttggaggaggagatctatatggatcaaccagatgggtatgtactagaaggtcagaagggaatggtgtgcaagctattgaagtccttgtatggtctcaaacaagcgcctaagcaatggcatgagaaatttgacaatacacttagatctgctggctttgttgtgaacgaagctgacgaatgtgtgtactatcgctatggtgagggagagggagtgatcttgtgtttatatgtcgatgacatattgatctttgggaccagcctcaatgtgattgaggaggtcaaggactttctgtccaaatgctttgaaatgaaggatttgggagtggctgatgttattcttaacattaatctactgagaggagatgagggtgggattacacttgtgcaatctcactatgtggacaaggtcttgagtcgctttggttatagtgactgcaaggcagctcctactccttatgatcccagtgtgctattaaggaaaaactaaagaatagcaagggatcaattgagatactcttagatcgttggttcattgatgtacttagctagt

SEQ ID NO: 57591 - DNA, 1890 bp, Oryza sativa
catccaggcatgttaaaagaagactgaagtctgtcagaaagcagaaaaactccggagtgatagcattggactatgtccagacggctaaaaatctggcagatcagtttaccaaggggctaggacgtaatgtgatagacagtgcatcgagggagatgggcttgagacccacttacagttgcacaatagtgtaaacctgtccattgtgatcggagatcccgtgaatttggatggcgaaacaaactattgtgtagctgagagaagagaccctaaaatgagcctatcttcatgatgcacttctcttctaatctgtatggtaggatggtatacaccttaatgtgatccgagtggcttttcataaagcagagatgttggcctatagaacaccttagaaggaacacacctatatgagtctgactgctagtcacagtctatgagatctgggtgatctctagatactcatgaaaaggccaggagtatgacttatacgctcaaaacagaggggatgcaaacgacagcctagtaccagttaagggtttgagtgaaacctgaatcgcacaagactgacaattcaaggcatagtccattgttcagttgtgatctggtgtagctcttttcctaggtagaagttcaacttaacagtctccatcgaaacactggtatatctaacaggttcaattttgagaacatttcttgtgagccatgaaatttggttgggattgttagaataaatgggctaggcccaatttaattcaattaaaatctcaagagcgcacaagtaatgttagagagaataatactgccttgaaaatttaggtggaagaacctcaacttaaatagggtgatattagagattccctgttgaccggttaaggtgatggttggactgccacacgcatgcgcgcatgctgagtcggcctcggccgtgggccgtgggcgtagcgaggcgaggtggccgaccgagctgagcctgcctgctgctcttccgttttgtaacagacgagaataaagtcaccattaacaaatgaaattcattgtgttgtaacctccacaacaaatgagacattcattgtgttgtaacctccacaacaaatgagagattcattgtgttgtaacatccacaacaaatgagagatttatttgttgtaatcttcacaacaaatgaaagattcattatgtggtaaccttcacaacaaatgagattcattatgtggtaaccttcacaacaaatgagatttattttgtggtaaccttcacaacaaatgagatttatttgtgtggtaatggagatctctctctctacatataacgcaaggcagaggctctcaaagtgtgtgtcttcctcctactattgttccttggcgatactctccttctgttcctgcgctgtctctctgtttccccggttctgttcatcccgcgcgcagaggtgatcggaacgagcaggtgcctccgaaattccgtccgcttgagaacctgcacgggaaggcgggcgatcaagtttttgggtaccgcttcaagcgcgactgctctacatcatcttcaccaacattattgcgttctcttatctatgttgatgcttattctatattaagcatgctcatattgtacacatctagcactgtcactagatctactcaaattacaaatgtcatgtttattgtctaaatattttggattaaaatatggcgaattatgaccaaattttccaacacactacaactaaaagaatgtgactccatgagtaaatcacccaaaacggaagttggagggacgacttgggtttagcggcattcaatcaaacagctctggacaaaacaagagaatctgcaatcaggtaagaacttgctgctaatcattcaagttaaaatcaaatagtagggctgcaggaat

SEQ ID NO: 57592 - DNA, 1519 bp, Oryza sativa
attttttttatagatattacgggatctattcagaacactcttttgtgagaagttcgaaccatccacttaggaattatactacaatacaaacacactgtggtttgaatttttttcaaaactgcagattagtagtgaactcatcattgtcttcaaataaccaagcttgtgtccattgaattagcataatttgcctctcttaataaaacagtagggatcaataaaataaagcagtggtcaaagttgcattttggtactgttaatgtcaaaatcgatatgttcactagaccagagtagtataaattctgccattatgtctttacgtggaacactttgagatctgtatgcttagtgtattaatgattttgcacatatctatctaataaattatctgcatgaccattgcagctagctagccagctatgcatgtcctctaccatgactagagagaccggttggcaaaagggcataatgcactccagtgttctaaactgtttctttatcatatttctgcattaataaaaaaataacatttcggtgcgcagcggtgaccatgataccgttttgccatttcttggtacacaaacctgggtgaggtcactcaactatcccattgtagatgactggagagcttggcatgtggatggccagtccgcagggtgagttttaattatgtttgattagttctgttgtttggcttacataatcaaaatggttgtctaataagttttcagtatacaaactgctttcaggaataacttttctaaaacttcaattaatttgcagattcaccgtagcatatggaaacaacctgacatttgctactgttaaggtaacaacccatcaatgcacatccaattttatgaataatttatatatagatatttccaaaggttgttgtgaatggagttacgttctgattcacgattacatatcgttgatacaaattcaacccgcgtcatgatgaggatttttaatctgtattactgctaatgatatttactttagttcaaagattattctattttatcaaaaatttcttatattatttaaaaatgaaatcattggtatgcgaagaaatcctcacaacatgggaaagaccttgccacaccagtgttagcaacatttgtggccccaaggttcattttttaaatataagttcattgaaggttcattttttaatttatattagaaaggttaaaagataataaaatttcaaaaactctttagaaggaccttgatatcaccaaggggtcaaattggcgttcctaaacattcgatttgaatccggaacatttggtctaagattaagagttgtgatcttatagcaaaacgtccaatggcaaggtggtaaatcaagaactaaccacttgcagatcaaacaaacaacaaatatagctaccaaaatgtgtgaaacaagatacaaagaaaataacaatatcatcaactagattaaactaagcacataggtagatgaggcaaatgaagaataataatggaaaaacacacgagagacaaaatc

SEQ ID NO: 57593 - DNA, 1238 bp, Oryza sativa
ggcgaccgctgctccgtgctcagcgccctcttcttcgagatcggtcagcaacccaacagcaaacaagccccgttgtcacccaagagtgtcagatcatgtggtaaattcatcgcgtaagttgcgattaccccgcaggcccattgaagctggtcatcgagccctacaacggcagccttccgcggctgcactaccacccttactcgtggacaaaggtcgccagcatcctcttcgtcgactcgccggtcggcgcaggcttctccttctccagggatcccaaggggtacgacgtcggcgacgtctccgcgtcactgcagctcgtgaaattcctctccaacgtaagcccatgttctagttctacgcaattaattggctgtatttttcgaccatttttgttccaagaaacgcctctgatcgcctgtttcagtggttcggtggccatcctgagtacctcacgaatccgttctacgtcgggcgagactcttatgccggaaagatcgtcccatttatcgcgcagaagatctcagaaggttttgcatgtttcgcagcaattacgactacttcacaatttaacgattccctgtttttcagatattgaagcgggggtaagaccgactcttaatctcaaggttagccatctgtctgccattgattaatcgcagaagaatcattaccatggttaatacgcagtggctaattaacaagtaaaattgcagtctctcgtccttatcgaaatacgtcctcgtgtacaacttgcatctaactgtagttcatgtacggtcgatcttataatacgggcagtagtccaaaacgttaccatcgttcttgattaataatgtttgttcatcatataatagtacaaataagttcacctaaaagctttgacaagtttaattaggactgaccattcgtctatatggctagctatatccatttataattgtaggaactgttgttagagatagcaactgaactaaatactggcgccaattttattcagtaactagtcgaatccaataccaatatccggtctctatatccatgcatgacagattatgtactcgtactaattactttgcattttgagtgttattcagggctatgtagtagacaatccaactacaggcgaaaggatcgactacgaatcaaaggtgccatatctccatggtgtcggaatctttcagatcaattgtacgaggtaattttaattaactaaacacgcttcccatttattatgtcat

SEQ ID NO: 57594 - DNA, 838 bp, Oryza sativa
aattcctgcagcccctaagtttgataaagatgtgatgttttggcatcatagacttggacatgttggttttgatcatctcactaggttaagtggtttggatcttgttcatggtttgcctaaacttaagaaagatcttgatttggtttgtacaccgtgtcgtcatgctaagatggttgcttcttcacatgctcctattgtttctgtgatgacggatgcaccgggacagctattacacaaggacactgttggtccagctagagtgcaatccatggaggaaagtggtatgtattggttattgttgacgatttttcttgatattcttggcttttcaacactttcgtggtttgtttgttcgattggatcttgaatttcctggttctttgaaaagaattcgaagtgataatggtggtgagtttaaaaatgcttcttttgaacaattttgaaatgaaagaggtcttgaacatgaattttcttctcctcgtgttccgcaacaaaacggtgttgttggaaggaaaaatcgtgttttggttgagatggctagaacgatgttggatgaatataaaactcctagaaaattttgggctgaggctattaacgttgcatgctatatttcaaatcgggttttcctgaggtcaatacttggaaaaacttcttatgaacttcgatttggacgtcaacccaaagtttcacatttgcgtattttttgttgcaagtgctttgtcttgaaatctggacatttgaataagtttgagtcacgttttactgatggattgtttcttggttaccccgaacatactcgtggctatcgtgtacttattttggagactaacaaaatcgt

SEQ ID NO: 57595 - DNA, 2931 bp, Oryza sativa
ttaagttgtcaagtaaataatgaggtatttaaatcatacacttgagtttggaatttggtattctacttcatcttctatatgcttaagtggatattccgatgctgattttggtggttgtagaattgataggaaaagtacgggtggaacatgtcattttcttgatacatcattgattccatggtcttctaggaaacaatctagtatttctcaatcaactgctgaatctgaatatgttgctgctgctagttgttgttcatagattctttgacttttatctactttgaaatattatggacttacttttgagaaagtacctctcttttgtgataatactagtgctattaacattgctaagaatcatgttcaacactcacgcacaaagcacattgatattcgctttcattttttgagggatcatgttgagaagggagatgttgaattgcagtttttggacacaaacttgcaacttactgatattttcactaaacctttggattctaatcgttttgcttttcttcgtggtgaattggggataattcatccttttggcatgatttgagggggagtttgtacctcatggttttatcaagcaaaaaatatgacaatgagaaaaattgagaaaagagagctttgtttatacatgtggtattttcttgtacatgctagcaatactttgaaggtttatttgtctctaacatagcttgtttgtattctagtctttgcatgagatttagattttgctttttaagggagatgatgcatgacacttaaattctatatttgaattaagtaaatatgcaatgttgacgctagcatgtggtttgatttctaaatgctctatatatatgctttattgaattgttattcctcgaatagctttaatttcttattgtgaaaagagaataaaaatatggaaaaaatgaataccgaatccttggaaatagtcttgatgacaaggaagtattcaatgtgagcaaaataatgggtgccgaatccctggaaacagtcttgacgatagggacgtacccagaataaaagagaaaaatataagcaaaaaggctcaagaaaagaaaaagttaaaaattctcttggttattttctgctaaaggttatttgagaaagagtgataaatgcaataggtctatatgtttagtgtttatttttcaacctatgtgcttgttaagatgttgcattataattcgtatgaaatcatgaattttgattgttgattcaagcttaattgtaaactctttggttcatggttatattttaatgcatgcttgctatattatagatgggttcatcttctttttattgcaacaaatgacatgatatgctatatgtatgctaagctcttatccattaatgaacataattcctatgcttgatgaaatcattgtcaaaagggggagaagccaagtgaaaatttttggagaagcaaatttctttcttttcaaaagtaagagaagttttcttttggattttcgagcacgatgtgtacgtttgtacgaagtgtgctttttaccagttttgtttttatttttccaaacaccaaaacatttttgatgggtttgccaatgtgttcatcaaggggttaattgtaaaatcaaaggtgtttttgattattattctgtgatgaacaattggcattggagattattggttttgatatttaaaattcattcacgaagtggttttggagatgattggatttcacaggtgaatctacaggttactactggattgggtccggtcagaccgggcagtggttgccggtcagaccggcgcaactcgcggtctgaccggccgactctgtgtcggtttcggtttcggattgtttgtttggatatccatgattgtttcatgattatagcttctagatggatactatacgtatgtaatactgttgtttgctacaaatgagtcaagttggagatagcttggtctcggaggaatatggtttctttgtttgttctttgtgtaggtgactcggatgccgggagagtatttgcggtgatggaccgggagtcggcttggggataagacgacatccgtggtggtcagagatcatgcgggatactatggctagagttcaatacacgtggttggtgaagattctatatggcatacaatggaggtattgtgtgcgtatgggatatggagtccaatttttaaggagtccaaatttggtatgattggttatgtaaagtttgtatcttgcctagagggtttctaaggtgtttaggacttctagtatgtgtttgattcgtggctttaggctgcctacctctagtataaatagagggggagcgtgaggctttccggtatcacttttgagagcaaatgagttgagagttgagttagggtttcgagtttagtcgaaatttttgtaaggagtgctgttggtccactttgtaaacacagagagaatcaataaagtcgtcatccactttaagagttcttcgatttgtgtttcaccgggtttcggcggtctaaccggcgacgcaccggcggttagaccggcggcattggtttcaccgggtttcggcggtctaacctacggcgcaccggcggtcagaccggcggcatcgcagtggtcagactggcgggcacacggcggtcagaccggcgtcggcgacaagtttcggcggttagaccggaagatcaacaccggtcagaccggcggctacgcttcgatcagaccggctaatctactccggtcagaccgatctccatcgaattcgagggtaacttttatttccactaaaagtttttggtttttgggtataccaaccattcaccctcctctggttggcttaggtattgtgtttcgatcctacaagtggtatcagagccttgttttcttctttggattttaaccgatctagagtttttgccatggctgatagattttcaactaagcctcatgtt

SEQ ID NO: 57596 - DNA, 8043 bp, Oryza sativa
caccacgtacggttgtgcaggtaggcacaagaaaggtcacaaacaaaaatacgatagatatgggtttgctgtcggggtgatgaagagagtcaggacacaatatctcctgctcagagcgggttttcttagtcataagataatctaccgtcgttaaataaaatacggtaacataacatcttttaacagtttttaataaagaataaatgagttgctttttttagtaaagaataaatgagttgcctgcgcaagtgtgtatatgtgcgggcttcccgctagttcatgtaagtactataaatatagttttgaacatacaatttttgttaagttgattttaacagaaattcccatataattattttccactggaaaggatatcaaggataaaacttttccaaaagcacgagaataaacaaaaaaccaagttgtacctcgttgaacctagccatagcttgtctgcaaatcagattcttgggcttgtcgtagtcctcccctttgcagtgctccaatatcatctgaagaccaggtgtgtcacagttaataatattaagaaatgtacaagtcactctttactattccgactccatgaaatcaagttgcacttgtctccttattttgtataattgatctgaaattattccgactccatgaaaatatggcacctttgatttgttgtcaatactttcgcctgtaactggattacctactagatagccctgagaatctcccaaaacgcaaaatattcagcacgagtgcataatcaattatacagagataacgagaaaaatatacagtacaaacttaaaaattattgtaggataaaaataaatgtctgagatttattcttatcaccatatcaccatgagtattttttttgggagaatagccaagatgctccctaaagtttcgctcatgagtcattttagtacttaatctttcatattatccaaacaagtcctttaaatttgtcacatgggctgatatagtccttggtcccaccaaaatcgccacataaacatgccatgtcacccttctatgcaaaatctatatgatttcttcaatttacccttacatatatcatagtaaaataaaaaacaaaaggaaaaagttaaaaaatatggtatatgtaagagcaaaaatatacgtcaaaagggtgaaaaaaggaaaagtattttttttcctatggttatgtctaattcacctttacatttatttttctatgatatacgtaagggtaaactgaacaatttatcatagattttccatgaatgatgacatgtcatatctatatgacgattttggtggactcaaggattattctaggccttatgataaagtttaaggatttctttgaactatttaaaaggttatggactaaactgatcctacataaaaactttagggactacaggagctattctccctatttttttagtcctaaccatggtagtttacatgtagagattggttactcgtagactagagataggaggtggggaccaagtccgtatattatgtaaagagattaagctttgaatactgtattaccttatattctaaggtacagtatgaaatcttagtcttatatgactgtataactgtataatgaaatccatgtcatgttcgactgagttttcctctttgtaatcttacccccgaacctatatacataaggagggcagggagcccctccaaggacataaccacactaagattgtgagatcaataatacacccgacagatacaatttccgaaacaggaatagtgtattaaccagtctaacctttgttcgtttactcatctattttaaatcccgtgtgctactttcttttctcattgccgatttctagaatcgacatatagagttttattttctcgggtttctaggtactgtattcgctgtctctgcccgcgaaaaaaaaaacgttgctatttaacaacagttcctacaatgaaatttgcaccgtacaaaaggcataaatactgctaccttctgagtaagtgcggttctaactcctaaccctctggaattccttaaaacagaggaatgtctgatcacaaacttgtcaagctattaggtgaaactgatttgagctgtgaacaaacataaatcatgaggaagtaatgtttcaactactgctcatattttcaatttttttttcggggaaccccatattcgtactagtactgactatacatcaactacagttcctcgaagagcaaattgtacagaggacatctacatatgtgaaagcaacaagctttctcaaaaactaatgagccacgtcagttgaactaataatagccttaggatgagagtatgaataaatcaggaccgttggatcatgtaaaccaatcacagaatcaggagagttccagttcccacgcatcggtgcacatatgcagatagtttatggtagttagagcaaatctagtcaaagaaacaataaataaataaaaaggaagtatcgggaaggttgcacaacaatgaaaggagaggataaaaaaaaccagcgataatctctcctattctccggagaagacacaatacacacaagagagacgatccaaatccccaaatcttgggcgcagtctccgtcgtctcgctctcgcatcagccttgcgacaccccaatatagatggcctactaatattgacaggttatattagaactcagagtcgcgcgaagcgcgacagggtggctagtattttgatacatatgggagaccacagttttatttcttaagttgcaccaactaattaattccaatgactttttttgcgaggaattaaatcaattaatggaaaagacttggctaaccttcagattaagagttggtctaaccgccgcttcaatgtctgaaaaacagaggagcgatcaagcatgaactggtttaattaagcttgtagcagtagtagtaattcttgtgaacaagtagggatctcgggtaataaatgtaacgtaacattgcaacaccttcggagatcttctccgtgatgaacgggacgaacctcccggccatggagtcccccccgacgtagaacggattcgcgagatattcaggatggccatcgaaccactgaacaagacgagcaacaggttacaacgatcacgagacaaccacgaacaattagcataggatagacagtgcatgcatgcgtggatcgatactcggtagagaaatttcacgatctgcagcgacgaggatacttcgctgacgtcgtagccgttggggtcccgggagaaggagaagccggcgcccatcggcgagtcgacgaacaggatgttcgccacctttgtccacgagtaggggtggtaacgcagccgcggcaggccgccgttgtacggctcgatgaccagcttcattgggcctgcaggcaagaaagcagctactagcagattgataaattggaggacggtgtgtcagtggcactgctcggggtggaagatggttgctgaccgatctcgaagaagagggcgctgaggacggagcagcggtcgccgccggtgagccagaggaggacggggtcgctcccgaggtcgccctccgactcgattaagtagtagaacagttcgccgccgttcacctcgtcgacggtcacgtagctggcaagttgtagcacgtagcgtcagcacgacccctctcaccgactgatgcagagcagagaccagaaaactttgggcgtacgagatggacgcacccggtctcgaggcgggaagggagggcgccgtcgaaacccggtaggctggcgacatgcgtccgcgtcattggcgcgtcggcgttggcgtcggcggtgacgccggagacgatgcagattacgatgagcgggaggagcaaggccatcgtcgcattgaaggacgacaccgtcaaacagctcggcacccctacttgcggtttattgcatattggggagacgatagttacaaaacatgcgcaatttgtaaaaagggggacctcgatgtcggattctctagatcgaccaatcagtaattatggtacagctatatgtacccaggcccggtaattttggcccgacggtcgttcccgtgccagccaagcccaacagtcgtgccgtgcctgagctgctccggtcgtggttgtgctggcccggcccaacagccgtgtcgtgtctaggctgctaccttagcacgctgggccggcacggcctggcccgaagtttagggatgcgaaacagatttattctcaaccatatgtaaagcacgtcacaaagaatagggaggaaaagtagccttattatattgcacggctcaaagagtagggatgtaaaatagacttattttagctatatatatatgtatatatatatatatatatgtatatatatatatagacacacacttctacttctactactacttaaaaagtataagatgtttccttcgtccgttaattaaaaaaagcgataaaaaaaagttcgattgtaattaaaaagtccggcgcgaaaaaaaacggcgcgggaaaaaaaaacctgaccgattcctgtccgtataaaaaagcggacaaaaaaagtgccgcaaaaaaaacgattgtaaaaaaaacccggcacggcagaaaaaacatataaaagagccaaaaaaacaaaattttcgtccctttctttttttcctttttccttttcattttcttttcgccatttttttcaccatttttccagtttcaacgaaatccaacacgctatttttttggcggtttttttttgtggggccgaaccctagccgccgtatcgatttgcctctccatgtgtttcctcatccaattgattgaaaaacggattccccactactctctcatcattttccccttaaattccctttagttcgtcattttttatcccaaattttgcggattgcttcgatttttatgaaaaaaatagaaaaaggagatcaagtggattaaaatatgtcaataattttggaggtcgagaaagattcggccgcatttgacggagaggatcgactccatcattgtacgtgcacggtattatgcgagctcgactagattaccggatttggtgggaagatcggctccgtcatggtacggggcatgagactgttcgagatgggactacagctccacttgcgggctgagccgaagagaggtaggccactaggccaggcacaagactattcgagctgggcctacagctccacttatgggctgagccaaagagagataggccaggcaaaggactgttcgagctgggcctacagctccacttgtgggctgagccagagagagataggccgagcaaatagagacagcggactgcactgggactgagctgaaaaggaaggaaagaatgaacgttcggtccaaaaacaaaaacaagggagtatattgtatagtataaaaaatgtttttacctgttgcaacgcacgggcattttttctatatatatatgtgtgttcaactcctcttaaagttcaaccaaggacacggggaacgtgtgtgttcaactcctcttaaagttcaaccaaggacacaaagcaaaatgggcaaagcgtagagatgatttcctagtgaggaacagtgtgtacagaaaacttaaatttaatcctatcgcaatacttcaggcattggcttgctcgctgctaccagatctcgctttactccatacccggacagggaggaccggtgatctcgagggctatcaccacctctacaccaacctctaacgaaatgttagatacgcagcaatcactggtaattaaatacctagacattgcgtctatgcaattaattactattgtagcgttagttaaacactaaagtaatcactatctattattgaacaatagtgaacaataatccaatatgctaataggaactaactaagagataatcctcacaaagtaaaactcacttactcgataaagatattatcaattaaagcaaagtaattgacaaggtacaaaaggtaaagaggaaaatactgacaacttcggaattcctccgactctttcttccttactgtctgcctattctaatgtatataaaagatacaatagagcctcttataattcagctcatgcttgagcgtgtttagaagtgaggaagagaaggtatttataggtagggagatgctttgggaaaatgtggagatgctaagcatctaaatggcatcttcactctcctcttgccatgtgtcctcttgagaaacggtctcaagggtcttagaatatcggtaagtatctgcccgtgaaaaatggagccgattgggatccttttgtgttcggccaaacccttgctggcccattttgccccgaattttctcctgggctctggtgaaggactcctcggtgcatatatatatggtgaatgggcccatttgcttgtgtttgattaggtttgtgacacaaaaactccataggcttaaatatggaagtttaatttacctccttctttatgtatcttttgtctcaactttgatgatttgtcacctgcatccaaatatacaccaacgctagtggactttgttagaaataaaccctaccactatgttggatattttatactctcatatttatgcaggtattgacggcgtgaatttggtatttaacagcagtcaacaggcataattaccatttgccctgttaccgatagttataaataagcatgcaattttgcaaacaacacttttgatctcccaaatcatgggtttcaatgtgatcaaaggaagagggatgaactttccttaaacttgagtagttagaaaacacctaattcactccttcacctaaacgtaataatctatacatatgacactgtgcgtgggcatattatgacaaacttggacacgagactaggtagtaccataaaaaatcatgggtagatagaagaagttgtgtgcctttgttgattcagtctagaagataagagtttttaggaaggtgtttatgcatgatggccataggctactttttttggggaaatgtttatggatgatgaccatagactttgtctttctagaagatgtttttccataatgacctgcctgaagactatcttcccttcatgtctacttgactgactgccatgttgtctatggggctatgagctgatacagtagcaaaatttgctacaggacactcaaagattgtggcatttgctgtgagacacccaaaaatcgtgtatttgcttatggacactgtaaaaatatggtaattagctgctagacactcgaggcattattttattattttcggtgaaaacagagagaaagagtgttgaaagtaccaaaatgcccctgacactgttcttctttcttctctctttcctgcccctgacacaggtcgtgttcttcgctacaggtagcggcgccgtgcgggaggtgctgctcacgcggtgggaggggcgggatgaccaggagctgctgtacggtctcctcccggcaggggtggaccacggcaagctcatgggcagagcgcggttctgcctgtgcctgaccggcgatgacgagggcgcggccgcggcgagccgccgcgtcgtggaggccatcacggccggttgctgcaccgtgggcatcgccgtttccttgctgcgctgccgtcgccggtgagctccaaggccgaagccttcttcccctcgcgccattgcctctctctcttccccaattccggccaacgctgtccgttgccgcagcgccacctccacgccatcccagagccccgtgccacgccaccgggttcgcctccatctcctcttgcagatgccgacgctcgtcgcggcagccatgcgccgtcaccaacgaacgccgctgcgccgccgccatggcagagcacggccagggagccatggctgctctgcctcctcctccttctctcatatctggttgcagccggacctggtcggcttatacaaatggcccatgggcaaaatgtcttttaggaaagtttctctcaccgtttcagccggaaataataaaataatgggaggagtgtccgccagcaaattaccacatttttcggtgtccaagggcaaatacacgatcttcgggtgtctcacagcaaagaccataatcttt

SEQ ID NO: 57597 - DNA, 3104 bp, Oryza sativa
tgcactaaccacaccgagttgtctctgaaagtatgaactgtttacctgtagggttaagattgatttaagcgatggatgtatttgtttttttcaatttacttcattcaatatatggcaacatgtcttacacgtgcacgctcactaatatcaactaaacaaacaacagccataaccacccacatccctcaaactcccattcactcttaatagttcccccaactaaatgccctgtaatgggtctgccgatccatttgagttatctatatctctaaacataaatctaatagttaaagaataatgggtattatggtttaagggaaatcgagtagttttttttaaagaaccacgtgacactctttgaagcatttgcaggagcatcatatgcttaggagcgtttatagtatgaacttttagtatataattatagacaaataatttatattgctttaaaagtttaaaacaatagtgttttagaatatataccaccgaaatttgtgaccggtttgatagacgccttatgtctgatcggtttcccagatgtattggtagtgctctttcttttttttttcaatatgcataaaaattctctcctgttaaacggactaaattataaacatagtttagacgcttggtttattcaaaatccctagattattgtctcaatttcctgagagtgccaaagtacgtaggtatctattttattagaatatatctgccaaactttgagcagccaataaaataatcacaaaatattaaaatacctcatcgaaaactagcacctgaagataaagaggaagtaaaattcttcaaatgattggacagatcaagcttttgttttcaagcactagctcaggattggcacatggcaccagcatgacttgttccatgaaaaactttatctgcctcgaccgcgtacgatatttcagaatctggtacagcatggtgcaaggtaattaattaaccagaaatcgagaaaatacatatccatcatattgtgtacactgtacagctagccggctagcataatcattaatttatcacagtggcatgtttgaaatccagcgcctaaacatggctgagcatctccccggctggtactctggtgcagtatgtccaccaccctgatagattgaggaaaaagcgtaaacatttcataaaaaaagtaaaagcctaaacatttcataaaaaaagtaaaagcgtaaacaaaatatatcaagcaatttgaaactactatttttctttatcttgttgcggacaaaatggttatttgacgatccttaaataccaaatctgaccatcaaatcattcataaaagaaaataaaatgaaacaccaaacctaatggtaggaattattactaaccacgagttggtacgtatctgtaatctcacaagcaacactacttccggtgactaacccacttgcatgcggcagatttgtcaagatgtttgatgtgatgctctcgcttctcttatatgcaaaattgcagaggaatccagaggcggagtgaacaaagatacacgatttgagacctgagattcgaaatgaagagaataacggcaagtatcactgttatgttcagttttaattgttcgtgtgaaggttgataatgtgggaaaatagagtatagttctgtgtgcacctcaaaatgacatgcttgatggataacttgtttgatattatatgtttgatctattgaaggtaaggactaaggagctttaaacttctagtttatctgttattataatacctgaattttcttataaaatatgatatttgatacttcgacattatgtgtgcagattgtactttatgatttattagttttatttttctgttcaagattgactactgatgttggacataggttccacataagcatagattcactagtcatatacatcacccttgcctaagaaacacgtggtctttaagctctttcatgtaatcgtagcaatgcctgtcttaatagatttgttcccagatactatatttttgcaatcatgtatgtgcaatgtatttaatgaaaatttaaattttaaaatatatgaacataggattatctcaggctgttgtttttgtttcttgcaggttccatgatgaggactttgttttgctgttccatgactggcatcggctgctccagcatggcagtggcttcaagctttcaaccacagttgagtttgtatgcttctgtaatcttaggacaccgatgccggccggtaaggcggtgaccaaaaccacttatatgcggtttcttttacaaatttgtatcttatttgaagagaactccaattttgttatcttggtaccgtggatttacattcacaagttggaaagaatataatatatggacattgtactttagatccgatcgatgtttactgcttgctatctactacttatttattgtagtattttacaaacttggttttacttctattaggccctgtttagatcctctaaaatggtaaaagttttaccattttgtagcactttttgccattttggatctaaacactagtagcaaaagttggcaatttggcatttggcatttgctagtccatagtagcaaattgtgccaaaaaatgctttgggaccactccctctctctttctctctctcactttagtgctagaatggcaaaactttaacatgcatctaaacaccaactagtacttttgcaatgccaaaacttttgctaccaaaacttttgccatttgccatttgccattccaaatggatctaaacaggcccttagtcttgaaaaatatatatatggtactgaaataatgggaagaagctcctatatgcttgttgaagcatatcatgcgtgtggagaatttagagccccaaatgattggaagcaactagagtacttgacatagtgttttagaatattttttttgttagcaacatttagttaaaagttcagctacttgactaaactagttcctttttgcaggaggaggtcctagaggaaccactgatcctgttgctcaaattcacttgatgatgaagacattgtacaatggatagaacttggtagatggaaagttgctactaggaacttctttgtacttagagaatattgggatttatgtg

SEQ ID NO: 57598 - DNA, 763 bp, Oryza sativa
aaacttttagcggaaataaaagttaccctcgaattcgatggagatcggtctgtccggaataaattagccggtttgattgaagcgtagccgccggtctgaccggtattgatcttacggcctaaccgccgaaacttgtcgccgcctcctgttaccgacgccggtctgaccgccatgtgcccgccagtctgaccgccgcgatgccgccggtctgaccgccggtgcgccgccggttagaccaccgaaacccggtgaaacacaaatcgaagaactcttaaagtggatgacgactttattaattctctctgtgtttacaaagtgcaccaacaacactcgttacaaaaatttcgactaaactcgaaaccctaactcaactctcaactcaattgctctcaaaagcgatacagggaagcctcacgctccccttctatttatactcaaggtaagcagcctaaagccacgaatcaaatacatactagaagtcctaaacaccttaggaaaccctctggtacaagaaacaaactttacataaccaatcataccaaatttggacaacttacaaagtcgactctacatcccatacgcacacaatacctccattgtatgccatatggaatcttcaccaaccacgtgtattgaattctagccatagtatctcgcatgatctctgaccaccacagacgtcgtcttatccctaagccgactcccggtccatcaccgcaaatactctcctggcatccgagtcacctacatatagaacaaacaa

SEQ ID NO: 57599 - DNA, 3552 bp, Oryza sativa
attcctgcagcccgctccaactgagaagaacttcaactctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaaccaaccacctaaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccctacccctcaaaaggcagtgggcggtcccctcttgcgccgcggtgaatccggcagctggacaaccgaacacctcggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgactagcaaaaccatgcactcacagcccgccattcagaatattttaattaactgacacccttgcggtggcaccaatctaaagctatgccaatagacaaagtctatgtaataatgtgatccccatttgtgtactagttgaactaagcatggctaagcatttcctaagccaacatctagtcattttgatacccaagttatcaatggcatcaggtaaccaatatgtggctgaggaataggacccatcccacattacattgtaaaagaatgcaacatttaatagaaatgcgggatatttgtaaattgggtacaatatgatcaaacgtattgcatgacttgccttgctctcgaactgatgagacctcagcaacgtcttcgagaaaccgcggatcgacgaaacggccaaaacctatgcgacaaacaaagcacacaagcaaaacatgctataagactacagaaacaggaaacaaaaccatttttaatggattctttgcatttttcttgatttactgagacttgaatggacttaaacggagctcggatgaattacttaagaattttagaagataaactgtgtttttactaataaagaaaaagccttaatcattttattgcgcaataaagcccagggctgacgtcagtgaaagggggggcgccggcacgtgggccccacgggtcagcggctccaaagggagggaggtggcgcctggcaggtgggccccaccaggcggtggctcaaaggggaggcgagggaggcgccggccgggctcggctctgcctaagggccgaccggccgaccaaggcgaggcggcggcgaggcacggccaccgacggcggtgaccggcggtgcgggaagcggcggcgacggccgaaaggcagcggcgcatggccggagcagcggcgtggccggcgctcgcgggaaggtgaggaaaggagggggagggaggactcaccggcgacacggcggccggagcggaagacgaaggcggcgacgacgacccgacgagaggaggggcggacgagcggcggcgacacctagaggaggggaggagaggagttagggatggagaaggcgaccgcgacgaccaaagtggctggccggagacggaggggaatggatagctcaccggctcgcgagggagatgcggttccggtggggttccggcgacgcgaggcggtggccaagatggcccacacggcggcggagctagccgcggcggcggcttggcgcggcggcggccctagtggcgacggcacgcggccggagatgggcggcagcggcggagctcggcgagcgcggcgcgacggcggtagagggcgtgggagaggacggtgaatgggggaaatgagagagagagctcgagtgagggtttttatggcgagggaggggcggaaacggccggggatggcccctatttggccggcgacgtggagaggtggaggagagaaagagggtgttgggggatttcaaatcccccaccacttgcgggtgcgcgcgcgcgggggagatgcgggggagagggcggcgacgtgggcgcgaggtgcgggcgcggagtggaggcgcgacgtgcagcggagaaggcggcggcgcgggcggttggagctccggctccaacgaccagaggtaagggacgaccgacaggtgggccccacctgtcggcacccgaaagagaaagggagggagggaggacttcggggaggggaaaggaggagcgggccggcccaggaaaggggtgccgagcgcggggagagagatgggccgatggcccatctagagaaaaaggaaggaaaagaaaagaaaaagaggagaaggattttcctgggattagatattgcactttggtgatttttaattggttaaaattatttccaaggctctgaaaattccactaaaaatcttgttaatgcattggagcatggggaactcaagaaaaattccaccacgctatttccgattattaattgcatttattaattatggaattagctctaggttaattaagataatttcttcggacgatttatttaacaaatatttaaagcaaggaaaaagggggaaacttctgggcgtgacaagcttgcagtgtgtgagtgaagtgaagaggtgaagtccttatataagggtaggtatgacggttagaaaacacaaaatgtcctttttgcccttcaaccgctatcaggagttcatccagattgtccatgccaaaacctagatcgaacggccgttggagtggttcggcagaacccatgaccgttcatgccaaaaccttgatcgaactgccgtgggagtggttcggccgaacccaggccaggtccaacaggcccaagttttggcatgttgtctctcctcctcctccactatccatatctacgagtggaaggcccaattgaatatgttttctgatagtttctggcccactcttgatatggatgggaattctccttcacttaagtctatatttcatccatctttggcggtttattacctgcatataaatatacactaacactttgtggaatatgttagaatttaacgctatcactatattggatgttctatttctttgatttatgcaggtattggtggcataaaatttgtcattaacagcgccaacaagcagctaattaccagttatttgcggtgctctatagttgatacacgtttttgcggtgttctctagccaattacaaattttctggatatcctgtaacatattttgcctcagtgcaacatgctagtccttccatggtctttctaccggttgtcttatggtttggtagggggggacgtatttggg

SEQ ID NO: 57600 - DNA, 8690 bp, Oryza sativa
gcccgtagtagtagctacagttgaacaacaatatgtctgtttacaccgaaatttggcacctatgcacgaaataggggaaaattgccaaagtttggaaagtgtcgggtttccttcacggggcggtcagaccgtaggtatgtgggcggtctgaccgtggcttgaactccagtctgaccgcaggtatgggtccggtcagaccgtcagattccgagtctgagtatgttttcgtcgggtctcgggttttcttgcttgggaaggcatattttggatttcctttggtttctataccaagttggacatggaggagagcctgtagagggcaagaccaacccctatttaagggacaaggccggttcaattgtaatctcccatacacacaatatacttgaatcgctttttcttttatctttactttttagctatgttttctattttaccctagttttagtccatctttgtcgatttgtgccgtaaattgtccgccgccgctgcgagagtgtgacacatctttgtaggtttgtcctgaaaacctttcgttttgcccacgaaacatgtaattatcctcatatcgatctaaaccggcttagaggctgattttgatctctaaatcggctccgttagccggtttagttgtttttctacataacccatcttgatttggccatttggctagatcgaggaggttggtgactccatatcaccgcaaggtgtttaggtgctgcaatcgtgcttgtcgacttgtcacaaaaagttgcccacaatgtcttccatagccagtttgatatgactaaccaatctaatgtttagctatgatcagtttattactctctccattctaaaatataacaacttttgggacggagggacagagtcatgaaaggagtagttgatttatgcagtttctacacttcaaaacaatgattaatacataggtttttaagtactttttttccaatcactgaacctggttcatttcatcgttcctattggatgatacctcgtgttttgttgtggtattaatagatgcatatatgtaaatttttttttagaattacacagtacaatgcagacactcacaacgcacgcacactcacccttatgagcatcttcgaagattgggccagcaaatcctggagagattgacgaagtccccacaggcgcctcgttgtcaacgggtacatcgcctaccactgaaagcacaacgccgttaaatactggaaaattcactcccatggggagtcgaacccaggacctcaggtgctactgaggctcttgtaatcattaggctataggatggatatatgtaaaatattgtacaaataatgaatgttaaaatgttatgaaaatgatacgggggagaagatgaagtgtttagattttgataattacccgtggataagaggtggcatagatataacaagcaaaacccaaaaatgtctacttaattcaataaattggcccaaacgtcacaaccagctgcagcaactttatcggcgaaaacatgataaatggaggtatatacgtgggccacccatttttgtctgaacatgagtgttttgtaggattatatatcacaggatgacgcatctataccaatcaactactatagttaacagaaagctacgttaatcaaaacaaacggttacatagtcctgacacaccagtacttaaatcttaaaattcactaatttgagaactaaacatgaatgatatttacttgggtctacctatatagaatttgaccgaaaactagggtccaaatcttggaagaaaaaaaaattcatccatgggatcacaatcccctaattttctgtctaatgttaattagtttatttataaccaccggtgcatatatttgctccaaggggaaaaagtgtttgtcctgtttcagctatccaggttggacacttgtgtatgtatttgtttgaagaaacttaaaaaaatgacatgttatttaggcttaagcaattaatgagttaattgtgacagaattatcagggaaatttcttttttttcctgctagcaattgtcatcataattcaactcatacaatcgcgaaaaaacggaagtgtacttgtctccttacactgtcaagcttggccaaagcttgtttgcaaatcaacttcaattcgcagtctccattgtcattttcagacaaatcacatacatatgcatttccaagcagagttaatcaagcccgagcaggaatcattcgacataattaaaattttgcgagcagcgtgtttaagtgcttacctcatatagctgatctgaattgattccgactccatggcagtacggcacttttgatgcgtagacaatgccttcgccagtaagcggcggattacctatcagatagccctgaccatctcccaaattgcaaattaattaatggccacgagcccatagtaaactatatcttgatatgggtaaggatacctgttcttctttatgtttgatcgacaacctatagcaatctagttatctctaacaccacttatttattatttaattaaatcatcgcgtgtaaaacacctgaatgtatctatagaaaaaaagaaaaatatggacatgtgaactaacttcagattaagcgtcgatctgaccccatcttcaatatctgcaaacagagtgcagactgtacccatgaaacatagccaaacaacacgtttctatgcgtcgacatgccacaacaacatatcaaaaaagggacaggacccttcacacaactccctttaatcaagcttaccacgttgaggtttcacccctgttgacggtcgataagtaccaatttcgactgtcaactatcataataaataaaaggataactaatatttcttacacttataacaactagaaaggtagcccacacatttacacgggcatatatcgtatgctaagtttgagacacttataaaagcgaaatattaaccggagaacatctgccacaatttctccataaagttttttcatcgacattaaatgtttttataattttctaacctattagctttatattatatcatatttaagtaatgtctgtaagcaattatttataatcttcttcttcatatgaaaagaaggtagacttattttctttggaaaacatgtcaacagaagtaaaaagtaaggtgttttttaattgcatatatattatgatagtttattatgggatgaattggtggggactataagggaggacaatgagaagattcacggagacaaattgaagatagggaagatcaacaaaagaatattgtatccgtgagggaatcattacgtgttttgagtctattttttatttagtggagacacatttttattaagtaattggtacacttaaattatactatcaaattttagtagtatataaacatttatcatcttttaaatttgatgagtgtagttggttatttgacactacttaaaaaattatatacaccatggaaatacgtagagcatcgtcatcattgttatcatggatcaaatttaactacatatacgtttctagattaatatataatagcacatttgatatcgtatttatttagaaaatatttcataactgtgatgcatagaatatcataactataatcaaaatatagttaacatgggtcttaaattattaatttaatcaaaaataatataaaaatacaaaccagttggaaattgcatgcacagttaagaagttatatttatttgaatactatttttaagtatttaaccacggtatactcttgcactatatacgtacactttattttttgactaagggggtatttaaatccatgggtgtaaagttttggtgtgtcacatcaggtattatatacgattatggggtgtttgggcactaataaaaaaactaattacagaatccgttagtaaaccacgagacaaatttattaagcctaattattccgtcattagcaaatgtttacaatagcaccatattatcaaaacatagagcaattaagtttaaaatattcatcacgaaaattagtcccaatctgtaccattagttttttttaaagtctatatttaatacttcatgtaggtgttcaaacgttcgatgtgatagagtgaaaaaatttaaagtgggatctaaacatatcctaacatatgtaggtacacttagagagagagaaaaaggttcgttatttttgaatagctccaaggccgaacataggcctgttattttacaaatgggacaattgcttattttaccccattttgaaccctaactgccaatttgaccctatttttttttgagtttgcttatttgaccctcctttttcaaaacgaagctccagtccaaccctgcttccactaatccgttaagtttttatttaaaataaaaaaagaaatgtaaccagtattcataatacccagaatttctctctctcgttcctgcgccaattgcggcgacagcactgagggggcggcggtggcgctccgagggggcagtggtggctgcgtgaatcggaacctcgcgccggcgtggaggtagaggagggcggcggcggcgctctgcgtgcgcggcggcggcgagacaggaggatccgcgccggcgcccggtcatcacggcagatccccagctggtgcggcagcggatccctagctcctgcgccccgcagtgggatgacgcatggggaaggaggaggcgtggcgcggccgacaccgatgaggggagcgagcaggaggaggcggcggcgcggggaggagggcccgaccctctctcgttgacatctccgcggcgtcggtggcatggggaaggaggtggtggaggcggcactgggaaggaggaggcggcggcggcgccgacgccgatgcggggagccagcaggaggaggcggcggcgggggcgccggcacgcggagagaggagcagcggcgggggcggcgtgaggagggaggtcgtggcagccggcgcggtggtgggaggaggggtggcgttgcgctggacacagtcggcggcatcggcaccgacacgcgaagagatcagtggtgacggggccggcgcgcctagggaggagggggtggcggggaggaaagaagcagaggtgaagagagaagagaggagaggaggagatgagaagagagaactacgggtgggtcgcacatgtaatagggtcaaatcattaaaggcataagagacattttgtgcttcagttaacaccattaggtgcctttaacagaatagggttataccgtatcttcattttcaaaaaggagggtcaaataagcaaactcaacaaagtagggtcaaattggtagttagggttcaaaacggggtcaaataagcaattgcccctttacaaatataatctaactgtttgacatgcatagtggatccatcagctttagttgaaatcgacggacggatctttttcttttttcttttatgataacttttgagagttatgatctatctaattacaattatatattaactgttagctagaaaaatatgaaaggtaagttagaaaataggagaggagaagagatacggagggtggagggagtacggattacgtacgtgcgcaaatacggtgcggggtgttgtaccggattttttaatagagaactaatggttaaaattgatgggtccacctatttaaaggaaaatcaatggttagatgtattttgtttttatcagaatttttaagattttctctactatattaaagtgccatgtggcggtttaggagcgtttgtagagcgccacgtggcggcttaggagcgtttgtaggaagtttaatggacttttagtatataatagataataaataaattaaatgtactggacctagagaattaacatggatgtagagaatatacatcaaagtgaaggaaaaatgaagccggcatgcaaagaaacacacctccgacgaatcatgtgcgagcacgcggatggaagggcccaccaggcagtatattagtatatactttgtataactgcttcattctagctaggctagttgatccatgctacagtaacggtctaatgacctttataggtagctctagcgctaacttgtctacccgtagggtgggagtcctaggggagtaagtgacattatttactagcacaagcacagtgcttaggttatataaatgccattggatgtgggtgtgccccacgaaaagtgaggtagatggtaggtggtgatatccatgtccatcatttgtattcctccacgttcgggtgtgacgtattgcgtaaatgcaataactacgcttgcagactagcagggagtggtctctcggtagtacctaggtgcctggaactaagtcctatgttgtaagcatgtatatgttaagtgtgtattagacatgattagtatagaagtacagttgtatcatagttctctaatactctgttctactaagcattaatatagaggtgaacatactgtgtgtccactaccttaatcatattatctttaactcctttttagactatggtggattaattgtagatagatgaatgatgtataatttatatctttacgccgccgccgtgcctgcagaatataaatacgatacccttgggaatactcatgggtaaaatgctacaacaatatccgtgcgcttgcagatttatctgtgaacgtaagaaataccaacaaccgccacctttaaataggggtgggcaaccccatgtgcaccgcgatgaatctcgcaactgatcaacgcttaaaccagggccaacccaactccatcacgccaacccttgcctggatacgttatagagggaagagctatactacagacccagttgtttcccacgaactagtccttagctgcctgggcgcttctatcaaaaccatatgcccatagcccaccattacgcatattgtcgttgaattaataccatgttgatccatgtccaatgtcatcatcattaatccaagaaataaggtatatgtgagattcccatagtgaggtagttgatctaagcatggctaggcatttcctaaaccaacatctagtcatattaattcccaacttatcaatggtacaagatgattaaactgtggctaagtatgtaggaaactaccccacatgacattgtaaaataatacagtatttaatacaaagcgagacatttgttagatgggtacaatatgtttaatgaggatgcatgacatgccttgctctagtgctgctgaaacctctgcaaccactttgaagtaaaacgggggttcacaactgatggaatctaagagacaaacaatgcacacaaagcaaacatgctataagtcttttgaaatggaaaataaaaacattttaaatgaattctaggcattttgatgaattcagtgcgatttgaaaggacataaatggagctcggatgaatatactaatagaaaaaaaactttatgaattattgcgcatgaaagctcgagcactgacgtaagtgaatggaggccagcaccgacaagcgggccgcacacgttgttgacataaggagggcggcgcacagtggactaagtccactaggctggggacaggtgcaccatgtggtgcacatgttgtgccgacgcagcagccacacgggcggcaaggtggacggcctagatctgtcgtggggcatatcagacggctgggaagcggcttcctgcggtcggccttccccaccgtgagggtgcgacatgcacagcccgatggtgccagacggcgaccatctggcgcgacggagggtgcgcggagcggcggcagaaggggaggaagaggaggggcggctcaccgagggctcacgacagcgggcaatgatgagaggacgatggcgacgcgaggaagatggcgacggctccgggtcggtgtcgatagtggcgaaccggtgacaggaaagacggaggaggtggcggacagggaccggcttgacctggggaggcacgcattgctggctagagggaggtgcgttctagcggtggaatgtgacgactaagtggcagttgaggggcttatcgacctcgtgatgctaacggttgatatgacgctcccaagggcggcgccaccggatcgaccttccttctgctccgccctcacagtagtcaccgtcgccgccgtcagcgtcgctcctagctgcctccgtctcaaccaccggagaagagaagggggagaggaatggggaagagatgaggagaggaagagggagtggagagggaatgtgaagccttagccaccagagcaaaggggaggagaagagaagaaaggtgtgtgtgagtggagaggaggtgtaaaaaaggtgaagatcaagaaagaaaaggtagtgcgtgtcagtgcggggacgcatggggcacacattctctccatgttgtctgcttgcgaaaatatactttcgcgggcaaccccacctattatcataggtggacctcttaaggagacgattgtgaaataaatttttgcatgcggccccttaaccatccccaaggagcgatttttgtaggtgagaggacttctggtccgcctggaacctagtgggggtctcgtcaaaaagaatcaaatttacaaaaaatagtcttgttttgagccttcccaaaaaagaattgattttattcacccatgacattcatactacaatcctccatttgtgcaagttacacgatatgcacatccatcatcatagtggtatgctggaaatccaacgcttaaacattgcaaagcacctctccggctcaaactctg

SEQ ID NO: 57601 - DNA, 1930 bp, Oryza sativa
tattcaaaacaagtaaaatcacaaacaataattagttggtcttttgtcaagttcttgaatttttttttcttcttctatcttgtcgttgataatgactaaggatgaaatataactggtttctttcatcgaactgttaataatgactacgggttagatatagaagttccttgctgtagaggccactaaaggaatagtttacatcatcaatgttgtttgattatttgaatgctagaaataaaataaattaattatatgtcctaggttcagctcaaagcatatgttattggatttgtttccattatacgaaaacggtcaaagcgtgcctcttaggctgtaattttgctgtatatttgtgttgagttgcatcaactgcctttggtcattgaaaaacataagctgaatgaggaagagagaataatacttttatacttcaacactccccaatgctatacgtacaagcaactcatagaagtgggctgtgtttttttatttaactatgatggaagccggtgcagatgcgtgggcatattagttattgttttatgaaagcaatgctaaaagaagtcgctaaaagaagtcacctcttatcatttctatgacgtgaaatagaccgtaaactttaatatatttaaatgataaaaatgtctcctagattaaaaaatcacttttgtcccagccacataatgaaataatatgtggagaaatttataattacactttgtcaacttatgtcacgctataggatagatgggaggccattaatatatatgttgaccatgcacttaaaattgttatggcaatggaaaaagctatggttgtttcaatttaagtgaaaaattaaaaaccaaattattttacgaatttattagattttctccaaatggctcaacttagtctgtattgacatttgctattttctgtttttttattttacatggttcttattttaagttagaaatataggcattgtgtacatttaactgttattttagttatgaatatggcaatagttagattagaaatcagatctatggcttaaatattatggtcatgttaatgttatagatcgtttctcttttagtttgatagaaacaaggagaaaggtagaggtggagatcggagagactgagtcatgaggagagggggcggggcaagttttatgtgcattttaggagtaggataaagtagaaagtagttcgtatttctaatttttctaaacgatttaagtgaaaacctgatgcttcttcttgataatttcaaatatttttttctaattcgtaagacatgacacatgatcgcgatttctctaaaaatatacctaatggttgaaaacaatgtgtccatcgattttagtgaaaaatcgatagttggatgtttatttcctcacaatttcttagagtttttctagttttaaagacattgtgaagttacgtacaaaggtaaaatctatatcttccttttttaatattttttaattgcacacgaaaataaaaaaaataagacagaagtgacatattttttttgaaacttgaaatataagtaaatatgtgtctttaaatgtaaatttagtcataaataacctaggaacatataattagcttattagctatataacttagatgttatagctgtttaaacttttttttttagaaattatgcttcctaactaatattgcacgtaaatagaagagtaaacaggagtaagataacgaggggagttgtgtacgttagtagttagtacgtacgcatttccatcgacatacgtgctggccatggaagggacgttgggttgggaagtgttttttttctaatctaaaataaatcaaatgcatgaaaataatgggtccacacaattaaatgaaatgcaatggttggatttttttttttaggaatttctttgatttattggagtacacatggcatcttagta

SEQ ID NO: 57602 - DNA, 6601 bp, Oryza sativa
tgcgttgcaacgggtgaaggattttttcttacaaaatcataagctgcaattagaaatctgatcgtctcaagttagcatgtgagtatgtctatttaaagagatttgtaaaaaaaagcgaaagaacttaaaaatgaatcaaatagggatatgtattttaaaaaaacgaatggacttaaataccgactcaaaaaggattacgtactgaagtactggcaaaaacatcttcaatttttatatcttttaataattagttaagaataaatagattagattagagataaatagatatatagggatgatgcgttttttctgccccttttaccatataatttttgcgttgcctaccaatgagatttttttcgctgctttttattttctgacgttgttttattggcttttttgtcgccacttttttttcattgattacgaatcagccttctttttcgctattttgttggacggcgttttttccggtctttttttccggctcgtttttatatggcattttttttgcacgaatcggacctctttttggctattgtttttggacgggacttttttttcgcacgaatcggacttctttttcgctattattttttacggcgttttttttgggcttttttttcagatggcgttttctttttcgcgtgacttttttttcacacggaggatggaaacattttagactttttaagtagtactagcaatagtgcccgtgcgttgcaacgggaaaaacaccgtttgatagtgtgacaccttaaaaacctcaaatcggtaaaaatcaagtctaaattgatatattaacaaataggtagaaccgagtctaatttgatgaattagcataggatttaggatttagttttagatttatttttcgagcctagttaggagtttatccgacgaaatttaatttaaaaaatctgagctttgatcaaatttactttcggcccaggtcctcccaagacgacccaaacttgggctggccatcttcggcgagccgagtcaattcgacagcctgcaagtcgagcagctgaccacggcacatatgcggggacggtccgatgcacttccacagcccattgggcgcagcgtaatctgttgctgcggcggcggcctgacgctaggcaaatctgagccgttcgatctattggacggctccgatcgtcctcttgccgaatgaagtgccaaccaggagagaggggcaaaaccctagctcccaaatctctctctctcctgatcctatttctcttcggcgataagcgagcggaacaatggcgaaggcggcgatggcggtttggcaagctagtgcacgcgtgcggtaatgaccgccgagcagctcctgctttgccggctgtggggcgcacctgagggcggcacaaagccgtgccacggcgtcggtggtctggctaggtgggcgcgcaaacagcgacgagcaccgagcggcatggacctctaggcgggaggggcgacgccaagccgacgcttcccgtcttcggcaaggtatggtggaggggtgctccagcacaacgcgcgcacagggaacccgacacgactacgaggaggtgaaggtgtggtggtgccgcttcccgaaaagctccggtgagctttgggacttcaagtccggtaagtaatccgaacccttagcttaattgattttgactgttagggttcttacctgaaattagggttcttcgaatttggggaattttgtcaggaaatttcaatctattttattccctctttttgagttaggggagtttcaatatcgtttatcctcttttaattttaggaacttcaatctagtttatccctttgctcaatttctttttttttctgctttggctagtgtttcatcgcacggacggggacggagggcgctgctcggtcccctcggaaagattgagattaagataagataagatttttacagacgacggaagtaaattcaatcgtaagatactattttattcttttttgttttaattttttttttgcctttttccgtttcgttattacggacgatggaaacgttttcaagtttttaagtagtagagatagagacatatactacaatgtcacgcataatagtatttatttttttaccgcgtcacatataattccttttttttggaattgtaccgaattcgtttttgtccgcttttttttaccacgtccaaagaatcgattcttttttttgcctttttttcacccgatttcttttcgcctggtcttttcacccgattcttttttttttatcggacagtccttttttttcgcctttttttacacgggatcggattccttttttccccggttttttctcgcccgattttttttcacctggtttttttgcccttttttatcacgtccacggaatcggattctttatttttttaccctatttttcgcccgattttttttatcatacagatttggttttttttcgcctttttttacatgggattggatttgttttttcccggttttttctccctgattttttttcgcctggtcttttcgcccgattctttttttttatcggacagtcggttttttttatttttttcgcctttttttacattggatcggattcgttttttccctcggtttttttcgtcttcttttactgcagtcaccgaatcggattctttattttttacccgattcttttttttatcggacagagtcgttttttttggcctttttttacacgggatcggatttgttttttccctagttttttctcgcctgatattaatcgcacacggacctttttctcttctttttacgtgaactcaaagggagtcggatgtatttttcacgggagtcggattttttttttgtttttttacagtttttctcgctttgttttctgttttctcgcttttttttctttcctacggacgacggaaacatgttgtattttttaagtagtgtatatatatatatatatatatatatatatagatagatagagatagagatagtagaagtagaagtagatagatagatagataaaaatgaaaatacaagcatattacatggttacggaaaaaaaaagaaactagcataccaacgcagcaacgctaatgttcgtgaggccatcaagcaaataaaatggaggtagcttgtatttgtatgcaatttagatgtactagcaaaatgcccgtgcgttgtaccggtaatgatatggtgactgaaatttgacttgaactatttatatgaagaaaatgaattgtatttaatgaaatataaattttctgcaatattaattatactctttgaaattataacaaaagtagtcgtgcgttccaacgaaaagaaaaaaaaaagataaaattgaattaaaacatattaaattctaattagatgaaatacaaattttctgaaaaattttggtatttttaagtaggtaggtatataattaaattaatttataagtaaagtaagtgcgataaataaaatgttatggttggatttaatttttattaaattttctatattaattacactcattgaaattttcttagaatttacatagcttcattgctaattttgataatacaaatatcattttagtatttatttaaataaaaatcttttttttctctatgggcttttttcagcccattttcttcttcagcccgcaagcgaccaaagtctacttaatacccccatactccttctctcacttggtggaccgccagcccgcgtgcggctcaagtggtgtggccgaaaccctcgatcgatctgagctattcgtttggatggacggctcagatcagttccatattgatgaaatccctaaccctaacactaaccctctccctccctctcccctagccgagccgagccggccgcctccccgacccccgacgccacctctccccctctccctctccccactagcgccgctttccctcccatcccctccggcggcgccgctccctctccccctccccccagccagccgcctcccctgccaccggcgtcgtctctcccaccaccggcgtcgtctctcccccccaccggcgccgcttcccttcccttcaccctcccttctcgctgtcacggcgcagcgacggcggggtgcggcggagacagcgccctcccaacggctgcgtcgacagcgtcggcggcatccgtgctccctctcccgctctccttcccgtctcgccggcacggcgcagcgacggcggggtgcggcggagacggcggcgacggccatccctccccctctccctgtcagcctcgacggcaacgacgtcctcccaacggcggcgtcggcttcgtccgcgggtggatccgtcggcagtggcggcgaccgctggcggattcgggctccctccgcgcctctcttctcccttcggcaacagtggtggcgtaagctaccgccgatttttttagtttttttgcattttttttcatgtctattgctaaccaaatcggattgcgtacggacgaaaacacggataaaaattagacgtgacgaaaggaaaaacacgaatatttatattagttatagatagatatattagaaaaatattattatgtttctattatatttcaaattttacacgaatgatgcggggacagcagcactgcatgcagccacgtttccagcttttcgcagagagaagaattcaacgcaaagaagctcgaaaaagaaaaaaaaaatgaaaacagggggcccgtcgaaagcagcccatcctcagcccatagtccaacaccactaatccctaattccgtcctctccctcccactaccctcagccgccaccaaccagtccatcgtcgcatcctccgtgcaagcagcagccggctcgccgcctctgcccctaccttctccactcctctttctctcatcttccgccccaagcttgcactctcatcctgcccgtcgtggtgcgcccgcggtgcattttgcctcatgtgcactccgagacactgcaacgacggtgaagaggaggagaaggcggctacagtgaccatggagatggtagatctggcggtgggcggctagcaaggtgaaggctagctatgggtcgagggcagcagccagcaagcaaggcggaggtccgatttgtcggagccagcaaggtggagtctcaaactcttaggtccgatttgtcgattacttcctcttgcaatgctaattttgtttttattgggatgggtttgatttcttccatggatccctctgctttgactataattgaattggtgtggattagagtccaatttgtgtggattagagtctaatttgacaattcagtgttctcttttcttttcagtttcgtgtatgaactgggaattggaaatttagagacgatctagttgtgtaggaaattttggggtccaaattgacaaacttaatgttctcgcttcaatttcgtgtacgagttgggaattgagaatttggaaacgatctagctacgtgggaatttttgattttgttcatgtgtttatgcttgacttttccctgtctgattctgaggatgcacgcagctgtgaaagcgcattgtgacgggacgaatcgaagtgtgacgattggaaaattacgattttttatattaggtatagatatagaaaggattgaggagggaaggaaactgtggagtgtggacacaatcgaccggagaaatcaactctcctttgctcatgaccgaggcagactcgcttttgatggacgaacgctggcggaagcagaaaaaaaaaatcaatacggacacgataggacgaaatcgtgacgaggacagacgaaacgtcctatgaatatggaattatttttaatttttataataggtaaagattatgataagatgcatctagcaatcgtaaatggattcggatgaggtaccaaaatcttgacaaaagcatcttcaacttttataatagtagatgttttagtctttttatctctcgtctagatttactagcatcaattagatactatcacccttacaagtcacttgtattttcacattcacccctacaacttaattaggtacaaagacccccataactcaatttcccttctaactttccctccatcagaattaattgatctctcctcgtttgctcaatttctcatgatttcatcttgtttgtcccagtttctagtgacccgtgagcctccatgggagctatgtttataggggtggacaaaaagctcgggctcatgagcttggctcgggtttggctcgagctcgcgaagctcggcttggctcgaagactaaacgagccgagcccaagctgcctcctgagctcgtttgtaaatcgagccgagcccaagctagcttgcaagctgctcggtaggcttgtcaagcttgtgcaaaatctgacctggcccattaacaggtctggcccatgagaaaccctaacctattatgcgtacagcacaggcactgaggcacagaaacccttcccttcccagttcccacacgtccacgccgccatcatgagtcagcgatggtcgagggcgaggggcatctggactgggcgacagggcgtgaggaatcgagggcttgagggcctcaccggcgccgccggccgccggccgccacctccctcccctgcactgtcggccgccatctccctac

SEQ ID NO: 57603 - DNA, 8488 bp, Oryza sativa
gcgccgtcggccgccgcctccctccctattcctagaggccacgccgctcgacgccctctgtgccgccggcccgcttcctcctccccgtgcgcggctgcaccgccttcggcctccctcctcagcgacgctcgtcgacagttcaagctggctcgagctagctcgagctttggaacgagccaagccaagctgcctttttgctcgttgtatttatcaagccaagccaagcctgtccctgacaagctttcacaagccgagccgagcctggctcggctcgtttccacccattacaccatgacacaatgacaaggcgagcacatttagggcatgtttagttggcaaaagattttgcccctgcaatgtcatgtagaatatacggacacatatttgaagtattaaacatagtctaataacaaaacaaattgcagattttgcctagaaactgcgatatgaatttattaagcctaattaatccgtcagcaaatatttaatgtagcatcacattgtcaaatcatggcgcaattaggcttaaaagttttgtcttgcaatttcctgaagaactgtgtaattggttttttttgtctgcatttaatactccatgtatatgtctaaacattcaatgtaacagcatgaaaaattttgtttgggaactaaacagacccttagaaatggtgatgggtggaagaccagaagaaaacgaggtggaagtttcttacatgctactaaaagagtactactccatccgtcccaaaataagtacagttttaacacttttcatgctcaacgctcgaccgtttgtcttatttgaaaaacaattatgattagtatttttattgttattagatgataggaattcctagatgataatacatgaatagtaatttatgtgtgactaatatttgtaatttttttttataaaattttcaaataagacagatggtcaaaacgcgggatacggatatctatagctgcacttattttgggacggaggtagtatcaaatttgaaactgactttactgctttggattttggacccttcaggacttgaaacattttgggacatgtttgttgttgtgatgttcaaaattcgaataatgactgacagttaactacacaagagaccaggctgagttggtttccaaattttcccaactcacctctctcttttttatcatgactgaaagatattggtttgttttttaaaaaaaattctatacgaaagttgctttaaaaatcatattaatctattttttataaaattgattaatatttaattaatcatacactaatgagttgctccgttttacgtccgcaagggactagttcccatccacaagtgccgaacacagcccatgtgtcatgctgcacccttgcgctatgattcctatcacaccaccatgttgaaggttgacatgggtcatgagaaattgagcaaacgaggagagaaattagtgaaaaatgaagggaggggaagttagaagagaaatttagttgttaggggtcttttatatctaattgagttgacgaggggaggatgaaaatacaataggggatatttggatttttccatatgaaattaagatatatataaaacacgatcccttttaaaatacctaccaccacacgtagcattagtagtgtagtaggatctaaatccgaacattgattattatggacattttaggttttttcttaattaaggtggaagggtattttagtgtttttgttgtggtccgaatcggtcgaaaagatgggctgctattgatcggccccagccgccctactctcgcgaaggcgcaggacgccgctgctcttctcacgctcatgcgttctcgcgacttccatacatcgtcactatgtgcgatagggtcagctcctacttttcctgtactagaaaaatgaagcttgcttatttatcttgtgatttttttcctggagcacatgtatactttttaaagtaattactttgagactgataaaatctatgtaaatatcatatattaaaagtattattcaatgtgtacttggatttatgtttgtagaatacctaggaagaattatagcatgacagtatacacaaaacaaacaggtgaatttcgtctcacttttgtaaatttaaattttgcatataataaaatactttttatttcttgctatttttctaaaaaatgttttaccttttctataatatgggattaacatgtttaagttacatgcttccaattttaacatatcacacttagcactaagggcatgaataacggtacaatcaccgtatacgagagaatgccattccgtatatattttctaatgtggaggtgagtgagagaagagagagatgatatgtctgttaattgctagatatatatgctacacacaatattttagacagcttaataccatatatgcactccatatacaaaatatagaactaaatttataatgtaggtaacatgttatatgaattctcttgtatatcatgtaaatatgttgtgggactattatagggcaaccgctctctaaactatttatcatgttctttttggatattgtgcaccaacatcctaaaatagtatgtaaatattgaaatattagtagaattactattttttgtcagctttttatatttgtttatacttatcttttttatacacaaattttattatttgttgttttatttttaagtaatatatgaatattataacccaatctaagcgtgtgcatttttttctttattacgttgcaaactatatcgtattctcttcttgagaaacatatgcttttaaaatggcattgacactgaaatttgatcattaatattcatgcaaattatattattattattattattagctataaaattaatactaatttaacgtcacaataattgtatatgagaccaatatactttgattttttttattccaagcatgttatatgctgcagtactcacaccaagggttcagctcgactcggctagcacaggcgcacagcacggccgaatgtggttagctgggatgagtgtgtttggtctagatagcagggacggcaggcgagacatccagaatttgcttgttattttttgttttctcccgcaccaaaacagcagtaaaacagcagtatatgcgtgtgacacaatggcggatttagtggatggtcccacccaaaaaaacagcatcaaccccactataaaaaatagcgactattaaaaagaaaaaaaaagcgatctattctactccatccgtcccaaaataagtagttttgcactattcatgtctaacctttgaccgttcgtcttatttgaaatttttttataattaatatttttattattattagataataaaacatgaatagtattttatatgggactaattgtttttaatttttttataaattttttaaataagacgtacggttaaacgttagacacggatatccacggttgtacttattttgggacggacgtagtatttctctttcctggcgcctggcacgcacggcccataggccccacacgcgagttgcgcgtgtatcgaattgatcgacgcgactctctcctccccctagcccgtagccctagcgacgacgcgatcgggatcggcgatctctgagactctgatctcatctgattttctcacgccacggccacgccacgcgattacagttcacacttcacagagccacgccgccgccggcgctcgcgcgagcgggcgcccccacgcccacgccgccgcgcgcgagtccgcattccgccgctggatcaaatcaagcatctcctgcgtacagtagctgccagccatgatcacttgtggcagcaatactttgagggcatctcgatcgttttcaggacgtctctggcttgacagctgagttgagattattcaggttgatctttttgcttggttcagatttcagacccgtcagactattcaattctgttttcctactcgttttacaggttctgaatttgccaaatgccgaccaaacgaactcaacatgacgtgattttgttggatgaagagaacataatgaagactttcatggtcattagaagacatagacccgataagaaaaaaaaaataatatggtaattttctttagactttcatagccatacaagcttctgtaaatcaaaattttacttaattactagttttatctatgcttgcattgtacatatgtgtttaggaaaaaaaatttaggtcagaccacccatatcctaaatccgccactggtataacaacccatttgcccaatgctttaatgacacgtggcataaagttaaatggtaaaaatggaccaatcagagataattagatttgcgagaaattggtgctgttccatagcactcgcgagagatgtggggttgggtgcatgtgcctgcattcgttactgttgccgctggtgaagttggtgatggcaaggctcttctgtcacgtgccactcaggtatctacatggcttagaagattggactgcactgagacctagaaccttccgcagggtatttcatgaagtatcagatacaaatcacacctaaaacggattagtgatatgcccgtgctaaacactacggtgtaattttaattttctttaaagaattttaaaatagcatgttaccaaaaacaatttcttgtatgatctatgcagttgagtcttaatctaatttatgtcgtctgtcaaatatattcatggcaagaataatatactgtgtgggtttaatagaacggattttcgccaatatctatttaaaagatgcattttcaaccctctaatttaaatatttaccaaacaaaaatcaaaaggttgaaagttttaaaaattgaaatgaaaatttaaaattttcaagtacaatttttcataattggagtaaacaatttaaacttaaaaagtggattaaaaatttttatgtgcatgaagatgagcggcgagtggtgacgagatagataaggcacacgttggccgctatcctttgagcacatagcacaagggcatgaatgtaaacccaaataacagtttggtatgaaacatatgtcaacgtaataatagcatgttcgtgctaatgctactgcggcatttggagcaacgactactataaccacaaattcacaaataaacaaccatttataacacaagaagttcatttaaaaaatcatatcgatggtgttcaaatccatacaaagattattacaattttggtcatttactcattgctacatttcatcaaagctacttggaaaaaaatatcatcttccaggaatcaagacagggatgaacgatttcatatcactggaactttaacccatgtctcacccttttgctaatacttcatttcactcttcacaacatagcacaactactgcactttagctaaaaagaacttctcagccatttcacaagttcacatgaacagaacaccatgttataacgaagcagccatttaataaaacaccttgtaaatgttataaccaataattattgatcaatttgtaatatatactgcaggaaactctggtatggtgttaaaaaaatagatacgcaaagtttctagcagcaaattaccttgttgcaatttacagggagaaaatgataatactcatggcaatacctcagattgagggcaaattaccccgcaacaggcattggtattccatcaaattttatgactgcaaaagaataaaaaaaaacttagctttgatactgaataccatcatgtttcgttttctgcccctcaaatcatttgatctgaggccaagtagagggaggagaagaacaacatttgcaggaacaaagaatcatgcagaagaaattatgcagtaattatgaacatctttacatttgatttgagaataaaattataagcaaattatggagcggccagaatcatgtatgaatgatccgtagttatcaactgatctacgatacactaaagatgcaaaatgtatgatcagggatttgctattaaaaaaataaaatggaactggattcattgttttgaagcaatgcatttgctgctgaaatggggaggattcctaacatgaggtgcttttatgtttcgtgaaaatcataagatatccatggcaaagggagtaaaccatgaaggaaatggtaagaaatgtgctcccggtcccctggtataaaactcatttacagacatgtagagtcaagggaccaactttgaaaaagcttccatcaacaactcgccgaacaatatgataagcctgcacgttttctacccagggataactccagatgattcatatcatgcaggtgctaaaacgggtgattaagcacatatgcttgacttgtgattcatatttcatggtaaaggctgacttggattttgctaacacatacagacaaaattgttgcattatactacttattttcactgcattgctatcagaaaccaagttgtcgtttaatacgatacaaacaaggaattcaattccaaatccttttcatggaaggacaacaaaattgacaatgcactatgatgatgggtgaaaaatcatgaaatttgtgcaaagtcatgattgacaatttaagaaaaatagtgtcacagttgtcccggacaagaaatgccagggaagtgcagctcaggctcagatgatgatgatttacttccaaacagcaggcaacacttgtctaaccgaaagtgcccaaccattcaactttcattctgaatttccgacagacgaccaaaagagagtaaccgcaaatgaagataatggagataaattacaggaaggcagtgcatctgcagcacaaatatgactcactaattcagacaaagaataccaaatcaaatgcatttgttcagatgatttagatgagacattcagatgtatcccttgtttcagagaactttgattctacgcaagtgctgagcttagttgcatctaaagcagagctagaaaggctaatgatcttttgtgttgttttctctcttggggaggaaaaagactaatgatatcaattcaaatgctattttgtcagtttaatcaaccacggttgttgtgttccgttcgaaccatcctttttttttctaatacttataactccatccactcagatcaatctcaacttgtttaaaaatgtgtacatccatcaggtattttagttgatgcagagacacatggaacatatattactcccacagatgtacacctacatagcgaaagtagtagaaagaactatccatgtgacaaccattaaaaacctgagaacaacctagttcccactgataatatttttggtcaggcaatgcagtttgaaaacgaacatcacttattgagccggtgtaaatgccagcgaactccaactaatataccctcttcctactatcgcaatcttttcaggttttgaaggcagatcaaataatgttgcatctgaatagacatgatctattcctagaatatttgccatggatggacagccaccaactgctgtgaagtaaagtgttcccatggtcatatcatcatcacctcaagggaaacaacattgcactgatgtgcaaaagaaaacatgcattttagtttcaggtgtatttgagtatgcagacagtaaaccaaatatgaaagcaagctaaaagtactaacttctgatggaaagtcatatagttatttcacaacatcctacattatgaagctatatatgaaatctcaaaaagctacatatggatggcagggagtttcaaggttggtggattccgaccacgcaccaaacattcattggtcttcatgatattagtaaattttgttactggtgactaactctttagcttaagcgctagaaaattcaatagaaaagctaaagatagatcatgaatttagtttagcctgaacttaaaataaaatgatgactaaaacatatcatcagctatttatcattccatatataggcaattcaattacagtttcacagaaacagaggagaaaaattaaggattttcagacaactacggtctgctgcaaattatatttaaaatagaaaatccattaaaaggtcacctctaatgtgcaaattctgcaggatttataagaccgggggataaggacataagtcttcactgcaggttacaggaagatgagcagctatacaagaaatcatgcaaattggaaaaaccgaggaattgtaggaaacctttccttcactcccagatcacagaaaagcaaaagaactcaccttcaatgtcatacaaggaattgtagtgcacctcacccagaaggttaaccaaagctatagaaaaggaacgaagggaatgatcaaataccaccatttttcattgggatagatttaccaaacccatgtgctaccatgaacctggtgccatacgattggaggtaaaaatatgagaaataattgcagtgtgtacaaacatggtagcatatataccttatcaagtgtaaaaccaacatatacttttgtataaaaaaatcagcataagcatttacatgaaaagttcagcatatacgcatctacagga

SEQ ID NO: 57604 - DNA, 4250 bp, Oryza sativa
aattcctgcagccctgatctttgcggcaaaccaattggaaggaccagtcggagactggtgggacacatacaaggaagcccgagaagaagatgctggagaaccaaactgggaggaatttaccacagacttccgtgacaacttcgtgcctgccgcggtgatgcggatgaagaagaatgagttcaggagactacggcaagggaataccacagtacaagagtacctgaactgtttcactcagctggcgcgctacgcgactagagatcttgccgacgaggaggaaaagatcgacaaattcattgaaggcttaaatgacgagttgcgcgggcccatgattggacaagaccacgatagtttctagagtttaatcaataaggtcgttagactagaaaacgaccggaaggtcgtggagcacaatcgtaaaaggaggcttgccatgaaccgcccgccccagaccgcaccccagcgtcctaaaggggcaacctcttcggcatggagaccaacagtggtgacaaccagtcgacctgccacctccagcaatttccacaggccggttaccattcaaaaccgagctcctgcaccgaatcaggccgccactggatcagtaaggccaggaagctgtttcaactgtggagagtatgggcatttcgccaataaatgtcctcatccaaacaagacacccattcgcaccggagctaatgcaacggctattcatgggactgctactcctgctgctggacgaggtctattcaggactccgcagactaacaggaccgctaccggatttggacgcgggcaagtgaaccacgttcgagctgaagaggcccaggaagaccaaggcgtgctgatgggtatgttttcactcaacttcactccagttaaagttctcttcgattcaggagcatcgcattcatttatatctctgaaagcaagtcaacaacacaatttaaccagagttaaactaaggcaaccaatgttagtacattcacctgggggtgaaatagccgtggacacagcttgcattgatgtacctattcgccttagggatgtggtgtttccctccaaccttatggttttgataccacagacccttgatgtcatattgggtatggattggttagcaaagcatagaggagtaattgactgtagacgtagagaagttaccctgatcacaccctggggatcggatatgagagcaaccatggatcaaaatcctaggctaaccgaacgtgccggaggtatatttaccatgctacccctaaagggaatgcccgtagtgcagcgatttcctgatgtgttcccagaagatttacctggaatgccaccagatcgtgacatagagttcattattgacctgatacccgcaactgcccccatatccaagagaccatatcggatgccagtcaatgagttaaaagaacttaaaaagcaaattagggagttgcaagaaaagggatttgtacgccccagttcgtcaccttggggagccccagtgctatttgttaagaagaaagacggtagcatgagaatgtgtgtagactatcgatcactgaaagaagtaactattaagaacaagtacccactaccaaggattgatgatctcttcgaccaacttaagggagctaaggtgttttcaaagataaaccttcgatcaggataccaccaactgaagattaggaccgaggatatccccaaaaccgcgttttcaacacgctatgggttgtatgaattcacagtaatgtcatttggtctaaccaatgccccagcatacttcatgaatcttatgaacaaagtattcatggattacttggataagtttgtggtggtattcatcgatgacattctgatctactccaaagatgaggaagaacatgcggaacacttacgattggttctccagaaactccgaaagcacaagttatacgcaaaattcagcaagtgcgaatttcggttgaaggaagtcgcttttctgggtcacgtaatctcagccagtggagtagcagtggaccctgcaaaagtggaggctgttacggaatggaaggcacccaagtcggtgaccgaaattcggagttttctaggcttggccggatactaccgaacgtttatcgaggggttctcaaagatagcccggccaatgacacaactactcaaaaaggagaagaagtttgtatgtacccgaacaaggaggactgcaaggattaatcctaaaggaggctcacaaatcggcatactcattacaccccggaagtaccaaaatgtaccaggatctgaaggaaggctactggtggcccaacatgaagagagatgtggccgaatacgtagcactctgcgacatatgccagaaggtgaaggctgagcaccagaggccggcaggtttgttgcaacctctcaggatttccgaatggaaatgggatgagataggtatggatttcattgttggattgcccaagactgcaacagggtacgattccatctaggtgattgtggatcgactcaccaagacggcaagattcatccccgtcaagacaaactatagcagtgctaaacttgccgagttgtacatgactaggatagtgtgtcttcatggtatacctaagaggattatatccgatcgaggcacacagtttacctcgcatttctgggaaaaagtgcatgaagccctaggaagttatcttgcttttagcacagcttatcatccacagacagatggccagacggagagaaccaaccaggtcctagaagacatgctgagagcttgtgcgttggattttagtaaagactgggagaagtgtttgccctaggccgagttctcctacaacaacagctttcaagcaagcctgaagatgtcccccaatgaagcattgcttggtcgacgatgccggacgccgctgatgtggtctgagacaggtgaacgggcggtatttggacctgacatcatcaacgaggccgaagagaaggttcgcctaattcgagaccgtctaaaagtgacacaatcacggcagaagagttacgctgacacccgaagaagggatctagaatttaaaaaaagagattacgtgtatctcaaagtttctccgatgaggggaacaaaaaggtttaaggttaagggaaaactagcaccaagatatgggggaccctttcaaatcacggctagaagaggagaagtcgcatatcagttacagctaccagagaatatcgctgatgtgcacccagtcttccatgtgtcccaattaaagaaatgcttaccagtgccggaagaacaagctccgctggaagagattcacattagcaacgatctcacgtatccagaacacccgatccggatattggatgaagtagaaaagaggactaggagcaaagtgtggcgtatgtacaaggtacaatggagtaatcacactgaggatgaagccacctgggaaagcgaagaattcttgaggacggagtacccgcatctattcgaaaactggtaagaaatctcgggacgagatttatttaagggggtaggtttgtaacaccctgaaaattcgaccgacaaaatcaaaactctaaaaatacggattttcaaaaactttttaaattaattgcatcatgcggatcttattcgtctattttatctggatttgatctcgaagattattaatcgtgagtaaagaatagttaattaggaataaaccttaaaaacaaattggtaaaataaatacaaattaaaataaagattaggtgtggatagaaataaataaaatattatcgcgaccatatttggatcaattaaatttaaatacgatggaataagaattaaccctaattaaaactcaaataaattatataaaaataaaatatgagtaatattaatctagggtgaattcattagttaagataacacaaatattgagtaaaatgcatatatgcaaaattaggaattgtggaataaaatttatatggaaaatacactaaaatcgggacaaataggaaaagtcactattcatcggccgccaggtgttcgacgtggtcccctaacccagctcctctttccccctctctctctctcggcaacgtcaccacgcgtcgccgcctcgcgccccgagccgccgcgcgccgtcgccatcatcgcctgccgccgcgccaccgtcgccatcgccgcctgtcccgtcgccatctcatcgccgctgccgcgccgtcgccgtcgcgtcccgcctagggccgcgcgtgcgttccatcgccacctcgcgccgcgcgccaccactgccgcgcag

SEQ ID NO: 57605 - DNA, 5138 bp, Oryza sativa
caaaatgcaactcagtgtaagctaaaatgaagggttgattacctaatggattttggattttcatttgcacatttcccaagttcctaaatgatgtgtttcagaaaaagaattatgtatatattgtttcctaaagcactttttccagaacaggggtgaaactagaacgaaaattaccaagtgtgccacacttgtataatattatgtaattaatgttctagttacatgtgttaatgaagaacatgctttgggcaaatcattttagagtctacgaccatgcatgagaaaggagcaatgtggtgttgccctttaggtaaactaaacaaatagacaaatattgtctatatgattatcacaagatgattggtgagtggaagacactactgagcaatgagtggacatagagtactgataaatagcatatagccatatatcaactatggcatgacgtgttacttttttctttgattccgagtagacaaaggcaccagtaaataaggagaaaaaaaaaagcgaaccatagttttttaagtagtcatattttttaaataagtttcattaattatgatgatataaattatattgaacttattgattataatttacatgataaaactatattctttgatataattggactacatgacaaaagcaaactttactgtagaacacttcaaaatttataagtacactacacacactaatcaaatttatacactattgatcttatttcaaacaaatgttgtttcaaagaaaacaatcaagcatgaaaaaacaaagtaattagcttgaaacaattgctaatattttgcattaccagccaagcaattgtgtgggtgttatgtgttctaacatacctttaaagttcttcaaaactgtgtaaaaaattgaactagttgaacttctacgtagaaaaaaaatccaacatataatctatccttaatttggttgtcactgtatcatgtgccttcatgaaatgattcaacacaaagaactttgatttccttagtctcacaagttttgcttatagccatattacactctatgtgtacagatggtagaagtgataatgtaacaccctgaaaattcgaccgacaaaatcaaaactctaaaaatacggattttcaaaaactttttaaattaattgcatcatgccgatcttattcgtctattttatctggatttgatctcgaagattattaatcgtgagtaaagaatagttaattaggaataaaccttacaaacaaattggtaaaataaatacaaattaaaataaagattaggtgtggacagaaataaataaaatattatcgcgaccatatttggatcaattaaatttaaatacaatggaataagaattaaccctaattaaaactcaaataaattatataaaaataaaatatgagtaatattaatctagggtgaattcattagttaagataacacaaatattgagtaaaatgcacatatgcaaaattaggaattgtggaatcaaatttatatggaaaatacactaaaatcgggataaatagaaaaagtcactattcatcggccgccaggtgttcgacgtggtcccctaacccagctcctcctctttccccctctctctgccgccaccttcaccacgcgccgccgcctcgcgccccgagccaccgcgggccgtcgccatcgtcgcctgccgccgcgccgccgtcgccatcgccgcctgtcgccgtcgccatcccatcgccgctgccgcgccgtcgccgtcgcgtcccgcctcgcgccgcgcgtgcgtcccatcaccgcctcgcgcccagagccaccgcgcgccgtcgccatcgtcgcctgccgccgcgccaccgtcgccatcgccgcctgtcgccgtcgccatctcattgccgttgccgcgccgtcgccgtcgcgtaccgcctcgcgccgcgcgtgcgtaccatcgccgcctcgcgccgcgcgccaccactgccgcgcagtcgccgtcgccatcccgtcgccgcgcgcgcgttccatcgccgcctcgagccgtgccgctgctgcgccgcgtgccgtcccgtcgcctcgcacccgctgcctcgcgccccgcgccgctgccacgtgctgcgtcgccttgcgccccgagccgcgccgcgccgtcgtcatctccgcccgcgcgccgcgcgccgtcacatcgccgccgtcacctcaccccccctccaccgcccttcccttctcttccctctcccccttatcctctctttcccctataaaggcccaccattctcccctctccccactccatcccctcctcctctcccttttccctccccatctccacgcgtcgccgttgttgtcccgccgctccgccgccttcgagccaccgcgccgccgccacgaagccgccgcgctgtgccgcgccgtgcgccgtcgtcgccgccgccgtcgtcgccgccgccgccgtcggtgagtcgctgccttccccccctgtttgtcgccgtgccgccgggtagagagagagccgagggagagggaggaagggagaagccgagggagagaaagaagaaggaacgaggagagaaaccgggagggagagagagaaggaaaaagaaaagaaaagggatagtgagaaggaaaaaagaaaagaaaggagagagagaaagaaaaaaaaagaaaagaaaaagaaaggaaggaaaaagaaaaagaagggaagaaaaagaaaagggaaataaataggaaattagagggagattagggaagttttaaaaatttaaaataattagaatttagttatagattagttatagtcgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacggtagaaattcggacttaatcactaggaattttagacgtatattatatttagtcgtttagtcctagactaaaattaaatcgtataatattataagataatttttggattccgttcgatatttagcttgcgatagaaatttccaacctattatatggatataacgctcgggtagattaaattaaaaacttatgataacaaaatatttatacccacaaaatagttaggatatacaaaaagaaattgggtttgccctagtacgcgaatagtaaagttaatataaaagaatcgactttcgcgttcgacttccatttggatttatttggatttttatttgaattctaatcgaatccaaatcaattttcgcaggtaactatagagcccgagggagttgcggatccaagtgaaggccaagacccccaagaccttgagcaaggcaagtcatcactattccttgaacatgttgatcctaattgcgaaattattttgtttataaataaaattgcatgcaatgatgcacatcctacttgtgattatgccatgccttgattattgtttatccatgtttacgtatgagtccctagtcaattatgacaattgcttagaaatgctattctaggatcatgcatactcatatttatcaaatgctaaatgcttgggcaattacctttgggaaggtaattgagatgcggcatgtggagacatgagcaccacattgccatgaaattgataacatgatttgtgaaaggaaaataaagcgaaaacaactgttttcaactggggcggacggatgatttgggtggtatctgggaaaggctagtaccgtccccggtcaattaaggaccgagccataaagttaagcatgaaacgacccccgtacaaccgtacttctcgaatgggtatagacctagcggattagatagccgagcggaggcagtatccctgcatagatggttcacccctgagtgaggcaggtgcgctacgatgggacaaccgttgaggtagagccgagaggcgtgccctacatcggtgtcgccgttggtagaactgccatgagtgtgtgagagagagaacttaacttgaaccataatttaatatgtgtgagacttctctttcccgggaccgccagaactcctcacactgctagaaacatggacgcctagagtgcatgaggatttaagttcatagagcggatactgccaatgcgaggttatcgaaaagctttgccgtgacgcgcctcatgtgttgagacgaggctcatgtgttgggcagtcgcggagtgcgagtaaagtgtacatccactgcagtgtgagtgaacgaaatctattcgaatagccgtgctcgcggttattgagcaccgggacatgtattacacttggctagtctctaaattcttaacttatgtgggatgggttgttgcatgacgaatttttatgctgttggagccacttcctgagaagggggaaggtgggcgtcctcagaaaaccataacgactcaatggcgggaagctatccttgggatcacaatggatggtggacagaaccgtcgttgtttaaatacaaacactggtactaaaatttgatcagtcaatgctaggtcttaggtttgtgaaaagaattacaaaactggcttagcgcaaaagagccatagccatcctttgaaatacccctttcatatgcattgttgctgtggtaacttgttgagtacggttggtactcacccttacaaatataaaattaatcagaagcggtagatgaagcttcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagacaatgcctgcgggcttatgatgtaataattagcactagactctcatgtatgtgcttttggtatttcagctatgaactcgtgtgtaccagactacttgatccagggaaatggtactgtttacacgaatgattcctgttataaaaacgggggtccacagagctggtatcagagccatacgactgtaggaaaagaccaaaaggcgccccaccccttttctaagttggccaagggagaaattcccatttagtaatactttcaaaaataaaaa

SEQ ID NO: 57606 - DNA, 744 bp, Oryza sativa
cctgcagccccgacttattgcagaaatcagaaagggaaaagcggaacaggcctccacactcataacctttaccaataaaatatccatgtttagacacaactactttattacactcaaaaactaacttaaatccgtctctagttagacgggagccactaacaagattactatcgattgtagggacatgctgcacgttcttcaactgcacgatatttccccaagtaaacttcagatctaccgtgcaaacaccatgaacaacaaaacttcatatctacccattccccattaggacggtggaatcccgtgctacctgataagaagaaaacaacgaaacatcagcacaaatatatacattggcccatgtatcaacccaccaattagtagactgattagctgaaaaaatagtaggtaaattaccatacccgcttccttttccagtgttaccaatggttacattagcaaacttggaagtctgccctacaggtgccttcatccccttgcgttgtggacacttcttggccagatgactagtcaaaccacacacaaagcaagttcactcatcgtggttcggattgctgttgttcttcttctgcttcttgaagttggtggtctgttgagctttatatttccccttattcttgttctgggccttgtgcataatattggcactagactgtccaccatcgcccttagacgcggtatctttttctcgagctttctcctcaacatcaagagacgctatca

SEQ ID NO: 57607 - DNA, 705 bp, Oryza sativa
ccagctcgcgcaaaccaatcctccgctaattactatccaggtcttgagggaaacatgagagagattgacactccaggactattcttagctggcctggttcgtgctatggatagatatctcgcaaaaactataactgagttgcgtagattgcaagctagggtggtcatgcttgatagacgaatagaaccactcgggcatcaaggacattttgataatgccatcatttatgggaatcatgaactccagcctcttacagagactttgcctcctcccatgggtatttatcataatataaacactagagcccgcatgagagttggttttcatcgaaatcgtcgaaccatgccagaccctgcacttgctggagatccggtgctgctggggccattctatgagttcgagcggaatgggagacaataccgtttgactatggccactccgtcaaccacagtgcctcaacctcccatcggattctccgaagttccatagaatggtgtactggaaaaaaagaatatgtatggggtgtaactttcatttcttttctttaagatgtatgagatgacaccctaatatgtaatctttttaacggtcaaaattttgtaacaccaaggcatgaacttggtttcttatgaccattatccactcctatgtatctgtgatcacttagatcctttaaaactaatgtactggaatgaacttatgctc

SEQ ID NO: 57608 - DNA, 1305 bp, Oryza sativa
gtgcactccattcccttaacagttctttttgattccggtgcaactcattcattcatgtcaaccttgaaagcaaaacaacttgacttgaaaacagaatttcttagcgatgctatgcgcatccaatctcctggatccaccatggtcaccaaacttctatgcaaaggtgtagaacttataatagacggggtaaagtttaaagctaacctcatattattagacaccttgggcctaaatgtcattcttgggatggattggttaactaaacatgagggaaccattgattgtgctcatagaactgtaactcttcgtagcaccgatggtcaatttgttaggtttacctttgaacaaacctccacttcaaatcaaccctctatacaatctctctctataccggagttaaaatcagtacccatcgtgaatgaatattccgatgtgtttcctgacgaattaccagggatgcctccagatcgtgacattgaatttgtgatagatttaatccctgggacagcacctatagccaaaaggccatatcgaatgacttctgaaaatttgatggaattaaagaagcaactcaatgagcaattggctaaaggtttcattcgtcctagttcatctccctggggctgtccagtgttgtttgtaccaaagaaagatggaaccatgcgaatgtgcgtggattatcgacctctgaatgaagtcaccatcaaaaataaatatcctcttcctaggatcgatgatttatttgatcagttaaccggaactcgtgtcttctcaaaaattgatcttagattgggatattttcagcttaaaatcagaccggaggacattcctaaaaccgcattcacaactcgctacggtttatttgaatacaccgtagtctcttttggattaaccattgctcctgcttctttcatgaatatgatgaataaaatcttcatggaatatcttgataaatttgtggtggtattcattgatgatatactcatctactccaagagtgaagaggaacatgcgcaacatttacgtatggtactcgataaactccgtgagcatcaactttatgccaaattctcaaaatgtgaattttggttaaaagaagttgaatttcttggtcatgtactttctgaaggtggtattgctgtgaatccaagaaatgtacagaacgtacttaattggaagcaaccacaaaatgttcctgaaattagaagttttcttggactagctggttactaccgtcgtttcattgaaaatttctccaaaattgctaggcccttgactcaacttcttaaaaaagaaaataaattc

SEQ ID NO: 57609 - DNA, 5894 bp, Oryza sativa
attcctgcagccctagaagtagtggcttatgcttctcgtcagttacgaccacacgagatcaattatccaactcatgacttagagctagcagctgtggtcatgctctaaagatttggcgccattatttggtcagtaatcggtgcgaaatctttaccgatcataagagtttgaaatatttctttacccaaccagatctgaacctaaggcaaagaagatggttagaactcattaaagattatgatctcggtattcattatcatcccggtaaagcaaatgtagtagctgatgctttaagccggaagctacatcaccttgccgttattgagacaataaatcagccatcgttgtcctctgaatttcagaaattgaatttgggattggtagaggatggttatgttgctgcactagcattacaacctactctctattctcaaattaaagctgctcagtccattgatgaggaagtagctgaaattatgaaagaaatcaattcaaagccacaatctatatacactcttaattctgatggtatggttatgcttggcaaacgaatctttgttcccaataatcaacaccttcgagaaaccattcttgatgaagcacatcaaacacctttgtctatccatccgggttgcactaagatgtaccaggatattcgcactcaatattggtggcctagcctgaggcgtgacatagcagcatatgttgcaatttgcgatgtgtgccaacgtgtcaaagctgaacatcaacgacccgctgggctactccaacctttgcaagtacctgaatggaaatttgatgaagttggaatggattttattaccggtcttcctaaaacacccaatggacatgattctatatgggttattatggatcgactgactaaagtggctcacttcattccggtgcatgtgacttatggtggagccaagctagcagagttatatttgactcatattgtaaggcttcatggcgtaccaaaagtcatagtatccgatcgaggaacacaatttacatccagattttggaaaaatttacatgaacttctcggaaccaaattgttcctcagcaccgcctttcatccacaaacaggaggtcaagtggaaagaacaaaccaaatacttgaagacatgctccgagcttgtgtgcttgaacataacactaactgggagaaatgtctatcttttgctgaattctcctacaacaatagctttcaatcaagtatccaaatgtcaccatttgaagctctttatgggagaaattgtaggactcctctttattggtccgaagtaggagaaagacaattctttggacctgctatcattaatgaagctgaaaagaatgtcactcttattcgggaccgattaaaagaagctcaaactcgtcaaaagagctactctgatcgtcgtcgacgagagctaagttttgatgttggtgaccatgtctatcttaaagtatcacccatgagaggcactcaacgattccaaattcatggcaagcttgctccacgatatattgggccataccaaataatatctaagcgtggacaagtagcctatcaattggaattgccatttcagttgtctaatatacatgatgtattccatgtttctcaacttaagaaatgtcttcgaactccgattgagcacacctcacttgaagacattaatctaaagccaaatctctcctatcaagaatacccaattcgtattctcgaagaaagtgaacggcgtacccgcaaaagctccatcaagatgcttcgagtacaatggagcaatcatactgtggatgaagccacatgggaacgagaggaccgacttaaggccgaattccctagtttcttctagaatgacgaatctcggggtcgagattcttttgtaagggggtaggctgtcacataccatgactttgggtgtttggaaaacatggaaatggtggaagaagtaaaataaataaaacttttgtttaaaacttatatgcttgcttgtttgtgcattttgtggtgtatgcatatggtttataggatcatgttcatatttaactaaaaccaatggatcaaagaaaaattcttggaacaactcaaaaatctgggaagaatttgtggtaacttcttgctgaccttagaaactaaatgtggattttaatttagcttatcaactcattagatcaaccaaacaactctctaaacacttaagcacaggattttgacagattctctggagcactctttgacactctgccaaaattggatcttgaactcctaggctgtaaaactcgatccaaactgtagttcaatcattgctttacaactttgcctttggtcactagctctaactctgcctagaactaattttaaactgaacccaaagatggaattccacctctgttccagacttggccaaaacctagatctcctctccttctctctcactagtcgctgccatgtgggccagggctgcatggcgggaccccattgtcagcctcacattcctctccacacgggcccactgcctgaactcgcatgccacgcgtgtgagcacgcgtcgagcacgggagagggcgagctcctcctgtccatctccgccggcgaccatacttaacccgaccggccgaccaactttctctccctctcgcccttgtctcgtttcgcggaagaaccgaggtaccccgcctcggattcgccgggaacggaggcgccatctccggcgccggcgagataagtcctcgactccgtcgcaatccggtgagcccatttccgttcaatatgcgttctgtaatcccctctcaatgccgtctctaacaccaccaagaacacctcatttggtgcagccaatctccgggaacgtgaccgcgtcaaatcggaacaccgtcgcgctctggacgccgctgcttcgcctttgctcgtcgcccggcttccatagttcgttacaggctgagccacttcgtcacgagcttcatcaacacctgtagatcaagaatcccgaaggaatcgacgcgaggtggaccacagtgggagatcctcttcttcttctccaatcccagccaccgacgccattcctttctttctccttctctggtgagcttcggcgcaatattttccgcctagagctaccttgtgctgatctaaacagagtcatgcttcctctctttgcagtagaagcctggggatacgccgtcgacgacgaccgtagcagccgcgccgtcgccgaaccagtacaccgtcgccaagacttcgctgagctgcgtttgcttcttggtgagcctcctagtagtccctagagtccttaccatacgcatgcacgattagatcgagcctcaaaactcacatgcatgtgcaagccgagcttagccgccgcttctaacaccctgacagccgctatagagcaccaaggcttgcaagaaaaacaccaataggttcgtacggttgttctctacactttttgttttgggagcttgagctgaatcgccgctgttcgccgctggtgatactgtgaagttcgtggctgtgctgctgctctgttctgtccagagcaagggcatggcttttgaaatttaaagactcccagggatgcattagcagcccgagcaatcacttacatatggggtcgtgcactaatctgtaaataacatagaactcaagtcccattttgaataaaatcctggaacacgtgctaggggctgcgggatctatttcctgagaacccaggggcttttgcgcaaaatgttagtctctgtctggtggacctgagaaaggaaaatgatgtatgaaaatttgagaaaatacaaaaactaatttcctatcaactgaaaaatgtcagaactttagaaagtggtagaaaattcatcctgactctaaaaattgcaaactaaattatgttagaatcatattttcatgctttgcgtcataaaaatgtttgacttaacagaatcataaagatttatgtctcaataattcgaaatgcatttaggaccataattaacatgtaaacactttaaaaaaaatctgtaactttgaatgtaaactgttagattgaagtttctttcactgaaaatcaaactaacacggagcacaccaactccataaaaaaaaagcattcattttagagcatgttggatttttatgtatgtttaaattttaaatttttgcatatgtatgtttagacgattcgcagccgagtctcgaggaggcctactttgtagctgagcaaggagtggaagagcaaggcaagccacctcccttctttgatcacattgaacctatgatttggatgtttttgaaaagtttgcaaaatatgcatgtctattgtacactaatccattaaaatcttgtaaaatttgttagatcaactccttaacttgcattatcacctgaactccacaaaagaccttaaccattattccaaaaccttaggaacaatccattgtgtcacattaagaatgatgtttgagatagcaagtctataaaaatgctcagccatgcttagtgatgagtttacttaccatttgggctcaattacatatattaaatgatttattttatgatctggattaaaatgataaaatgtgatatttgttaaataaaatgttggaaaatgtggattttaggtttgggccgcatgtggtacacatattgtgtttagttgtgtactgatagggggacagtgtgcccaaaccgacctaaggacttcactcagcgtcaattcatttcgtatacagtacaaccacatgtgctagtatgggatagcccaagcttagtaaattatttatgatttagccttacattctggtaggccggtgtgtatgagttagtcgataattctgaggaattagtcgttgattcagaggaactttctatttaccccgacgtggtagtttaggtgactaagtctgtccaatacaacggtattgtgccacgtgggtgggttcccgttgcgtccgccaccacggcgttaagtttaaggcgtgggcccgccacttaacggttctaggtcatatatcgagtatggcttaggatggagtaacacgtatcgtgctggtgtaaggctaaatcatgaatcttggaagggctttgttgtgagtaataaatcgggtacttatgtatcgcgtgccatgcttttgcatgattattatttcgcatcatgtgggtaaagtgtacatactctgcagagttaaaactaatcgattagccgtgctcacggtcaagagcggcgtgtgaatatgtcatgagtttagacatgtgttttattcttctaaagctgaatttgaacttcaaaatgtgatgtaatttgtggtttatatccttgctgccatggaaggcaataaggagctatgttatatgtgtttatcatctaatttggtgcccaattgctaagtgtattcttgctgaaatttatttgaaaataaatctgaaatttgaaatgctctttgcaaactaaatttgctttatgctaaaattatcccatgttagctttactttgaatttgccatgcatgtagagtactaggcttgcttggtgcttgccagtacaatttattgtactgactcttgcttgtattgttatattgttgcatgtttagaattggttgcaggtgagatcactcctgtggaggatgatttcgttggggaagtttctttcttccaggatggttcttactagggtctatcctagtcggttgcatgaaagatcttttgggtagaagatgcttccgcgaacctatctattcagccaatcggccatgtgtatctaagttataagttgtatgatcctaactaaaacttagaacttagaactccctatgttgagatatcatgtgcttggataaagtgtttagtgtgttccttttgttagggacatattaaacatgagtatgagttaaagatatttgagatgttgt

SEQ ID NO: 57610 - DNA, 1372 bp, Oryza sativa
attcctgcagccctttcagtcacatcatctccaatttcaaccaaaatctaaactttgcgctgaactaaacacaaccagagctaaagatggcatgaattgatgaagaaagtgcaccaatgtgaaaactatccaaaattctggagtaatatttgtgtatggccagccaagcaaagagcttgttgtgcagaagatgaaggaagcaagaaatggccaagaaatagtctgattcgcccggtgatgagtcggcggtcccctctacttcatcggaactcgcaggggagaagtgccctaggcgacgaacatccgatgtctccgccgccttttattcctacgagcgcgattaacgggctagcgctggatgatcagtcaatcaactttttggttcaacctatgacatattcgacagttttaagggaaaatacattcactgtgaccatagtgtatttacgttgtaacaagggtgcagttaaactggtaacagcgtagctaaggtacagttacagtttaactatgatgtagctttagtttgtactccctccatttcgttatgtttgacgtccgtattcaactcaaaagcagttttaatatttgacgctggtatacacccaaaaactctctttccaactttgcccttcgcccatatacatcagtcataccactgcttccacaactgttagattcggtgccgccgacgacatccatcgcgctgtcgtagtccgagcgccgctaccggcagtcgatgctttgttggtgtcctgcctcctaactcccctcctcatgctccctgccaatgcggccttcctcacgtagtcgctccatgctcgttgaagagatttgtggcggtgtggcctcaccctctgtcgaaacatgaattcggcaataataaaagagggtagcacacgagacctaaatgtggatggatgcggagacaaaggatttagacagattcaggccttctcaatgagaggtaataccctactcctgtttggggatttgaatccgtcgggtgtgtattgatctgacgatctagttgtgctcatgccccctagagggcctccagcccaccttatataggatggggggcaggattacaagatagaaaccttaaccaatacggtatcggttttctaaatctattttacaatattatcaaattaggactttaggccgctccataatataaaaggaaacataatacccaagtcatgatctgttacatattccatagatataagttatcccctataaccagtcggataaccatgccgtgtgggtatgtggtacccataatctccacagtagcccctgagaccttcactgtcgaaaagataatcttctctcgacccagattactccaaagccaagtgcttca

SEQ ID NO: 57611 - DNA, 4652 bp, Oryza sativa
tgctttgtaaaaattgatgcgagcaacctaaagttgactacatcattgaaaattcacatagcaaaacagctataaaaaagctcgaatgctgtgaataaagaaattaccaaagtattgggcatacgccatgcgcacactgctttaacagatgtgcttaagtccctaaaagacacatgttttcaccacacccgaaaatatacggcatatgtggtgtaaaatccgagtaaataaactcataaaggatttaccaaccgcctgaaaaatgaccaagatatataatcagcctaagccataatattggtcaataaaaatgcacacttacgtggcaaaaagcaacgatattgtatccaatcaattgcttaaaaactcaaacagtaccttgacttatataaaaaagtcagcgaggcagctatataaagctttactatttgacaccttttaagatgcattgtaccaactcctaaaaagttgagtaactgcggtataaaaggattttaagatatttggcactggatcacgcgcactttggcctaagcaaaaagtgcctaagtccctaaaagaatgtgacatgccacacctaaaaatatgggctgcagacatattagacctaggccaaaaaatatgccttcgacaccctttaaaggatgacgcatgtatcatgctcccgagtaataaatcttccaggtgatatagaccaagtgtaactcatatgaatagcttctgatctgagtgattatcccttatgggatactccaaaatagatataaaaattgaatctcgactagcgcaagtactcagctgttagccctcacgacaaataatgagtggtccagtcgttgagcatgagaaatcgactcatgaccatgaatccatgttgaatgtatccggaataaatccaaattgaagatataatcctcgcgcttgtgttgatgagcccctaagcatgtagcttatccttctgttgtagtcacaattgtccattgatagtagctgacaccatcggcatggagacgaaatgaccaacatgaagatgatatcacccatcaaagctgacgaaaatgttggtagtagtaaagacaatgacaccaatcaaaggtgatgaagtcgcatagccatggaggcgaagaaaccagtcggcatcagataagtcagccagcagagaagacgaaggtgcccagcaacggtgacagagttgtgcagccatggcagcaaaaataatcagtcgatgacagacgagtcgctcggtgcagaagacgaagactcccaaaagtaggggcataataagccagccgtgaaagcaaagacaccatgggcggcagtagaggcaagctggtggtgaagacgtagacgctcatcaaaggcaatggcgcaatccatcaatcatgaagatgaagaaaatagtcagcgacggcaaacacatccgacagtaatgatgattagcggcaacagagatagccggctatgatgacgaagttgcgcatcaaatggcagcagagtaggcatagccaaagaggcatggtaggatgttaatgaagatgacgatgtcagtgatctggtcaatagtagtgttgcagctgatgataatgatgagatcttttatcagcagttgcatagtaagccaaccgtgaagacaaaataacaagtcggcgaagtcgtagtcatccattagcaacggcggagacatcagggccaatgaagtagatgtgctggtgatgatgtcagtaacaacaatccatcaaactgttgagaggaaatccatgctcaagtattttcttaatgttggcatgtgtgtgacgaagattgatgcaacgcctcttgatttatgaagatgacagtagaacttggtgctatagctgttgcatatgcttcacttggaggaaagtagatgttgttgtccttttatgatccgagtgatgttgttggcatgaagaagccaaaattgccggtgtaataattggagtcgctgaaattaaatgtcggctctgaagcgaagacgaagataataactccccaaattgactcgttgattgattgattgcttcatcttgacataaagcttgtcgaattttttgagagtcttgtatttgtgtagcccccgactctttggttagttgagaaacaactgaacatagagtcgagaactgtagcttcttgtcgtcgagtagtcattgcttgagtgaacatacgtgttgaaaatgtctgagtagaaatattgaagattggaacaccacttgttgtagtaaaataacacggcatcatatttcatgacacatgccgagatgtcgagtctcttgtagacgtcgtggctgatgaagtagcaaaacttgcaaagtagcagcaattgagtttgccggtgccgaagataataaagatgaagtcgctccactatggtgacaaagttgcaaagccgtgatgaagtgaacacgagtcagcggcaacagtagaaaactggtggcgaagacgtgtagttgtgaagatagatactccagtcggttgagcggcggcataataggctagccatgaagacgatgacgtccatcagtagtggtagtggtataaactagccgtagaggcgagggcactagtcagcagcagacgagacgaccggcggtgaaaacaataaggccaatcaaccctggaagaatcatgcagccatgggagtgaagaaaccagttggtagcagatgtagatagcttgcattgaagatcatgacgcctattagtggtggcggcgacgtggccaaccgtgaagacgatagcaccagtaggcatcatacaaggcggcccgtcagtgaagatgtagacgtccaacaatggtgacataataggccagccgtgcaggtggaaacaccaatcggcggcggacgaggcagccggtcggtgaagacgtagacgaccaacattggtggcataataggccagccgtgcaggcggaaacaccagtcggcggcggacgaggcggccggtcggtgaatacgtagacgcccaacgacggcggcatattaggccagccatgtaggcggaaacaccagtcggcggaggacgaggcggccggcggtgaagtcgtggacgcccatcaacggcagcataataggccagccgtgcaggcggagataccagtcggcggtggcgaaggcagccggcggtgaagtcgtagacgcccatcaacggcggcataataggccagccgtgcaggcagagataccaatcagtgacggcgaaggcagccggcggtgaaagcgtagacgcccaacaacggtggtgtgaccatccatccgtataggcgagagcaccattcggcgacggcgaaggcaagccggctgtgaagacatagacgcccaacaacggtgatgtgaccatccaaccgcataggcgaagacaccagtcggcggtgacgacagcgagccggtgataatgttctgactgatccattcctgaagcataggagataagcttaaagccatgaatccctattatgcatatccggatctggatcttgcagaacaaacatataggatgagtagtatctgatgtaaatacggtactcggggaaaattcaagtattttaaaatgtttataaatatgtatttctcctcttatcaattttgatttccccgagtagatgactcattacgtttaaacactctgcccaactagtcatagcccccacgcatcgggagtcggcctaagcacttcccaaacatgcatatgagtgacatgagttcgtcattaatggaacaaagtttcacgaatcagaatttactactcgggtacttttgcaattgttaagagcagaaaataaatttatcttatctctatgcttttgatttattccgaataatacttagcaccttgcattacccagtccatccaacaagcccccgggtgctaggaatcggcccaaaggcaactatccatcagcaaaccaaacggaaagcataggaagatagaactccataactcgataggcacttttgtactcagattatattgcaagcaatcaagataaatattataaaaattgtttaaaaaatatgatataacatctgtagcccccgactcactagtcaacggcgaaccagttgatgtagtgaggcagaggaaaaggaaaatatcatataaacaaagttaatgatgacttagctttgtaatattccccttgatgatggcagaggtggccaatgtgggaacaaagtcgtccgtcaataacaatgaagacaccagtcgggggcgaaagaaggcggtcgacggtgaaagcgaagatgcccaccaacggcggcataataggccaaccgtgtaggcagagacaccagtcggggcggcaaaggcaagccggtcggtgaagacgtggatgcccatgaacggtggtgtgactaatcaaccgtataggcaaggacaccagtcggcggcgacggaggcagccggtcggtgaagttgtagacgcccaacaacggcggcataatatgccagccgtgtaggcggagacaccagtcagtggcacaacggcggcataataggctagccatgtaagtggaaacaccagtcggtggcgacgaaggtaggtcggttgataaagtcgtggacgctcaataatggcggcataatagggcagccatgtaggcggagacaccaatcggcggcggcgaaggtaag

SEQ ID NO: 57612 - DNA, 7357 bp, Oryza sativa
aaacaattttgccgatggaacacaatagctcgatagtctgggacttcgatttgtgcttgacaaagatctgtatacataagcatatatacggccatgcaatctgaggactccatccaattggttggcaagattgccatgcgtgcatgcatgtatatgtagatggaagaatacacttgcatgattggttggcctggtatccatatatgctttaatgcgtatgggctggatggatatactagttggtgtccattatcaagggtagctcatgatagccgattgacgatgtatatgtatagcaattcttctcggatgtagttgcaaaaccattttgtatatttgtatccaataaaacatgtgtgcttgactgcttgattccgcttttctctgccaaggagcgatcgatctatgcccatatgcttgtacgtctcgtcgtcttacgtagctctggatacctctggctttgaattgacgtgaacgagcggagtcaggctgatgggaaactcgccgaaggcttgtcatgatgaggaacgaattcagacgactgattttcgacggctgcaatgctatccatgcttccgtacagaaaaacttggcttggaaaaagatgagtcgacgatgctggtggcagccatagtagattgaatctaaaactcgctgtggtagtctggtagagtggttgttatcctctgattggatcttcttcgactggtttgaaatcaagtcagagaaaaagagcttgttgaaattgtcggcggcaaggaagtcaaagctggtgaaccgaaggcgaaaaccggcgactcatgaagttgattccatcgcacttgtcaatagaaactcgacgcgcccctacctggcgcgtcaactatcgaaacatgaattcggcaatagtaaaagggggtagcgcacaagacctaaaagtggatagacaggttcaggccctctcaatgagaggtaataccctactactgtttggggatttgaatccgccgggtgtgtattgatctaacgatctagttgtgctcatgccccctagagagcctcctgcccaccttatataggatggggggcaggattagaagatagaaaccttaaccaatacggtatcggtttcctaaatctattttacaatattatcaaatcaggactttagaccgctccataatataaaaggaaacgtaatacccaagtcatgatctgttacatatttcatagatataagttattccctataaccagtcggataaccatgtcgtgtgggtaggtggtaccctcaatgcctcctctggtcctccctcgttgatgccccgacgtcttgcgtgaacgcccctgcgtcgatcagctccaatccgctagttatcctcatggcagaatcgccctgctcaccaatggggtagggacaactggcgaggagatgaagggagaggagaagatgctcctgttgatgctcaggtgtggcttcgtttccttgttcttcttcatcacaagttgtcaacttcccccaaatccttttcggatgaaggcgatatttttctctttttctgtccacagaagatgttcttgatttctaacaacagttcagtgcaacaatttgcaccgctgaatcatctgcaatcttcagagaaagatgcaattctgctgcttcaccagctcattcaattcagaaccagaacaagaaaaagatcactgggtagatcactgggtgttcaatggtgaactgaaactgaaccgaattgtccataacacctgtatgcagcagcagaccgcattctgctacattcatacaacccaaagatcctgatgaaacatttcttcattgtagtattgatctgaatatcttgagtaatgtcacttcaactcaacagcacgaaaagcttgtgcaattttgacaatactcttgtaaagttaacaatatggtttcttgtgaactgtgacttcttgtaaagttaacaagggtaaaattatggtgcaataaaggatgccgattttttctggatatcttgtgaattttgaataagaatgaacaattctgtgtctttgcatttgtgcaatgaggttgaccattaggagcaaagccagaacagggtgcaattagcattcaaacagagagaggagggaattccaaaagaaaaaaaaatagaggtgaatttgttttcttggctactaaatgttgaatctatataggatgaatttggctaccatccctccgccgccgcatgcctcgccccgccgcaacctcatgctgacccgccgccggtgacgccatgggctgcttgcacggccgcccctccaccgcagccccgccgcgaaggcttcccgtcgccgcctcctactgttgctgttgcggagatgtacaagcagggagcggatgcttctacggaggcggaggctaacgagaagggtgagcagccggccgtcgccgccgcaggtccgctggtgaagagggagaggcgtggtcgtcgaggtcggctgccgcacgtgcacacgcataccaaggtgcgccatcggggggagcttcgcatacaagacgcgcggtgagcaggtcgccgctgggtggcccgcatggctctctgccatctccagcgacgccatcgacggctggactcctcgccgcgcagccactggtgctctgctccatggtcacctgccccaccggcgcggtctggatgaacgcagcagcaggggagaccgtagaaataactcagcaacgggagggcaaactcgtcaattcactagttccttaattttgtcgaagctgtcggaaacgacatatataaaaaagaagggtgaggtatcagaaaaagagatggtaccagaaaatagcacagaaaaagagatggtaccagaaaatagcacataattttttcccttttaaccataagtatatgtctttagtttttctttgatttgtagcatcccattacatttgaggggctaagttctcaatttaaaaatgttgcatatatctggttggatgtagatatttgccatttattgggatggaaaaaagactaatttatccttcttctactcatctttccccttttcttcctcccgtcgatcttgccagtgcgtcagtgggcagccatggtgcggcaatgcagcgtagcagccagcatgcaatgcagttgtgtgcagtgctgctgccgggactaaggctgacgctgcggccagcgcatgcggcgcaacgatggcgaggtgcacagcgcaacggtggcgaggcacgtggtggctgacatggcttatggcgcaacatttgatgtggttactcgccgtggtggtcgcacagcttcccggtagcttgcgtcgtacaacctcattggctgcacctcgtcctcatccgccgcaatcgctgtcggtcaccccgccaccgtcgccacggtctccgcttcttcgctcgctgagctaaatagatcagaattccaaattcatgtttggttacaataaaggataaatttgtcttttcacatctctaatcatggctaaccaatcgattcagatagaaaatgtgacggaagtgctacaaattgaagcaaaacttgtgacatgtgcttctggttgaaaggggaattttcttttaccggtgttttttctacatcgaattttctctttatttttttcactggtaaatagagtagtataatggtcctgccacattccttgttgagtaaatcttaaagatcgcttttcatccaattaaaaaaaagaggaaagtgcgagaccagctagcacttacagaatcacaagtacatatataggacaagtacgtgcttaattcgtactactcccggttgaatgaaatttgattctcataaaaaacaacgtaatacagtatatgatagattctagtagtataaatttggacagattgtgattagatttatagtcctacaagatcttttcatatttgtagtaataggatatgccaaatctaatgcagattcgttttctttttaagagacggagtacatgtaggacaatgaagtctgatagaaagcagttccaggcgtcactactcgtctgtacgaaatctgacgacgcagggtccagactccaccagtccaccctgtaattcatggcgaaggacgaggaaggtgagcacaggacgaacagcaacagcaagctcgaaactaatccggtgataaatgcatgcgccccaacttccaactcacagttcctcctcgtcattcaaaggaaagtggcaggcaggctagctgctcggttgacacacgagcacacacaagacaaatgccgccacgccggccggcggcgcagtgcgtccgatatatggcggcgttctggttcatcatcctcctcgtcactttcttctccggcttcgctgccgccaccaccggcgtgaccacgtccacctcgaaccagaagccgacgtatatcaccagccttccgggactcgacggcgcgctgccttcccttctcgagaccgggtacgtgcgtccgtccatgccgatgacgatggacgactgtaggtctgtagctacgtgcatccattgaaaattacattttcccgctgctctagttggtgtgcaagtcgtggtgctcgtgtcaaaatcttgtcaggtacgtgaccgtcgacgaggagaacggggcagagctgttctactacttcgtggagtcggagggcgaccccggccgtgaccccgtcctcctctggctcaccggcggccaccgctgcagcgtgctcagtggattggtcttcgagatcggtgagccatccatacatataccgattaatcaatccgcgtgcactctccgtgctactactgctgatatgacaacggtggccaggcccggtggagctcgtcagggagccgtatgacggcatcagcctgccgcggctgcggtggaacccaaactcgtggaccaaggtggctagcatcctcttcgtggactcaccggtcggcgcaggcttctcattctcccgtgaccccaacggctacgacgtcggcgacgtctctgcttcgctgcagctcatcgaatttctctacaaggtactagcataaacagtctgacatgcacctacgtgcatgcacggtgaatgtgttgccgttggtggtttcgttgtttctgctcgattcatgcatgatctctcggtcgtttgacatagtggttcagcgcgcatgaggattaccttgcaaacccattctacctcggaggaggttcatacgccgcgaagctcgtaccattcatcacccagaagatctcagaaggtacgtatatatgtaacttcgctttcattttctttctttgggagtttttaggctcttttgcagcgatcaggttttccaaataaatgctgtaaattgtttacttacttatgattatctattaaaatttcactggctactctgctttcaggtattgaagctggagtgaggccgattattaacctcaaggtactcttctagttacctataagttttgcaataacaggcgaggccaattattgatcagcaacacagttagcaaactcacattatccaacttacaaccaactatagtatgaagcttataatctagtaaaatagttacaattgagtatggaccaatttgtatttctgggtgatgaacagggctatacggtcggtaatccccttacaggtgatagcattgactttgattcgcgagtgccatactgccatggagttggagtaatttcagatcagttgtataaggtaagaaccttactcttttaactcaataatcaaccaccatatattatagcctagtcctcccatgaatcgctaggatttgcccattcatgtgtcacggagatgtgggtgattgagagttaattactgacacatgcaacttcaaaccctaatgaattaatttgctccatctgtgcatgctacacttgagacttcctccagtaagattaagtgatctttgtttctcacatgcatgtggtcgactcaagacgataatggataactgccatggaaagggttacagtaaccccaggacttttatttgtgcaaaagctatgtccaagttcaacgaagtaaggaacattacaatttacaaatacctaaccgattttgcaataccctatgtcgacttgtttcgccagtggttcaagtcatctttttaattactgttggattgctctaagattcatgctgtcagtttctcactgaggactactaccgtgtgtttcgctaatatatgatgttagtttctaaatgtttgttgaccattcattttaaacttactctgttattgcagccacacaaagtggcggcaagaaagaaaagggcaagaaagactgatcatcctggcctgtctccctcttcgtagaaaaaaaattaggtatcatgtttgttttatcaattaaggtactacaaacattacttttagttttgcatatttatattaaaatttaaaaaaaatatgtacactggataaggagaccttagacataaggtctcctgtaataggcccaaacacttatctttaacgggtttgggcttggtcagtgatcagttgtcactggtgagtccagtcacctttgatgggtgaccggcccatcggcccatcagaggcacactcacctctgacgggtccgtattttccggcccgtcaaaggtgaggatctccacaagccaatgtgtagttgcaacccgtcacaggtagacacctttgacgggtgcatattttccaacccgtcatacctgagactcacctcctacgagttcaagatatgaacccatcacaggaatagaaagtcatcttaaaaaaatggtgcccagttgcaaccatagaaaattggtaatagaagccgaagaactaataattaaccccaaacatttcaaactaattcctttcaaaagatggcaagaagccgaagaacttacaaggtttacaataggaaccgaaaaacaaactacaaaactaaaaactactgggaaactacaaggtttgagacactgcatttcagggaaaatgttaagattctaattttctagctacatcacaataaaaacatctctagtatcttcaagaaaaacaagacaaaagttcaaaggtcttcttctagaatcaattaatctccattggcaacacatcatggggcttcaacaagaccacacccgattcagaaacttgtaatcgatgacttgcaacatctgaaacaaaatcgtaagcacataaacacattgatcagtacttgggagtggattaatccggaggaggaagctacggcggtggccgcaagaggatggaggaggagggcgcttggggacggaagagaaggctgtccggcgcggacacggtcgcctcctagaggtcggggttgaccggatccggcgtcccctgacctctaggaggctggatccagtgt

SEQ ID NO: 57613 - DNA, 6350 bp, Oryza sativa
attcctgcagccctttgtttctatggataagaggagagagagagtgagggagagagagaggatactctagtcaagcctagtcaatccccccacccacacctgtgacggctgtattgacgggtccgtttgagctgagttagcctcacctttgacggtttataaggatgcaacccgtcacaggtaactagtcacctgtaacaggccggaagtggaaaccgccagaggtgactaattacttctgacagctttcacttccggcccgtcagaggtgactaattacttatgacgggttgtagaaggatgccttaccgatgacggcgtcctgtaggatccgtcaaaggtgaccctcatcactaaccggtactaaatcccgtcacagatataccgtcaaagacgtgaggatctagtgtagtgacaaatagtcaaacctatcaacaacatcgtcactacaagaatctatttaatctatgacgaaaaaaattcgtcatagatcactgaaaattcgtcatagaaatatgtctgtgacaattctcttatcgtcatctattgagcgtcatagattaattttgccgacgttttctccgaaatcgtcacggatcagtacaatctatgacttttaaaccgtcataaaacgcttttaggctcgtgtagtccagcccatgcccaacctttgtgacaaaattaaatgtcacagatggttgccacgtggcggccaacattgcaggtgacatggtcgttgacacgtgtgtgtgatgacgtgtcactgatgacgtggcagctaaagttagcaaatatttttaaacggcccattatttttttgacgggccattaattttttaacagtccattaattttttacaatggtccattaattatttaacagcggcccattatttttttagaactggcccattttaaaataggcccatttcaaaactggcctattttgtcaaccaactatcagatcaaagcccactaaacaggcccattaaatttgagcccaccaaattcaatccaatttcacataccatctcagattcaaacctaataacagataccatctcagattcaactaataacagatacaatcataatacaacagaattcaaacaatagttcatctcagattcaacctaataacaacctaataacagatagtctcagatactgacaatcaaccgaagcttagcattctccctcttctcagctttcagttctgcactcatccttgatcgcttagtgtgcatcccaacattccgaaggaacacactcttcttgtggttgcgctcaagtacactagctacaacctgaagcacagacttgggttgttcgggtgtagccatcctttttctcgctgaagtggcacattttgaacaaatcaaacgcatcatgttctttaccctcatcctcgttcttatattcctgaaaatcatgtttatatggtagattacttaatcggtgacaacacttgatagtaggaaaaaaatgaaaataaataaacagtgaacaagaagaaggttagcatgcaagtatgtacgtatagatttgctgaaagggaggaaggaaaattacctggagagaaattgtgcaacttgaggtatatccatgtcattatatattttagtagcaaatgcctcagctcatatgaacaaatcaaatgagaggtactgaagtctatgacatgacaactcacaagaaatactgaagccgcagcaactctaactcgccatcgctcttggtcgttgctacggctaacatgcataaaagaaattaacagatatagccaaaaagagacccaacatacacatggaatgagttagcttaggcctagcaaaactcacaagcataataggaggacatagacatagcaaaatcagaattccggcagtaggcaaatcttaggcattgttggacttaggcacagcaaaacctgtaggatagtatagcaaaatcctctaccttaggcattgcaaaaatagtaacagatttgcctaagcctaacaagttaagatttatccatagcaaaagaggtgttacttaggcacaacaaaatcctgatgttatatatagacattgcaaaacagtaagagttatatatagaaaaacatgtgaatgactacatagatatagcacaaaagtaaaagtaatacataacaaaaatcatgagttaggcatagcgtaattgttggaactagacataggaaaatcaatgagttagtaaaattaacagtctcaagattaacataggcataaaaagggaatatctggagtggggttggcccggagagcggctacgagaaggactgctgcgactgcgagagcggctgcaaccacggcagagacgccaccgccatggaagcggaagccgacgcaccactgctccccccagtcctcctgaacagccatgaacacactaccatgagcaaaacacatcatgcatgaccagaacacagcatggaattggacggaggacggagatggaggcggaggagctctccacggtggtggtggaggcggtcgagaaggagacctcgcccttggctcgactggcctggcccccccgactcatcggctgcctccgcgtcctcatccttcacactcagcacggggggacccgtctcggccggcgtcctcctagggcgacgcaggcgactcccatgccctagccactgccgccaccctcctcctcccatccgcctcgccgccacccaagtggcccaccatcaaatcatctagctgtaaggatgacggtggcgaggctccttatccccccagtagcattgtggttggggcacctaggcgcccaaggtggaggttgcctagatctgggtcaccatggttggatccgatgaggggatgttggtgggcatctttggccgtggtggtaggccgtgaggtaacaggagtagtagagttagcggctggatgataggcagtgatagagacaattgctggtcctctaggcggtgatggagattgttgttgggttacaggagacggatacacgaccgccgaggttggatccctccagatccgcttggtggggacaggtggtagcggtgacggtagtgacgacgcggttgggttactttgtgcctgaacagctgcagcagtggaggagaatgctagcagggtagtgggcggtggtgaaggcaacaatgggggctgtcggatttggcatccccatatgcagatccaacgtgctcttgaccagatccgaagaggtggcgggatggatggcgtcaaggtggcgcgatgaatagtgacggcgtgtggctaggaagtgacatggtgccttgatatggctttccccggcgaggtggccctcggcaacaacgagcgatgacgatgcaggaggggtgacgaaggcggcagtcctcccctaaccccttctcctatcatggtgacggtggcggtgatgtggtttgtccatttgtgtcactactacaaaaacggtttttcatggcgtcaccctaaaattttcgctggtggccatacgcgaaaactgcagcaacaaagtaacaaggggtggggggcttcggaccgccagcgaaaattgatcttcgctagcaacggagttgagcgggccaccagcaaagatgtcgcagttttcgctgacggcgaacttaagacacagctagagaagatggcaaatttttgctggcgggcgagtggcgtggcctccagcgaagatgtagctatctttgctagtggccgacttaagccaccaccactcatattggctttacaagcggataacttaagtgacaaccatcgaaaattgattttcgttgtcggctgctgctaaagagaacagcctgtgaaaatcatcgccacactaaaaaaaatagtgacattaaaaaccaccacccacctactgcctccctctcctcgctcctcctcctcctctctagatccacctacccacccaccggccaccgcctcctcctcctctcaagatccctctcctcctccctcaccggcggcactccatccctcacccaacggcggtcgtcgtacccctctcctcctccctccccaccagcggcgtacaacggctccaagatgctctcggcgatggcggctctcacgtcaggatctctcggcggcgggtggtggcacagcaagaccagcggtggcacaacaaaggggatgcggcggtagagaaattgccctcccctcacctcccctcctctgtccataggggaggaggccagcagggcacccttgccctcccctctcctcctaggcctgtatagaggggaggaggccggcagcagcggcaacaacattaatagaggaaatggcttccttcacctccccttttccaaatctggcaggaggggtggcagccagcagatggccggaggtggtggcttcggcgaccgcttgtccccaatggctttggtggctagggttcttgtgaattgtgggatacgctggggagctagggttttagtgatgaatttttatgttccgttcttccatttgatgcagcggtgatgcagacgattcgatttgaatttcatgtttgatatgtggaaatgggatgattagatttgaatttcttgtttgattcatggaagagggcagctgaatgcatatggttttttttgttgccaaaatccatctgcactgtcggtcatcttaactcaccgcttgcaaaaattggatttccacagatggtcggttaaacctagttgcttgcgaaaaccattttcactggcagttgggctaggttgcccactagtgaaaatgatttatcgctggcggctggttgccgccattgaaaatggtgcattttggccattggttgctggcggcagtgctgaccgtcgtagaaaacccaagctggctgccaagaaaaatcaattttgtagtagtgtatagataagacggagagactgcggtgctcactagagtggtactgatggtgacagctctcctccatcacgacgatgatctacggtgctagcaatggagggatgtagtggcactagcgcggtgtgacaatgtgcgggagacatgtctcttcctcaggatgggactcctacatggtgtctgtctggcgatggggcgctagtgtggcggctagtgggtgcaagggaaagaggttctctggtcgaaagcctaagctgttttagggtgaacagcggcagcgttttctagcactgcttggaggcgttgttgtgaagtcttcttccttcccaatcgaatcctttgggtgaaaactttgtccttgtttccagggataggcgatggctgcgccctaggcgtcgcagctttgttggaggtattgtttgaaggtcatttcgcactaatctattctgtagagggtttgttttccagctgtggcgcttttgtccaccattttggcgggtccacgtggtggagagcagatccatgcttctctctcgccctctccctctcagatttgagtgcaatgggatgttgtgttcttgtctatttctcagtggcgggccatgtgtcgaggcatgtggcatgacatgttgtatttcctttttctatctatagccttctagggctatagtcttgtaaaacttttctattatatcaaatgatatctctcactatcatgtgcgggtttcgtttaaaaaatagaatggagctagctagggagtattagggctccctgatgttttccaatcctgattgttgcaaataatagaagggaaagtgtggtaattgccaatccgattttagtgaaggtcatcatcaacatctctagttccccagtttctagtacagcttaccgtgggtgtctcttttttggtgttccataaagtggaaagcgcgataatttaggatgtactaatagatccgaaatttggaaattatagaattttcagaattttttaatccgaaataattaaatttgtacaaatttggtcaatgatggggcgaaggttggtgggagaccagaagggttggcaagaggaggaagatcgagaactccacctccccgcatggaaaaaggtgttggccattaacgcgtgattaattaagtattagcccataaaaacttgaaaatggattaatataattttttaaaacaacttccctatagaaaacttttgcaaaaaaaacgcatcatttatcagtttgaaaagtgtgcgtgcggaaaaagaagaaggtgagttggttaagaagggtggagaacatagccagttttgaacttacttgggtgttgtgtccatgcctctaataatctttcagcctatcttcttattggttctctattctactgctcctccgtgtaaataatacttgacattttggataagagtgatatcaaatattaaaatatttgactataaatattttcttaa

SEQ ID NO: 57614 - DNA, 2697 bp, Oryza sativa
ccaagcatgtaaaattcctcaatgagtggcttaaagggtgggatgaaagaggtcacagaaataaacagaatatagttactaacgggagcatgaatggtagatcctgtcaagatggttctgatacagattattcagaagatgcttctgattatgagaatgtgcttctaattactggaccagttggggtgagttccattttgaagattacttgccgtttgcattgtatgcttcacgtattgttttgttttttcttttgaatttgctgggcatcatctccttgtgtgttcgcgtgcgtgtgtgttttgtggggggtttgtgtgtgtgagaggggaagagggggggggagccttatcttatttgtttgagctcgggacaataatttttacaccccctggaacttgtcgggaatttgaattggtctgtacgtttgaaagtactaagctacgtctaggcagaatagtaagttttcgaccacttttttctccacatgaaggtgtggtaacataagattactggctgcaatcaattgatgctcctatagtattctattatatatttttgtatgctgtacttgaaaaaaaaggtgtaccaacctataagcaatcagttttgttcccagctgcaaagctgcttcttcattctctttgttcatttttacagtgtggaaaatcagccgcagtttttgcatgtgcgagagaacaaggattcaatgtaattgaggtattgtctggaattccatttttctctaccttgtaagagcttccatattcctatattatttgtgtactaagatactaatatattttggcttgatgaatcctttcagcttcttctttccttttcgcctgtttttctctacaatatctaccaattcgggacttttttgtaacattaaaatgctgtaaaaatgataatactgtattggaagtcctttatttatatactccctccatctacttttgataggcatatttccaaatctgaaaaatttatttttgataggcatatttcaatctaacaacttatcatcttaatggctttcttggatttaatgcgtgactctccattcttccacacaagattagctacatgggcatcgagaaatgtaaatattaatgaatcgcttgtttacgaggaatgactagtagcatatttaaatgaatgataagtagaaccacttatcattgttctgtgtgtcaagatgaaatatgactatcaaaagtagatggagggagtacaacacacacatgttcctcccttaggaacatgaaaaatctaagggtgatttagtatatgcttttccatccctctcttgacacgaccagcttaatatgcccaaaacagttgtgttcccattcttaccgcacaacaagcttcttgctcaaaccctggatctgaaacctgacaagcttcatgactccagtcatcctagcatcaagtacattcccactagagtatttgttcatatgaatagaaattctattatatccatttctgcacattcaaggtactctatgtatagaggaataaataattttgaacatataaaatatggcgctgtttgggggagcttctggcagaagaaactgaaagatctcattgaaattgagcctaatcccattttgggtagattacaccgctcacacaaaccttagcttatgcatttgtctttgcttcgtgtaaaagggttacatgggggttgaagtgttttggtacttggtatatatgttggtacatcactcgttaaactagcaagatggtactattctaccatgcactcacgcccacatgcatgggctaaagttgggctcaactcgcccctcttgggttgggtctcatgtcttgaattcaaggagggttttagttatactgatattgtggaatgtgcttatttgaactcgactttgttaagatatggtgatgcccagaaattagctgaaatccatttttttttgctcgctatgaggtgtcacctggcttggttatttgggtttcgtttgtatatatgagaaatgctaacataaccacctccatgcgcacccatactggtgtggatcagtcttgctttagctactatggaatttcgttattattatgaggcacttagctagctcatatccataatgatgacatcaagttcataatcatgtctagttctctaagcgtaatcaaacttcattgtctagtaagcacagacaaaacttaaggttctctaccacctgattatttgagttatgcatttatgatttgtctgttggtctaatcaagctaacatatgataaaaggctaagtaaaggtccatggcctataatcggttctgtcttcatccttatgtttggatatattctaaagtataatcttgaacttgttccagacatacttgattgtaaaaatgcagtagtgtcaggggttataggtttttataggttacagtcagtaaaaatgttatgttaatatggaattatggacacatgctattcaaaatgcagtgctttcattttagagaaaactaggacatgggacatgaacagaattctgagtattctcgttacctagtttacagtacttcagcaaaatttattcctgaaatttcaactctgatttctaaagcttgatttttttattctgatggaagtttgtgacgtttttctaggtaaatacatccgatatgagaaatggggcttatgtaaggcagaa

SEQ ID NO: 57615 - DNA, 1878 bp, Oryza sativa
tagagctagggatctggtggagtccatgagcctaccgtagacccccatggagtgctcatcaacagccagtgtctgcacaacatgggtcactggcaagaatcactcaacagttgccagtttggagacacctttatatcaacaactgtcatcttatgaccgtttattgacaagtaccggagtgttcattcttagtttctgactagagagtgccccttcttgtaaactccataaatatattcacacgcaagattttgggttatataggaggacgaaacatatataaccagtgtctcgatcaacctttccccacatttgtatttaaaagaactttcctcatatttacttcgtaaaattgactactattcgacggcgttaatgcctaacataatctgggatagacaagcgtgatctctaatgtggctacgactgatttttctcaaccaactagatgataagaacaaaaggatgttggttttggggaacaacacgtgcaaaccaaaaaaaacataagatagttgtttacagttcttatgaagtttgctctttgttttcttgccaactagatgcatagcgaagtgcagtttaaatgacaatccaagcattcttgtctcaacttttcaaatttgcatgtttgagacaacctcagaagtatcttttggtttcccatgcaggtcacaagacgagatcatcggtttaccaataagcaattccttagatccagcttcagggactcctggcacggctgaatacaaacaagtcattaacaagaccctcatcctatttgaagatgtagatactgtttttgatgaggaccgtggatttatttcaactatacttaagatggtggagactacaaaatggccaatcatactgaccagtaacagtaagcctttttgtctttaggattttgtacatctctaccatccttcgaaatttcatttgattaagagcatactaaagctcttgttattttgttgtttttgtctttatatttcctgaagagaaagatccgccattgcctcatctcttggctcagctagtattggatttcacatacccatcatctgcagagttactttcacatgtcgacatggtaaaaacaaattagttctaggctgaaataccaaaaaactatgctgctttctgcaattattgaacgatgaccataccatgttttcgtgcagatatgcaagtctgaaggagtagaaatcactgttcctcaacagaagcatataattgatgcctttttaggtgatattaggagaacaatgatgcttttacagttttggtatcaaggcaagcagcaatactcaggttgggtgctttgaatgtaaaatccctttcaactcactatatggttgcgttctggttctgacctgttggcccattactaaaataaattaagagtaaatttcataaaactatgtatactttgcacaatctatcacaaaactatagatttaagaactcgtttcacaaaactacagattcagtgtcttcgtttatcacaaaattacaggtactttgcacaatatatcacacaactacatatttaagaacttgtttcacaaaactacagatttaatatcttcatttatcacaaaactacaggtttagtgtcttcattatcacaaaactacaagttttaagaatacaagttttaacattcttaaaacttgtagttttgtgattgttaaaacctgcagttttgtgataatggagacactaaatctgtagtttgaaatatcaatagatgcagcagccaatatgttcagttgtggaacttgtttgcaaatcctcctagactagcgacttctgagtttatgataaaattgactttaatgggctttatctgtcatcaaacagttgttttatttt

SEQ ID NO: 57616 - DNA, 2233 bp, Oryza sativa
agatgcagcagccaatatgttcagttgtggaacttgtttgcaaatcctcctagactagcgacttctgagtttatgataaaattgactttgatgggctttatctggcatcaaacagttggtttattttcatatttaattgtcaactttaagttagaaatttcatctggctgttgcatgatttgttttgcttattaatttttttctgtgaaagaatgttattgaatatgttcagcttactgtcagcaccgaaatgtgaccatgtcttgagatatctgttttagttctctttttcatgtgatattaatgacaaatcagtaccttagcgtaacaaaattgcaatgttgtgttcagtcttgaaatgatgagcacatcaattttggtacactaattttgtgttttgctttcagggaggttgaataagtgcctgtcctgcccttctctacttgatttggatgcagtacattctactgtaccaagaataatgccttgggacttcccatgtaaattatcagaaacaatatacatggaaatagacaaaacaatcgtgacagctgaacaaaagaaaaaacagatggaagtatcagaatttgaaggcctcgaattacaaataatgacacctttgaccaagggaagaagtgctggtaaaacaagaaaacctaagaaatccaagttaaagcatggccgctctgctgattgtaatgatgcttcaccttgtaagaatgaccttgacgatttccatgatagtccagatatccctcttccatccaatcatcaaagaatgagaaataggcgtggagtagttttgtttgctgagtctgatgatgatctagctgatgcacatgctgccaaagatgccacatttactgttcaagaaggtagattgctcccacaatcttcagagctgccctgtttatatggccatgggatttccaacattgttccagaaagtgttttcttccaacaatcatctgtgcctcatttacatagggaagtgatttcaaatcaattatgctttcctagcgaatcaagggcctttgaacctgccagttctttccaaaaccagcttgaaagcaacatgcccgggtccatttcacaaatatgtgatacctttatgtctcagggcatttcatgtgtgcctgagtcatcgttcatggttggggggacatctgcatcaatcagcagtgatgatcttttatcaagtctagtgtccaatggtttgtctgcccttcgtaatgagagtacttacactgcatctgtagtggcactagaagacactaacaaggtggagaatcaaatgactgataaacctcaaaaatgcatggaagatgaagttggtgagacttgtgaggcttatgtggaattggctgacaggaatgatcatgcaagctgttcaattacaggatatcaattgatggatgaatgcagtcgtgctgaaagtgtttggttgctttcagggaaaaaaaacaatgactcctgcaaggtcgaacatgtacaagatacttggaacaggctacggcagtgccatcctgtacttccatgtgacatgaatcacaacagatcagtttctggagctttgaagcgtgtttcaagagtgtctgatttaatatcagaatcagatcttatgctcattagctgccacccttttagtaatgtcagtgtatttttgtctcttttgagattcatgtttctgtaatatggtattgaagtatttataattttgtgcaggatatttcagatccatctttgactccttacactgagtctgatggcttctcgtacagcaagcagcttgagatgggatctatctatgctcagcatggtctttgcatttttctacaggattcccaagctacagatgatggttttgttgattttttacaagagttgttatttagcggtacaactaccacatctttgggtaaatttgttagctctggaatcagctgtggtgatggatctgggaacatttcccatgtaaaatacccaacaagttgtatttctaagagaaggtaagcattacagtgtgtttgcggtgcattttattgcttatgactgatatcatatgacgagctcaaaaaatatatatacacatgatggactatcttccttatagttggagctccatgttgatcccttagctatgcttgatttatcgcatcaaccaggagtatgagtagagtggattattttattggtcacagtaatttctgcagcttgcttcaatatagggtca

SEQ ID NO: 57617 - DNA, 1455 bp, Oryza sativa
ccatgaaaagagcatgggctttgctcacatgattagcaaagccaagaatgaaaaatggtaggttaaaacaagaatcacctgaggatgtgaagataataataaattacagacacagctatagacaaccatggattcttcatgatcttcttttagcggcaaagctttgataaacaccggaagtacctaagaatcaagcacagaatgcgtattagaccagcactctgaagtttgaaatctgaaattatgcaaaatattatgtactgcagagtgccaacctggttgagtggaattgactgaggctgcaccattatcatcctagcaatggcaccggcagcattatctctaactgcgtcatcaggttcagaatcagcaaacaaacgatgcagaccatggagtatatccccgtagtatctgcacaaagatgaataagaaccagcaaacagtacacgttaacaaaaacaatgaactgaatttacagcatgggaagtcactctaagctccatagaaagagcaatgcaatgttaaaaccaattcattatcaactagacagcagactattcagtacgcttcagaattcttagtcacatacattagcaattcagttgacgaggtgggttcagtttaaggataatgctcttggcatattatcactggaagaaacaatagcttgatttcttggtctttcgagcagaattttgaaaatacagttgtccaagttggactatgaaagaaaaaatggatccagagtaccctagtcactgacaggggactgataaatacaccgtaataattaactccatctgattgtgtcatcaagtattacacacatcacaaggaaatgcatataaaccatgggggcaaaatgggataagcagcatttggacttgtgaagtgccaaaatcttgggctcgaacccgtgaacccaccgaatcaaactaacacaacccacttttgcttgtgtacatggtttggttcggtttactccaccccgttcaacccatgagtcgcctccttctccagcagggccatctcaggtggcggccaagcccccggacggctgtgccccttacccgtgaggccgcgatgagtcccccaccagttatcgccccccatgcggcgaggtcaccggcgactgtgcgcccgcccacgacgagcaccctggcggctgcatccccatgcacttgacaaacaccaacggcggccatgaccccaacccttcgatgggcctatgctgcggctgcgtccccgcgtcggccatggccatgcccatggcaacataccctggcaaacggcaattcatctagtgctcgacacgccacgtctctgcggccagctgcgtcactgcgtggtcgacgactcagtcatcaacgtgatttatgcaacttagctctgcctccccgtgcttcttgggcagttccgccatgaaatctggtgctgccgacctcacaaggaacg

SEQ ID NO: 57618 - DNA, 1419 bp, Oryza sativa
ttcatgcccatttcgccccttgcccacaaatcctagcatgctccagcccaaaatagaactactagtactgagtaactagctgtggtaggtggctcaaccagtggtgaacccagaacagaaattacagggggtccttatgctcatctgacccatgcggtagccttctcaggtgtccaatgtaacttggttgggatatcccacatggtatagttataactgtaaaaaaataatttacatgtgtccaaggacccctgttgggccttagtaggtacgcccctgggctcaaccagcccaactacaggttattagagaagaaacaataagacattcccttggataatctgccaacactaccaaagagcgcatcagtataggctctggagcgacagtagtcacagtgtgatgccactatcatcggaaacttcactggttggtgacttggtgtcattaattgagacatgttccgccagcactcactatccttctctgcctgacacaattgggcctttttgtcatgcttgctcagattcgtctaccatcttcatcatcctcatctactcgccctttttttctcggtgctattttaaataagtctatttgaatttggattttttttctctcaattaagtccatttgaagctatgaacagtcatttttagactagtttgatagccatcaaaggatagtggttatacagtggttgcaaccttatatagtgattttttttgtcatcgataaacagataaagaattaaaaattgtcacaacaccctaatttaatcatgtttctacctgagttatgtattgttttgacatgttctctccctaacaaaagtggcacactagacttatatgtcctttaaaagaactagttggaccaaccgaaattcaacccaacgggtgaatcagaacagtatggactaccgagaagacgcagacaacagctaaggtaggcaaaattcaagcaatgtaccttcttgccggcctctgatttccgcggccttcctctctttttcaccttctccggcgtcccatcgcccgcggccaggggagggagaccggcacctcctgcttctcctccgcctccgcccgccttgggaggtccccacgagagcttcgactgaacgcaccgccgcaaccgattcccgtccgcggaagcaggcgaaggagtcgccttcgccggggaaggggacggcgacggcgtcggcgtcggcgcctcgggatcagcagatccgcccatgggaacgagcgagaaggcgaggcggagaggaggggatcgactctagggtttgggtttttgtgaacgatggggggaagaagctcagagaagtcagagtgagcacagcgggagacgggggttggattagcttcacgtttcccgcgcggtgaggcgaaacgcgggcagatttgggcgcgccgc

SEQ ID NO: 57619 - DNA, 776 bp, Oryza sativa
tgctctgcctcaagggatcggacgccgtcgtcaacttcccctcctccgcctcgtctcgccgccgcctcgacatccaccgggggggcacggactcggcggcgggcgacatgtcgccgaggtccatccagcgcgtcgcggccgccgcggcggcggcattcgacgccgccgccgccgccgtcgtcgtcgacgaaagctgctcgtgcagcgccgaggcgatgtcgtcgacgccgacgtcgggagcgacctcgctgtccacgctgggaagctccggcggcggtgacgtgctggaccacgcgacgacgccgtcgtcgtcgtcgtctgccgcggccaacgtttgctcgccgccgctggagggggaccatgagctgtggacggagctggacgcgttcgcgtcgccgaagttcatggatctaatggccgccggcggcacggcgttctcgtcgccgtgggaggagcccgaggaggacggcgagctgatgaggctgtggagcttctgctagcttagctaggagcctaggaaatcgatcgtgaatccattcgcccatgcaacacaatactaccattgatccaatcaatttctcctctctttgagcatcgaaagctaggttaattaggccttggtccatggcttcagttcttccatagattcttcttcttttctttgataatatcttgattaattatatggttgtaatttatataagtattttacggtgttacactgtacgggttgttgaatgagactgtgagtgcattggatactggttggatttgtt

SEQ ID NO: 57620 - DNA, 2855 bp, Oryza sativa
  unsure (1)..(2855): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcatagataagaaagatttgcctctgtatattgccctgtggtatcagaaatggctagaccaagaacagagcaggttctatacataacgggtatagctagcaacttacttgaagatcccttcataatttttggtccgtctttctttgttattagaaaaaggcatgagaggtcgttttctgtagcttctcccaatgcttacagacccctctgtacaatgtttttgtatactttgactgtgagtaggtttagttctaattcatgggaataaattgattttttctaccaggagtaattctggctagcatctcaatgatgtcatgtggtgtgaagagtttcatgcagctgcaaacattttctttggacagcattgggttttctcaattttgggtttggatgtgtgctaaattattacaggtccaatcttttggaagtcttacaactgtaaaagtcaaactgttgagcaagctcattgtgccacatcccctttaaaaatgctgtcatcaaatcgaactcaatatgtcaatctcctgatgtctaaagcgcatgcatattttcctgaatcctgaagactgccaactgccgtatgcatcatttcatgaacacttccaaccgctggccgatacatcattaagctatcgtgttcacgcggttgcaatccctcgagctgagattgcctacagcgaagaacaaacacctcagacctacccctccatccaaaaaaaaaacctaatcttacttatcaacatgaacatatgtatgtccagtttattgctaacctaatcttacttatcaactctgaacaacccgagaagggttggacgcgccatacccgagatgcgatgcgcgcccatgccaaagacgttgtgagcgctcacacgaacgaaccccgtgtgagcgctgccgcgcgtggctcgcaaaatcgcggattgccgcccggtcgcactgttgctgctatctgggcacgatgcgctgccagcctgccacacaccggtgctaccacccatcgcagccaaccaaacacggcgtgacgcctggctcgctgcaatcgtctccgcagcccgcgctgcccacgtgacgctgtgccacggagcttctgcttttccagttggccgcgggggaacaaggcagaaaaagggaccgatctgtgaaagcaaggagggaagacagtgtaaaggtaggagaagtcactgctgggttggacctcatgcggtttgacgggggagacctacttggacagcatggggtaccagcgcaacagggcactttctgacgagaaggaaagcatgcgatgagcaagaatctctattaaacaactgctttgacagcgaagatcgatatcacacttgagagggttgcggcaagagctgggatgcttgaaggcgacaaattgaattgagacgcatgtgacatggacttgattattattcagcattcagcggtacggagtggaagcacaagaatgcagaaacaataacctgaagagcagtcaaatggagtcagaaaaacacctccatagttcaacctaccaggaaaaaggaacaggggcggtatggcatgataaatattcgaatgcatatgcgtacccagataatccagcctgtcctcccttcgtctgatctgtctcagcttgatcaatatatgagccgtataagatagggtgtagtattcggcaacagccatcagaaaagaatcaatgagctcaagtggtgccatgcaagcgatccggaatgaaatgatgaagagtggccagcatgatgactgccttagaaaataatctttgttagaccaacttacaaagaagtttaaaactgaatgtacatagtgattttaccatctattcctgcaacccaagctataaatcatacaagtgtgattaaagaaaaaaatagcccaaaattgtttggttcaaataaaacctcatggatatcagcaaggatctctattaaacaagagcattggggattgtaacaacagtgtgtttggaattcacatgttctcactcccatacacttggacgaacaatagctaattgattaggattttcaagtagttggaacacattcagaaaactccgaacagaacagcaccttagtttacaagagggcaggagactatctagagatctttgcacctagaaaggggatacacagattcatgctcgagcaatcgacaccaaagatcgaatgatcaagtatcagcttcgagcttcttagaatgtaaattaaagcacatgcacttatcgataagagcctcagactcgttaccatattctttgaacctgtactcatccaacttgaatgctgatggaaccttcccttcactgtagcatcgattgcacaagctaaaggagtgctttgtctccttgaatcgggaaccaatgataggatatcggcaaattgagcaggtgtggcggccgtgacgaatgtgatcgctgtcctcaagcttcaccaatgtgcttaggattccaaatccccaatcgggatcattgaacatttcgaggaactccgtgtatgataccatagtggggtcagactccccatgcatttcaagcatgtcgctagccccatgggtgggtatataaacagcacgaagaagtttgatgtaggacagtgcatcgctcctcctaatctgacccctgcttccttcacttgccggacgccaaagaagtgcatcaaagacaacccgcttgcgcttat

SEQ ID NO: 57621 - DNA, 4649 bp, Oryza sativa
tatcaagggcattagcaaggtcctgccgcaaggtagtctttcttccaaccctcttgaacttggatggctccactacaacgaaggcctcctctccttgactatcatcttttcctttgggaggctttggtttcttcttctgcagtgtcttcagatgagatatggcatcatacacctctaccctttgtgtcatcttaaatgcctccttgagtgccttcttggcctcctcagactccccctggccaagcaaagcaacagccttgtttagctgagcacgccaatggttcggtcggatgctcaacacacgagtatacatctccgcagcccgcacaaagcgccctgcatccatattcaatccaccaagattgtacaaggcatcaacatgcccaggtttgagatcaattgccttctgaaactcctgaaccgcacggtcatcatccccgatcgcatgcagggctgacccaagatcacagtgtgcatcagcatagtctggcttcaagaagatggcctcctctagtgccttctcggctgcacggtactcaccaacaccaaagagcgcgctaccgaggagcttcagcgcccgggcatgagaaggacacagtatggcagcctctcggtagtgctcacaggcaccgagcaccatcccctcagcctccatggcaatgccaaggttgacatggatctgtgggaggatgtccgcagactgggagccacctgcctccgctgcctcaagcgccaggagatactcttccttggcctccgagtggcggccaagggcgtagaggcagttccccgcgcggaagtgggggcgcacgtcagtgggctgcagctcgcaggcgcggcggaagctgctaagcgcgtcccggaagaggcggtgctcggagagcgccctgccgatgaccatgtgattgtcgaaggcctcctcccgtgagcgggaggcgtccgcgcgcgtgcggagcacggcgagctccttgacgaaggtgaggtagtcgcggctcgtctcgtcccatggcgcggcggtcgaagccgaatccgcttggccggagatctcccttgaccacccggcctcggagaaggagtcgaaattgttgttccccgcgccgccgctgccgttgatcgtgtcgatggaggatgttctccgcagctgcttggagcggaggcgcttcactagtatctccaggtcgtcgaggagcgcccaggaggagtcgaacgcaatcccgtggctgggcgacgtcgcccacgccggcgcggccgccgcggcgcgtgagctggacgagggcgccccaccggctgctccaagcggcttgatgtggtcgtccaggagcgacgcggcggcggcggcgccggagggcggggacgaggcggcggccgggtcccccgcggcgatctccggggaggactccccggactcgagcgggggaagggacagcgcgaggaagtcgcggtcgacgtccccggcgccgtcgtcgtaggtgcgtagcagccccggcagggagaggccccgccccccggggagtatgaactcggcgtaggtgcggaacacctcgtcgaggatggcggagatctggtcctcgctgaacttcacccgcgggttgacggcgacgacgagcgccgccatctcgtcgcggtccagccccccgtccccgttggcatcgaaccgctcgaagatcctccccaccttctccgcccgcgccccccgcccggccgacgccgccgccgacgcggacagcgccatccaaccgccgccgctgcccccccgcacggggaaacgctgccgatttacggcgaaatccggcacgcgggcgggcgggcggggcacgggcacgggcacgcacggggttgggggattttgagggggggctcgagccgcggacgggtgggaccagggtggcttggtggaagaagaggagagaggagcggcggcccggcggttgtgggctatgtagaggagacgatcgttatgatgacgatgatggtggtggattgctgctttgggtggcggcgtgtgggctgtgggagggagggggatcggttcatcggcttagctggctggcacggccgcgccgaccgctcgcgtctcgctgcgcaatctcacgtggatatctcgcgatttcgagccacatacgcgcgcgcgcacggtcgctctcgctcttgggctctcgcacggtcggacaccgtggtggcgctgtgggagactgtggagtggactggtggtgggtgcttgctggtagggggagaggaggagctagcgaggcagcgaggaggggaggagcattcatcgtggcgagcgagttggtgcgttacgctggctggcgtggtccggcagcatcgttgggagttggggaccgttaatttggatttgggaggcgtcaacaccgctggacaaaggtgggttgggagggagtacgccgtaccacaaggaatgttttctctgttattatctaaaatcaaaatgagacattggtttttttaagtatagtagttattagagcttgacagctatgagattcatttatttaaatattttgtagcgttgaagttctgtttaataattgatatgttgaagcttcctttttgcaaggggctactggccacggctttgtatatgaccccggaaggcactgtcagctggatatgatatatctgtagccagaacaggtctgccgtttcctcaccaatggagtccccatcaagccatgaaataatagaaacaacagacacccagcgagagcaatcgatttgctgggcttgaaagatacttcttgagggggctttttgctaaccaccaggtcataatgtccgtaatccggccggagattaccgaagatagcaggtgattagatgtaaagtgcggatccaatgtttgctatgcgtgtacggcaactaaatttgaaatgtatgtggaatgcatttgtaagcttgggttgcatcgttgtactttcatgccactccacctaaaaagaacacaagtttaaagctgctcaggttataccagaactcccaaagaaccactgaaaatgatataaccgaggctgctttacatttcacgcaactttgtttgaaatgtttatggtttacaaaagcacatatcccgactatttagtatacattttgataaattgcaagacctccctgggtgaaaaatgtagacctttatgtccatgactccatgtggagagcaaagggcaactgtcctctgcaggggccaaattctcaccctaaaaaatgcaagtaggagtatttctcaagcaatacagcttgatatgactcgatgtgttaatattatcatggtactcctccaagttctgcattaatcactctcaagcgtactgtcaacaagaacagttccaccatagaaaataaacctacttgatttacattttattgttggatttatagcaagagtaagccaattatagggaattataagagcaggtaaaatagcatgctataagccaactataaacatattttaaagacacaaaggaagagagagaaaagcagcgagctacagatctgtagccagctgcattacggactccaaaacgtaatgtgcgtatgataggtgggaccagatattaatagtatagtaagcaactattatataaattggctatatatatgatttggagctagtagtgggctatactattaaacttgctttaagcatagagaacatatgaaacttcaaccttactctaggcgaataagcacgttcttttatgctcatttaccggactattgggtgaattatttactcccacgtttaaaacaaaaaacatttttttttcaaaaaactttattctgaattgttggtaaatgctaatgtattgctaagacaacttattctaagttatttgttactacctccatcccaaaatgtttgacgccgttgacttttttaaaaatgtttgaccgttcattttattcaaaaaatttaagtaattgttaattctttttctatcatttgatttattgttaaatatacttttatgtatacatatagttttacacatatcacaaaagtttttgaataaaacgaacggtcaaatatgtttaaaaaagtcaacggtgtcaaacatttagagaatgagggagtaattaggttcataatatatactccctccgtcccaaaagaagtgcaattttagtactattcatgttcaacgtttgatcgttcgttttatttgaaaaaaaattatgattagtatttttattattattagatgataaaatatgaatagtactttatgtgtgactaatttttttaatatttttcataattttttcaaataagacggatggtcaaagcgctaaacacagatatttatatagctgtacttattttgggacgggacggaggtactacttaatttcccctgtataatcagatagcaaatccatcaactttcatccacgaataatccatttataacactgcctaaggacgcgacctcgcccctttcgctaatcaaaccgtacgcgccaatttgacggatggaaaaaaaaatactagcactaataaaaggagtagcataatcgaaagtccaaagcttgcacttctaaagtaacatttgcagcagtacatccaccataaatggtggtcttttcgatccagtggcatctcatgttggtccatactagtggtacag

SEQ ID NO: 57622 - DNA, 2352 bp, Oryza sativa
cctgaactttctccaatatggactgcctaagccgctcactctgccaatttgacaaatttagttagcacaccaaaatattgtgaaatattaaacataagttacatcactaattgtaactgtatttaaacaaaccatccatccaatgcatagtcctatttgggaacatactgccaagtgtatctttttcttatcacagttcactaactcctttgcttcttctgatttcttttgaggaataaggatgggggttcatatcaccagcaccatttacgtggaataaaagaatgtagacagatatcatataatccggaagtcaatagtaacttatatcaagtcgtcaccaaaaagaaggctgacagctcagctgaagcacatgatcaaagttctccctttttgctttatatataatattgcccatgccctttttccctttctccccactttgattattaaaacatgttaagccagatatacattcctggtgcctagaaattagctgaattcactagcttaccgtaaatgtatgtggcatgggctaagaaacccaacgtacattaaataatactgtttagtgtccaaaggttaaatgaatgatccgaccaacattgaagatcaggtccattttgcaggtaaagcaattgtttaaaagttcaattgatggaagcaaatcaagaatagacaactgaaatttatccaatcaacagaagacaaaaggaactaagaacacaggtggtacacggatagaaccttctggttaattatttcatcaactgaaaatgcattgcagttttgtctttaagcaacagtgcctacaataatgtagcaggcagatcacattaactaagacaaaggataccagaaattctatcttttcgttccattttgtctaacaccgtggcttatcaggattcaggagtcacatagcagtcccatgtgtatactgatgggttagctgtaccaccaagtataatatgtaacacttgagggttcaaagacagtaacttcaggatgatcattttggttaaagaaagggttttagtccaatagagttgctaggcctgcataggcccatctagagtggtatctgggttgtaaaccaaacatagcctaatgttcacctttttgttaaaatttacatggttttcttcaggtggagtactgaaggaattccttgaaaaaagatggtctgctcatgtagagatacgctcataacgatcagcatggtgtcaatagcaattagcaaaggcggaaacctctaacattagcaaagaaaagaaactatctgtgtgtgcccttcacctgcaaaaactatatggcctgaaacagtgacgcttcactagttttccctaacaaaatgatcatgaatacctcatacaagtaacacatgctggtaaagtaataacatcattagttcatttttcgtattagctaatcccacaacgaaaaaggtttacgagtgcctgacctgggccttgatgaagcggtccatatctgcatcgagccgctgaacctcgcgagagatgtcatcatccaacatcgggagcaggagcaacggcgaatcgccggaggagttcccagccccagcgccgctgccaccgccatggcgtctgtcctccagagagagcgccagcccagtggacaccgcggagcccgtctgcaggaaatcgatggacgacatctgggagttctctcctagcagctcctgctccctaggctgcctccaccctagccccgccgcggccgtaagccccatcgcgtccaccactacacagtacggggcaaaagccctatgctatcagcgccaatcgaagcggaatttcaaccaggcgaagaggacgagggttcttcgcggtgggtggggagaaaatggaaactcacgtggtggctgcgcgggctggtcctggaaggccggcggcgggttgaagaagggaagaggcgccgggatctgcccatctaccggcaccggcagcgcgttcctgccatgaagcgcggaatccggcggggaatttttagcgcgaaaattcgtacgcacgaacgcgcagagaatggaattgagatcgcgtacctgaaggaagggggcaccggttgctgctgctgctgcggcggcggcggcggcggagcctgaggatgcggctgctggaggtggtgatgggagaagaacgccatggccgaggacggggaggaagtcgggggaaggagggagagaggggaaagggaaggtagagggaagagaggagagagaaggcgagacggggtctacagttacgaacattttggctcatcgagagttgtttaagcggctaacatgtggggtcacggtccgtggagcccacatgtcagtcacgtatttgt

SEQ ID NO: 57623 - DNA, 2477 bp, Oryza sativa
ctcggcttgaatcgtggccatttcagcccatgtataatattagtaaagcgttggaacatatatgccgtaaactaggccatatgctttaaatggctgacatgtgagccccacatctcatggttcgtatgtcagtgatctatgttagagggtagtattgggtggatctacaatatatgggacaacatcaaatgacatcgataaatttgggtaaaacatagggttatgttgtttatctatatattataacactatggtctaaaatcctgtttgtttcaacttaagattattgtaattcagattattgagtcggattactataagttggattataataatctatagtagagtaacttatgagttgtttgtttctccgaattattggaggaatggattattgggtttgaaagactaatgtctataatgccctcagctattgcagagtgagagaaggatgagatggcggtggcgacgtggcttggcaaaggagctaggacgcagggtgggggctcgggaaggatttgcgcgtagggttcaagcttggggaagcattcgcgcgcgactagggagagaggaagcggatgcacgcactgccagtggagacgtcggattcacacacgactgggaagagaggaaacggatgcgcgtgtggccgggggagtgagaaatcggatgtgctcgatcgattgggttcgatggcagtgctagataatttgcgtaaaattttaagggtagtgggtctttagccacccaataatctaaaaaaaatcatgtttagaggggattaccagattatactaatatagtttatagattataataatctatcatagtaatttaccaatttgtttcatattattactaataatttagattgtaataatcctaagctgaaacaaacatgatctaaatataattcgcataatatgacaccgaagatacattatgacaccaacaaaccaattttgcgatccaccactggcaatagttcaagagcttctgttagaagtgtaaggtgtgtacatgccaaggtgttttcggaggctctgttgcccaaacgccgcagcaattatacagcctcaagcacactacttgcactcgacgtcgggggctattcgattgttttgataggaggtcatcgtttggcttattataggaataagccaaataatatatttgtaaacgaaaaataaattgtgaacaaaacttttatatacgtgttcttggcgacctaaaagcaaaggctgaaaaataaacttcgatgaaaaaaaaccttaaaatcaactccaaatttaatgttgaaaattcaaattttggctaataagtataaacataagcgaaaagatgatagaaaatttagaataatattagtaaaaaagaaatgaatgaattaactattgcaaaaaagaatcaaaatgtttttttttataaaaactattactccctccgtcccgaaaaaaggaattaggatgaaatatgacatattctagtacaatgaatctggacaaaggtatatcaaaattcatcacatccaatactaggttggttttttatgggacagatggagtacctgagaaactaatacatagaaatttctttaaaaatcaaagtcaggaagcatgtctgataatccaatgatatgtaaagagagcaaaactgggcctaatgaagaacacaaatagaagttcccataaacagcatttcgcagttttgcgccccacgtcgcagcaatagcaccccttgatgagtacagcacaaccccgcacaagtgcgcaacaagcctttggaacgcaaaacgtagtagtattatctggcattggcttcacgaattcgtgcaggtccattgaaggacacatctttaactgactaaaaacatgcataaactcacaattacaagtgaacagatgaaggcaacgtggagatcacgtcagaaacaagttgcataatatgtgctgggtattacactcgtgttttgacaatgtcacaatgcatagatgatctttctaagcagaagatgtaacatgtaacaagtgttcttatatcctgcttaaccagcgaagattatatacgttctaaaattttcagaattcagacttgctcctaaaaaatgacatcaaaaggatcttagagtcgttcatagttcagcagtcacaatgacagatgtacaggttaaccgcagcaggatccacaagcagggagagaatctggaatttgaggttggttagtcttagatgtgccaaaaaaggccacagcaaagtaaaaactggaatttgactcagcacttactctgatcgttagatcggatgtcagatagtgtgcgaggacctcggaggccgcctccaccgccgcggccgcccccataagggccaccaccaggacctccccaccaggcccaccatcccatttcttaccagagccataccctttcctatagctgtctgttttttcaatctgaaagatggaagtgcggaaatattaca

SEQ ID NO: 57624 - DNA, 8396 bp, Oryza sativa
  unsure (1)..(8396): unsure at all n locations
catagccccacatccttactgaatgtgtgcactgaaatagaaagacatggtttacaccaaacacatatacagtaaattacgatatttaattactccagttcaagaggaacaaaataatctcacggtggatttataaccaatccagtttgaagggctacagatcccataatgagaatacatgttccagtcccacgcccccaccacacaaccaagttcccaacaactttggacatctcaaaacactaacttgtaaaattttgccaagcatatttttctatcttaattcttcaagattttaggcaaaaggcctgcactagtgcactttgatctaattgaacatataaaaccactttgataggttgcctattcaggctagtattatccttagccaacatctggttgcatgattccatattttcattccttaaaactataaaagaaagagctccccattttctacagggtaaaacctcactaccaagttaagagaatcaaaccaatagtagttgcattgtgctcaatatatcttgtgtaggtgaatattccaatagtcccaacagccaaaattctcttttgtccaaaaaccatttatgataccctgttcgtaaatgatccagaagagtactaaaaagcgcatggatgctgttcctaaatgatacagaagggtactaaagttgcatgaatgctgttcctaaatgatctagaagggtactaaaagtgcatgaatgatgttcctaaatgatccagaatggtactaaatagcgcacagttcctaaatgattgagaagtgcttgaatgaagttaacataaatcaggaccaattgaaatgaaatcattccatctttgaaaaaacctgtcccaatataattggaatgcctagttacacaggtagcacatcaactgtgtattgaaagcaaagctaccttgctatgcagtatgcactttgttatattacaccatacacaaccatatgcattcatgtaattgctactgcaccatcgatacatggaaatgattatctactctcaagtcgcaacagtatacattaactcaacatatcatgcacaatctcatttgactctcagtgatggtgaacgattggtcatgtagaaaacctggtaactagttagttttttcctcgaaaaggtcggtaactattcaatactctttactttttttcttggcatctaacaattgagaggtatatctcacaaatgagaaacaatagccctcaaaacatctccattctatggaaggtgaatggaagtttcaagaggcaagaaagtgaaaagggtccaggaaacgttaaacaaggcattctagagcagccatttttagttttaattttgatatatcaactccatccatcaaatttatccctgctttccaggttggtcaatattaagccattactattagaaatcgctagctgtggtatgtggatacttatttagatttgctgtaacatagcagctgtactcgttactctagcgtcagaatctgcacacacctgcatattttacccacatatctaaatctactaccgagatatgaccacacgaaaaaccaagatttgattatttgacgaaaccgggtaggccaacgaattcacaggcacaaatcacagatcaaaacagattatagacgcagatctcacagcatccaccggataggggaaatcggattacctctctcgacgtaagccatggtcgcgccccccggatcgccctagcccaccctctgcgatggaaagaactacaatgataagattttcgctcgaggcgagaagaattaagaaggggaaaccgaagggagaaggggattcgcgaaccttcttccttgcgcgtggagagactagagaccggtgagagggtcgcgggccttgcgtcttttattggccattgactcgtagacccgaagttttcgttgaggtatggggcccaatgtgtcagtgacacgaattgttggcctgcatgccggtgaggaaagagcatcggcaggaagaaggtgccacgtcaattgtgcttttgtgagccgttggattaaggatgtgggttcgagatgaattcaaaaggtcaaataatcttccggctgtggcgctctcaagtctcacctttctatggtcaaataatgcattagatagagaagatagtataaggtttagggcttgttcactttgatgcccgttntaaccttactaaattttggtaaagttgtaaaaaaaaattgctacatttagtttgatgccaaattttagtaactatataagaaatcattaactatgccaaaattttgacaataacaaaatttggtaaggtttttttttggcatcaaagtgaacagacccttatagtatatggtggtcatcaattctaattttatccacgtcatctacttattaattaagagataacatatataatatattgcttttaatatacttactctgatatgctatactaatttttctctatttgttttcacttaatttattggtctcttctctcggattcctataagtttgtagttttgtgtagagattgtcctttcgtctcttcctctctttctctctctttctttctctattccatcttatcacatgatcctacatgacatcttatgcaaaagctaagagatccatagtaggttgagttcgggaggcaaacaaagaaagcgattagagcgatattaattatcagtctaaaaaagcttggaaaatggattaatatgatttttaaagcaatttttatatagaaaacttttgtaaaaaacatactttagcagtttgaaaagcgtgtgcgcaaaaaaagatgaaggtgggtaggaaaagaagggagaataacacagcataagcatgttttacccctcgactattaactcttgattaaggaacatggtaaaatttataccactaagttatcgaaaccatatataaatgacttttaagataatctccggttttttttaatatgaaacgtcattgatttttaagatatatttgaccattttcaaacctaagaggtggtttattttccctcaagagaacgcgccgttatttttttacgtcacctaaaaaacataattttttggaaaaaaatatatgaaaagacagatgaatatatgattttttttaaaaatacagattcaaactttacttacacaaatagaaacaaaaaacaataaatttgcttatgaatggtcaaattcattatttttatttgtacctatgtaagtcaaatttaaacttcatggtcattgatatatttataaaaaatagttttttagttgaattttaaagtaacaaaaaaaacaaagggacaaatagacttccctataacccaacgcatgctcaaccacagtaaatgttttagctaagacttagagttagttttcttgcaacatcgacacaccattgcctgtgtcttgtgatttttcctgcacgtttagaagggtggcatcgattgaacttctggacacttggagttcttccttcttcgtgatgcaccttttgctttacagcgctagcaatggccatggtcagggccctcagccctggccgggttcggttacatgcatcgtgatatgcttgttgacctgtgcatcttgcaccgtcatcccagcaatgcaaaacatgcaaatccccacttcgaaagcacaagattccttggctattccgaaccaacagaacacctactcccaaacaatcacgctgactcatgcaacctccatgcatcgaatatatattttcgctgcaaaggcattaagaatttaagttaagatcaccgtctccaccaattccgtctttcctctgcgtgcaaattccgtcttccctcgctcctgatctccatggaagagaagaagcagcagcagcagcgtccacagagagggcgcgatggcatcctgcagtatccgcaccttttcttcgcggcgctggcgctggccctgctcctcaccgacccgttccacctcggcccgctcgccggggtggactaccggccggtgaggcacgagctggcgccgtaccgcgaggtgatggcgcggtggccgcgggacaacggcagccggctcaggcacggcaggctggagttcgtcggagaggtgttcgggccggagtccatcgagttcgaccgccacggccgcggcccctacgccggcctcgccgacggccgcgtcgtgcggtggatgggggaggacgccgggtgggagacgttcgccgtcatgagccctgactggtaacgaacacctcgcctgcattttgctctcgccctccacgaaaacacctctcgtagcagtgtacaattacgtgttcttatattgcaaaaaaaggtcggagaaagtttgtgccaatggggtggagtcgacgacgaagaagcagcacgagatggagcgacggtgcggccggcctctcgggctgaggtttcacggcgagaccggcgagctctacgtcgccgacgcgtactacgggctcatgtccgtcggtccgaacggcggggtggcgacctctctcgcgagagaagtcggcgggagcccggtcaacttcgcgaacgacctcgacatccaccgcaacggctccgtgttcttcaccgacacgagcacgagatacaacagaaagtgtgcagctgcagtatcactctcttcagttgtatcgattctctatttccttctatcgttcaagattttctgattagaatcagttgtgcagggatcatctgaacgttctgctagaaggtgaaggcacagggaggctgctcagatatgacccagaaaccaaagctgcccatgtcgtgctgagcgggctggtcttcccgaatggcgtgcagatttctgacgaccagcagttcctcctcttctccgaaacaacaaactgcaggtgaaatggcacaagctttcacaggttctgaaaatactaaaggttagcaagattcagaattgattaacattgcacgcatatgctgttctaggataatgcggtactggctggaagggccaagagccgggcaggtggaggtgttcgccgacctgccggggttcccggacaacgtgcgactgagcagcggcggcggcggcggacggttctgggtggcgatcgactgctgcaggacggcggcgcaggaggtgttcgccaagcggccgtggctgcgaacgctctacttcaagctgcccctgacgatgcggacgctggggaagatggtcagcatgcggatgcacaccctcgtcgcgctcctcgacggcgaaggggacgtcgtcgaggtgctcgaggaccggggcggcgaggtgatgcggctggtgagcgaggtgagggaggtggggcgcaagctgtggatcggcaccgtggctcataaccacatcgccacgatcccttacccgttggaagagcagagtagcagcaacgtgcttggtgattgatactttgataggctggttttagcagcaacaaaggtgtactagttgatgtattgtttgtgtttgccgggccatcatagaaagtgcctggtgatctctgggacttgatggcaaatgttgggcaaattgtgatcgaataagattagtactagagttatcgtgtaataaggacatgcatggactaccatgtatttcatgttatgacgctcctaagagccacagaccacagcgatggtattagaccccttctcagaatggttctgctcattttcggcttcgatcgtggtacgcgttcgtgtcttcgtgtgatcggaaaaaaaatatttgccgtttacaagtgatagtttttcagtggatgtaatttgtgcgaaataccatcgtacaaacgttttgttctttttcatcatagtcattagcctttcatgaatagtactcacatttataaggccgatggtgttgtcctataaagaaaaaaaatgtaccagtaagtagggtggctaacgagccaactcggctcggctcgtaaaaactcgttaaattaacgagctagcttggctcgactcattaacataacaagtaaaaaactgaacttgactcgactcgttaaaaagtctgagttggctcattaaactcactaaactcgttgcaccaaaatacatgatttaaaattcatatacaatataatttgttggcctatgaccaaagattacgattgacatgttatgcatcatgactcataagattgtgctacaatggataattatgaatttacgacctttacacctgtaaatatatagacaattaacttctattttaatgcatcacgagctcaacgagctaaccgagtaagtcacgagctagctcgagttgactcattaagcaaatgagtaaaagtttaaactcaacctgagtcgagccgagttttacaacaagttgagttagctcatgagtttcgagtttttttccaccccgtcagattgaagtgagtaaattcctagaatgaacgttatttattgggaaaaaaagatactttactcaattgtaggaagaaatcggtttgaatagtagatgctatccagccacttttaaaaaacggatagcgtcgataggataattttgagatagttttggagataaaaaaaagaatacagtaaggctactattcaatgaaaatgaaaacaatcagaaacttaggatgataatttcctgaaacaaaaacctagcccatatcatctctaactttaggactatatttttagtccaatttttttttatttttggaaacatggtaacttggtaagtatagcttgtatagtactcctatgttaatatttactagtcgactggtaaggtataaaagaaggataaagcaatgtttgggctgaatccgcaacgaagtgggcttgggcccaaaaatagccgctactggtaaaaaccaaccgacctgagccgcaccgtgtacaaatcgagggaggagagggcacacaccgcatacgagcaggacagcacaggtcgagactcgagaggcggcgagaccgagcggggacgccatggatcgcgagtggggctccaagcccggcagcggcggcgccgcctccgcccagaatgaggccatcgaccggcgggagcgcctccgccgcctcgccctcgagaccatcgacctcgccaaggacccctacttcatgcgcaaccacctcggcaggtactgcctcccacccgctaaaaccctagctttcttcttcctcgattcggtttgctccctcgcgctaatcccgctcgatttcgtgtccagctacgagtgcaagctgtgcctgacgctgcacaacaacgaggggaactacctggctcacacgcaggggaagcggcaccagaccaacctcgccaagcgtgccgcccgcgaggccaaggacgcgcccgcgcagccccagcccaacaagagaaagttcgcgccccgcaagtccggtgagtaaaacatctcttctcgtctccttcccccaggattaacgtcctttggttataatgtgaatattagcactaaactgttgtgcattctggctttgtttggttctaccaagtatggctaaatcatattggtttgctctcagttgaaaaaaagatccaaaattatgtatgtagttggtagttagtgtctagcggcaaatttgtgtgggtgaattctgctaaatataatgaaaattgttcataaatgattgaatgatagaatcttttcttcaaatcaatctaccgatggaaggtcaaacagctaattaccaaattcagacgaggagatgacagtatgacaccttgaaaaagccttgaaaaatgaaaactcaccgtggacattcggttatgctaatcaattggagcctaagcatgaatatttggattagttctgaaaacttcatggagtatagcaatttctagtccagaatggtgttttactatacttaaagtttataggagctcataatttggcttaaaactgagtatggctcaattctcaaagatgaccagtttcttatctgaaccctttcatgttgtctgtatctttggggatagttatgctatctttaagtccagctatctggacatggtcgaatctgttggaagaatctaacacaaaatattttaattatctttccttccttttcagttaagattggaagacctgggtatcaggtgactaagcagtatgatcctgacatgaagcaacactcatttctttttgaggtcagtgttcattgcgtttacatttgtttggcacttgaatttaattcatacatgtttttacatgttaatattgtgaagtccagaacaaattagttcactttccaatactccatatatatagagataattttgtttatttttcttttcatgtcatgtaatgtagggcatcaaagttacatacttatggaaatgatctttttgtgactccagttaagttagctccttttttttttctccatatttaagttcattgcacagtttct

SEQ ID NO: 57625 - DNA, 3905 bp, Oryza sativa
aggatattttgtttttaaaatttatccttataacattagaacatgtatataattttgtacgctggggtgataacttttgatatttctcttttagattggttatcctgaaattgaagaaaacagcaagccaaggcaccgtttcatggcatcatatgaacaggtaaagcaatcaacctgcctgattgttcggttttcagtttgtggtatgttgctttgtttgttactcccatgtatcaacagtaacctaacagactgatgttttgtacagaaagtcgaatcttgggataaaaagtatcaatatctactttttgcagcagagccctatgaaattattggctttaaggtgtgtgttttgaatgttttgctgctaggatttcagatcaactggccattgtattttgctaacaatttttgctgttgcagataccaagcgcagagatcgacaagtcagcagataaattcttcaactattgggatccagacaagaaacagtacattgtgagtacaatatagtttttcattgttcataatttaggctatttagcctgccttcatagcaatcttggttctcaacttatcttcgtgttgtttgcaacagctccaactatacttcaaaacaagacaaccagaagctaataagccgcctgcggctcctgggactttgccaaatggatctggaggtccaccacgcccacccccaccgcaggttccgccacccccgccacaggctccgccgccgcctccaccaaatgcacctatgggtatgcccccaaggatcccacccccacctgttggtggtactcaacctccaccaccaccgcccccacttgcaaatggacctccacgatcaatcccacccccacctatgaccggtggtgcaatggctaacttcactcctggagcacctcctcgtcctccaatgcaaggatttcttgggccgcagcagtagatgacccaagcgacaacaactgaggtcgggctacaaatgttgcaatgattgcctagtttgctgtagaatgccttttgacccaaatttgtatgttgtcaaatacattatatatttacatgtactcttagactatagtattgtcgattttaagaaattttccaccttgatacttttgatacttctattcaaagcacttggtgtctattgcgcttgcgcacattgttcttgtattgtctgacgttgacggtgtgtgcccgtgagcaccgagctgggtgctatgcaattgcgcgaagcatacatacaacatcgataattcagtatgtaccgatcaggatctccttgatgggctgctttcatgcgaaattgctcttgctttggtcagttgatttcggtgaggaccatatagttgcgacccatgtttaacattcttttcatttattcatgctatcatgtacgctggataaacagtcgtatggaaactaccagaggaaatgccaacagaggcaagaatgaccaattgaaacatcagatgatcagatcagtttggcaatgtgccaaatacatccctcaagcttattgccttccttgcacttgcctgtcattcaagaggtagcaacaaaaaccccttgaatgtgaatttcctactgctaaatcttaaaattgtgttcaaattcgctcaacaggtcatctcctacgttcccgctctcatgaaaatcagagcaactgcctgccatcatctactccgattaagggtagtagctcagcacaacatttacgcgatgtggtcaactccgcttttcatgatccacctggcgcaaatcggtggcagcaggactaggaatgaatccaccagatgttggcctggagattgaattcacaaacgcttatgattcataaataactggtaggcatcacaatacaaaaatcgaactgtccatgatgtacttacagtccaacaaagactttaaatgcatcatatgttgcccattgagctccagtaagagtaccaaccataataatacggagtggaaggccacgagtgagaaggccccacactcctagagttcttacagcctgaaagtgcaatgcattggtcagaaatagttaaacaaaatcagtagaacattacttgacagtaggtgtaagaactttttttttatatgaaagtcactgagagggctagcagcttacatcagccatagtgcccccctttgcattgttgaggaaagacaccaggttgtctgcaggatgagagatagctgcacagaagactcctgcaatatatccccctgcaaagctcactgctagctggagtggcttactgcattcatcttttggctttggaactgcatgcttatatactaattcaacaattgtctcaaagcaagcaaatttcaccatagtatctggaaattgaaagtagtttagacacaagtgagaataacaacctaaaaggaaacggcataagaattgctggcatctgtacgggacttagtagcatcttacattttaaaagatgtggtcctatctgcaatttacactacattttattaattctagtttaccttaatcttgttttaggtaaatccttgtttgtttcatgtaccagatcctggataaaaccaagtttcctcgaaactggaaaaatcgtattttctcaggaacgactccacaatgtttttggtgcccagccaaacaagattttacatatatctagattctggaataacggaattaaaagtcgaattaaaagtcgtttcccccctaaaaacctgcttttattttcctcattaaaacaaccactaaaagttagtaagtgcattgccttgatttattttttttaaaaaaatggtatggcagatatctaattatctatgcttttgaaactttgggtggtattgaagtgcatcggtaactttgagtggtatatttctaaagtgggcatatttcgatatcaacaaaccaattccccataaacgtgttggaagattatctcctctcccaccttttatcatcctgacaaattgatgttaaattttccatccatttttttttccaagaatagcaaactaagaagctgagcaaaacaaatgaggtatctagtatacatagcttaaagctacagcaaccatttgattgttttcagttttgacaactacagctgatcttgacttctacttagggtgcaatgaattaaattcgtagtgtaaatttcgagggatgccctgaagttgttaccgtgataatagttacaattgacaatttttccatagagtagccacataagtaagaaaatataatatagtttgttcgagaaagtgcaacagactatgtcttgcagcattattaggagagcagactactaaaatactaactctcaaaaaagagttataaaatagtgccagctaaagttattcttctgtcagaaaatagcaacgatgagtggcactcattcagtagaatgggcaatttggtatgttagaatagtatcaatctgtcaacgatggctctttgtgagcatgcgacttcaagacttctcttcatggtcaacgctcgtggcacataatgttattgcacacaaaatctaatatcctttcagtaggaacatgagcaaaaacagtaactcaccagaggattttgctatagcccttgctgtcaaatgttagttgctactatggaccttttatttgccccattactatggacctatggtctacattatgcagttaaaaacctgacatgcaaatataatactctagtgaaagataactgctaacgagacatttgacttacaaggaacttggcgaccccagagaggaagtagtcctttataaagcctgaaattcgcacattgtattataggatgtccccaaataaactttgaacagaagtcacaattgtatacaagaaatgcagtatctatacccaaaggcaccttcagattggacaatcttcg

SEQ ID NO: 57626 - DNA, 12697 bp, Oryza sativa
ggggagaagggccgccgcgtctcgccgaacgcgcgcgcgcgccggcgtccgctcgcgaagccgaagcggcgtgaggaccgtagcagccgagtgcggcgtgcgtgacgaggggggcgcgccgccgctcgctcgctgacgctgagccgctgtgctccgcgcggcggcggcttggctgtttttttttcctttttccgttttctgtgggctgaggtctgacgaggcgacgccgcgagattcgggtgcggaattgcggatgtggtgggcgcggacgcgggacaggaagcccacggcctcctctgggcgttgcgcacgagctgtgcagtgcctgtggtgagctcgttggcacattcgaggctgggattttccgccgagaggaaaaaggtgcggtggaaacgagatgggaagcgagatgtgcgaggattatctggttatctccgtggttttgacatgtttgttttgcaacgcaccaacgcctctgcgtgcccggcactccccgaacgatgcatcagaagtccagaaccgacgtgcaacccgtgcgaatcacgtgatgatgggcctgttgggaaaatttaactattggctatttattggagtacatctttagcagaaacaccactcaaaatcttgtaattttagatagttggattgcttggggattcatacatgtatccatatcctaatccctttctcttttttttttccttttccttcagcaccgcatgcttgaaccgacacttatttgatgcgcaggcctaccccgttgtcctcctcaagacatcaacgacgaggtcccctacccagccatttttctcgtctcaagtggttcctcactgtcgaatccgctaccactggtcaccacttcctaactcgtcgctctgctttacccctgccacctgcaacacaggcccaccgccgcctaccgtccacgcgctttggcagcaccgatgccctagccgcccacccattcctctgcccaatgttgggcaccatctcccatggaccatggtcatccctctaagccctgcgaggcggtgacctcccacttttcttccatccctcatccccaactcatgaccttaatttgtaggtcctccatttggagtttggtggtgttgtcggaaccagaggagaagaggaagtcaccagagttggatgagacacacccggagcattaatcgtgaagaacatcccttagcccaaaatctacaagatttgaggatggattttttgtcaacagaaggttagcaatgcagtttaactatttgtcactctttaaatgacagacttgctattcttcctaatcttttgtcactgaagggaagtgaaatgtccatttttcccaaaccttgtctttcatccctcttctcgctgggattaggaacggtggtgacaattaagggcaatctagcattttttatctctctccttaatttatttaacaatcttcatgagtagttatattttgggccagagagagtatatttgtcagtgacccaataactgcggtctcaggcaatcgacgtgcaccaggaacgtgccacgtatctcttcatttggcctgttatccgtacaggagattgatgtggagtggcacgtggtctatcccaggataagaagaatgcaccacttagggcacctcgaggacaatccttagacagaggctgaacaacaggtttaggctggcactgggtcccatttatgctttatgggacggttatctaccatggagcagaaagcatgaagatagggcggcaactgcagcaactgccactcgtcgcttcaactaacgcttcaactgtgttggtcctgacacgggcatggataatcggagggcatagttgactacagtgtcctcactaggacccactcaagtttctgcctctcactaggtaatgaaaggcggactccgcacctaccggggcacaacgaaccctattcaccacatgtttggtggattgaatgggagcatgtggcaagttgtcgtcgtgccccgcatgaagaaggccccgctcaagacggacctgaggccctagtggattaggcaggttagcatggcaaactctcaccaatttgccatgccccgcttacagtgggccccactaaggcctaacctgcggctgatggagcaagagagaaaatgaactattgatgagacaaccataccttacgttgatacgaataaaatcttccctcgaagtgtggttatgtggtgtccctgagagaaagtataagggaagagcgaggaccaaaggagggggtgggatgttgggtaactgaggagagacttcaacacattgagtcaaattcttaggaaacccataagagaaaggaagataatctatttgagtagtcgataaacttgtaagatccttcaaggacgaacgagaaaccaccacaacaagagtagcatgttacacctctagggtatcccaaacctgtatacgtctttgtgttaatctattctagcgctctagaggagctcaagcccctcactctcacatgactagctctctagtcaaactcacagagggtcctaccggatccatgctatcgaggtccatccacagacaataatattgctttccaatcaagacacaagcatctccctaaggtgttttatcttcgattattgttgttgagtttactaattgattgcccccttctctctctcttatagtgcctatgtagctttcccgactccagctttgatggctctcgtagtctctgctcgttggcttatcaacaagaacaaaaatttgaattgtgaaacaaaagttttggaatttttcgtctagtcaatttttcaacgtcggtttttaaactggtaatgatatcggtctaaaagttttatctataaattatttttgattggtttgtttatttttcaggtttatcagctgtagcccaaccaattagaaagtgccattttgtttacatggtggttgtatttttaacaagagtactgctatacgtatgacccagttgtacaactcatatacaaatagaaacatgtaaccatagattgatcaaataaagcatattcatatgcattgcaaccatttataaacgtttatcaaattcagtcgtacgtgagtcggataattgggttgtatgcatgcaatttccttttaacaaagtcaatatgctggcaacaatttacgattaacttttaccgttgataagcaagcacaatagtgcactcctacgtagaaatttttgtgcaacatcaaatgctaaccaatctctcgaatgagaacgaccaacacacacgtactaagagttagcaactctcaacgtcttgcgagtgacagttttgacacaccaacggaactcaacttacacgggagctacattttttttacgtctgaattctgcgatcacatccaatccaaagctaagctagatggcgactcaaactagcgcgtaagctggctcgacaaggaacgaatcaatatagtcaaactccgtccgcgcgaagccaccggtggccaccggcgccatcccgacgacgggctggcacaccccctccggcggcgacgacggcaccggcagcggcggcggcgcccacacggacgccgacatcagccgccgggccttccacccgagcacgatcttgttgggacccgtctcctccaccgtgtacccgtcgttgaacaggccgagcagcagcctcgcctggctgtggttgaagcagctgagcggcacggcggtgaacccgctcccgcgcatccactgcccccacccgcacctcccctcgccgtcgacgccgcggtacgcgcggctcacggcgccggcgatgttgggggcgaggatgacgcgctccacgaggccgcgcacccggctctgcgtcgggaacccggcctcgagagagtcccacaccgcggagtagcggtgcagctcctccatgaactgccgcacgaagccgcccgccgcggcgtcgccggccgagtcgccgtcgtcgtccttctcggcttcgccttcctcctcgaccaccgtgaccagcttggcaccgagcgcggccatgccggacaggaatgacgccaccgagccggtggggcgtctgatggtggtggtggccgcggcttggtggaggacgcagttggcgacgagcgcctcccccttgaccatccggaccgtcgccggccggaacctctcgtcggagtccaggcggcactgtccgaaagagaagggttgcccgatggacgccgcgaacgctgacaggcggcggccggcctcctggacggcccgggcgccgccgcctccgctgcgggagacggcggtgatgcgcaggtgcggcgccggcacgccgtcggcgcgggaggtcatggcctgcatcagcgacgcccactggatcccctcggcgatgtcgtagtcgacaatgtgcacgcgccggtcgccggacaccgcctcgaggatcgcctggttcgcggtgaagtggccgaacttcatgtacggcgacatgtcctgcagcatctggaacgccgtcagcacgtcgccggcgtggtggtgcgacgccgcggcggccgcctgccggccggaccctccgacggggtgggagccgtcgaggagcccctggagcgcgtcggtgaagtgcgcggcgaggcgctccatgttggacgcggcggcgttggcgctggcggtgtgtgagaccatctccttgagccgaaccaatatcacccgggccagctcccggctcttgtgcgggccggagagcgcctcggcggccgccatgagcaggtggagcagccggaggcccttctcggggcagccctgcgtcgggtcgtcgaacaccggcgagccagggttcgtggtggtggtgctgctcgggttggagccattgccgtagcagtaaaggtcgtcgcggaacatatccgcgtggtggaggccagcttggccgtcgtcgtcgacgccgacgagcgtgtcgtcgcagagcatggactcgatgaggccgtgcaggtcgtggccgccgtcgtcgtcggagcagcagaagttggcccagtcggcgaccggggacagctcgccccacgcgtagcacatccccgtgccgtcgtcgagggaggacgcggaggaggtggtggtggtggagccgcagccggagaactcgaagtccccggccacgtcctccatggtcacctccatggccgtacccgtactctcctaccacgcgtcgtgcgtgtgtgctcctcctctgtttttggtttgccggcaaatgttttggcgcgagagggaacaacaggggaagcagagatagttgccaattgccaagtacgagtgggcacctagcgggttatttatacagggaggcttgagccgttcttggcactggccccgcgccggaacggcactgtgctagctgaaagggaattaagccggcacaggtagactggtagcaagagcaagtttaatcctatagccaactattagcttcaaatcatctatagttaatttaatagctaattaatacaatagttatctataaatatatactacacaatcaatatctagccccacctgttatacacacatgtgttttggaatccgtactatagctgactacaaatctatagtccgctgctcttatctcttctcttttatttttttaataaaatatatttatagttggcttatagtctgctattgtacctactctaaggcattcttttctgatgatacatattttactttagtttctgttagcatgtttttcaatatgctaaacaatatatttagtggataaagtttttatatataagttactttaaaatattagataaatcatttttttcaaatttaaaataattaaaagtcaattaattatgttctaatgtctttctcattttggatgcttgtatttagtttccaacttcattagttgtgaacacaagtatagcaaacacggggagagagaaatcggggctaaaatattgcgtagggtttatgggctttgtttttcttgttaaaccgtacaaatcggcgatgtttgtatgtttcaccagagtaattgagtagaacacgtaggtttctcagtagatggatgaaacaatgcgtttgactgtatcatcgccactcttttaacttggtggatatattaccaggttagtaaatgatctgagcttcaacagaagtatcaaaacaatttggaaatctattgtagttcttgtttttcacaatgtcagttgtctctttaaggataaaattaataatcctagataagttgatccatgagagggacatctcatgaaggcagctggccaagaattcatgcaccttttactaactgagctggtcacagttccttctcaatgtttctgtgtgctacttcctccctcccaatactggcaacttacattgacagccccatattttcgcttatgcttatatttatcagctaaaatttaaattttcaatcttaaatttggatttgattttgaagttttctcatcgaattttattttccagcctttgattttaaatcgctaagaacacgtatataaaagttttattcataaattattatttttttgtaaataagccgtttggcttattttggagctttgagtatgttcaagagctttgagtatattctaattcgtactcataggatgagtcttacttatcacatcctagattgctataggagggataaccattctgtcaacatcggactgttcgtgcggtttagccaggttttggcatcactatgcattaatttattagtttttacgttgtttttgttccttccatgataccctctcgttcttgtctttaatgttggacagaagcaatggcttgtctcacatggtttttggttgcatctgtgcagtggtgagttgtaggttacaattgaaccaagaagattctcccaaccaaacttgagtagtgaagctttgtaagtgagcactaatttgttcctagtcacgtctcacctgatggatggaatattaaggataacacattaacttgatgagccaactaaataaacataagttagacttttcaaaaaataaattgagggaaataagtggatcattgaaaatctctaaaaatatatggttttattattacgcttttttctctttcctatcaaagtttgccaacagcctatcccattttcaaacatagctgtggactgttttcatatatgtacctattgtatgaagtatgagcttatggtttccttatgtttagcatgtagtaataggatatactagcagtgtgtgtttacgtgcatttctcatgtaatcgaaagaagagagaaggttgctatatataaatgctgatggatttttttaaccatttcaaaatattattctactaaccatcttctttttttttctttcttagacgtggtatgttcaaggaatcaaggttgaatttcctccattattattaggtgttaattccatccaatcataaatatttgagttttgggcaatatttgatcaaattttaaggttttgacaatttgtgcaaaatctttcacctgcgctcttcatttttttttttactcttaattaacactgagcccttcacctttccggaggaaacagatactctcttgtgtttgcattcggctaacttcaatttgacaacttgacctccaacttgctggggccatggaacactttcttattatggcatactaatcactaaatactactcactcgtaagcaattattgatgtgtctctgcactaattttttttgtttcccaagcaacttgcccaagacaattggagcatgcaaatctacctagagcataccgccctccatgttggcatatcatatgttttttcacttgccatcacccatacttaatttggaatgatctatctagtacaataatatgccaaaacaccaagtaactaacttaatacttgaattccatggatcatgggaaagagccaagtactggccggcagtctagctagtaattagccactggcacctctccacgaagccaaatctgaaaaacgagatgaaaaaaaattctctgccattaactcgaccctactgacatgtggctacctccatgcatggccagagccgcatgagaggccagtggttaaacggcaaattgctccggccgtcgccgtccgtactcacgacgacgaccgagtacacacctaggccatcgaccgacacacctacgttgaaaaaaaaaagataatgatttttagtccctaacatatactatgacaaggcggcaggatagcttagcttgagtgcagcaagaactgatgagataaaaattttacgtttcctgcagagctcacggtatcacttggcaatcctcgtatggcgattggctcgccggccggcgacagcgaccggccgccggcgagacgtactggtcgggagcgagtcccccttctacggaagctagcaattattgcgagcgagtgatcgatcggctcgccgaaaagcgtgacgctgtcctgttgcggttgcttcggtcgccgatgcaactgtgaattgttaacctgcagctggttggcaatcagtaaagaaatgcccggtgttcttggccgcttctactcgtctgactaagctcctgaaacaaatctatttaatttgatgatgttaactggttttatgatagtcttcctgtggccgcttatttgaccgtcgtcttgtggggtgtaggactaaattagaatttcccagtgaaccgatcagcaaaccattggagattttttttttcctgaagaaaatgtatcggctggtgctatctgaagctctgaactggctgactatggtcagtgttgctaaaggctaggggtagaaatgtgccgagagagatggccaacagtaacttgtactctctaacatataaatagcacacaatctcaacttaaatgtagcttacttataggcaacttgtgttagcacccatcaggttgcttagctttgttgccaaggccggcgctgaaagtcaaaacttttcaatattagagcgtggagttaccattttctcatatttctatgaaccatttggaaaaaaaaaaagtgaaacaggattggcctttgatggtgtccaaatggcttccacagagctgattggctggtgcaatgagcttctagctctaatgattttagatacatggaaatttccaaaagagaagtactcaggaaaatccaaaggaacctattgtattgtataattataaagatctcctatggaatgaaggaatttagaggatttccggaaaaattgaactaattcatgtacaatcctgtattttaaaagagcctaagaaatggcaaaaaagacttgtcatatttgttataaaaacacagaaattatcatgttaattagagaaaaaaagaaaataaactcaccatttgatcgtggtggacctagattataatggtgtaactagaccgatatagttatggacaaaatgtaattgtatttatgaacggaatatgtaatttaattctacattataaactagctctgcacaaaagtgggtaaaaaaaccgctagttagagcagtatctccttgtcatcatgaatttctatagttaaacaagtcgttttatggtcgatttaataaactccatattgctgttgctgagttgctccatacattgttgagatcactattaactattcaatcctttatgttttcttaaacaaaaaaccggatagagtccccaaactacttgatttgaagaacaaggcatgttacagttcataagtcataaccctgccacttgcccagttggctcgagacccagttccacttccagctcggtcggccaacctgacggcactacaataacaagaaaagttttcagatagctcccagttcacaaacatgcatgatcgcccacgctgctgaactgctgaagactgaacccttcttctgtctcttctgaacaatgcatcccaaaaccccggtatattcctagtataaactttaggcatatgcttaggcataacctccttattacatcaccctttgttgcttcccgtaatgcaatatatacgcactaacaacccagctaattctcttgtacgactgcaataaagtggggttttgtcgtggcctggatgtttaagttaatcaaagaatcaaatggtgataacgttaacatgctggacggtgccatcatcacaaggttagttattcgcatgaagtacacatccagccgcagataaaatgttttcttttcaagttctagtgatgttgcgtgatggccgatggttcagtaagcaagctgcatgattggttgtggtttggggaagcgacctagcaaaacaatgggctctgtctgatttactcaacatctttattatattcgctaagtcttagggcatgctcaatgtatattactcaagtacttcctccgtcctaaaaaaccaaccttagcatagataaaacatagaataacgaatttggacatgttgtcctaggaagtgtcccatccatactaagattgacttttttttgggacaaaaagagtagatagtaaggtgggtcccatgatcaggaggcagtaagatgtaacacttcttacaaagcttatatggagtatagtggtaaacaaggtagggtccacttaaaaaatattcatccatcccaaccctcctttaccttggtccagtaagaatcttcatattttatttggttgttgccggcaatagcgcaaacaccaggtagtaactactacctcttcccacaatgattactagtttaatactgggtagtaagcttgcattaaatgcttgttatctggtttttttttccacattgtagttgctttaaagcatagctatttctgcctcgaaaaaaattacagggttttcaacggagattaagaagaaatataaaattgctagattatccttcattgactgttttgattggtaattaagtggggttttggggatgagggtattttggacattcataactaaatccccccccccctcccccaaaaccacatttttgaattgtacaactaaataccccttggtactttagaaatagatgttttttatatataaaattaagatgttattagaactagctatattttagaacgagggaatatctctcaagtctcgacctatggggtttagcatgtgtagcttcctcggttctatctattgtccagtattgcttgcatcttccttagattccaatttgcagagctgattcaaacaatgttagagcctagaagcatgatcagaaacggcaccaactgttctctacacgtgtctcatacctaaaaattgaatgcaggattcagacattggcatgccttccactactgattagtgattactggacacaaaggcagctaagatggccagttttgataaggccataaacagtacccttgatctggttctactcatcttaaacttcttcctggtcaaagtacagagcctatgaacacacatttcacaaatctggacggttttccgaacggaatctcaacgttgatatcatgcaatgtagtacaaggcctcattagtttagacattaggtttggtctggggccctaatcaccaatcatggacctgtttttaatccctccatcatcaatagttggaagcaatgtatattgtattgtatatttgtattatattgggaagagttcttggactttcctgcagcagcatgcgcaacaagctcgtcaccaaaaagtgcccgagtgtctgtactcaaaactcttctggagctatagcccgtcttcattcattaggttttggtttaggtctccatcacgacgaaaatggtggttgtagttggaaccttggaagccaattaagaagcaaagcacttaatgtttaaactagctgacttgaagcagctggaaagatgccattgattaccagcttacaacaatactccctctagtttacaaatatttatctttttttttaaaaaaagacggttttaaaaaattaatttgaccaatatttttatgataatatataaaattatcaataatacattattttattgaagtgttttttaagattaaatatacttatggtctctatgtttctcgagtagatattaaaaaatcgttcatagtccaaagtctaaaagtttaatataagtcttatccaaacgataagtgtttacaaactagagtgagtagcatattagaagaactttattttgcataagaaaggaactccaggtttcagagtccatagaagtactaggagtacaagtatggcaatggcaggtttaaggtcaagccggtcagattaatgtttctgatgattccttctagaaacttaagtacaactctcatctggactgaaaaatatgaatagatgcttgctagatctgagaaattcgaaaagaaatcaattgcaacttacccattggaagcatttcggttttcagatttttttttctgcgttgcatttcatctaccataagatgcttccttcagaatgtttgcaccaaagcgactgcatttataacaccaggcaatgtgtttcacaactcacaaagttggtggaagatgcatagtcccatcaagtgttttctctaaggaagccacaaatgacgcaatagttttccaaacccaaagctattaggcacaaggagttcaagcaagcagtaccatcagaaagcattttaagaatcaaaccacatttataatgatcttaaacaatgtgaagccaagtagcataccagtacaacgccacgaacagtaaaaaa

SEQ ID NO: 57627 - DNA, 6953 bp, Oryza sativa
gtatgtttcgatttatgacacaagagattcttgctcgtcagcagtttaataaatggtatattatataaccaaagacaggccattgagtctggctagctccaatagttgagcaggagtagttggaaatttgtagccactacactgctgatgttgcatgctgcttcgtgaggaaacaagcatatgttaatggcaagttaaattgttttaagcctcacttgacgacatgccaacaaccctgtgctcgtcctccaactaacatcaagctacatgggagcgtttcttaatttcttaacatgaccagtacaattcataatataattcaaatttcccggtccgatttaaaagtgccaagataccaaactcctttgatcttttccctgttcacatcgtgccaggcagcatggtaagatgcgatcacacgtgtagacacagtgaagcagaaacacagtttttggccatgtgccatatgtttagctatgctcagctgagatttttttttttttagataatatgctcagttgagatagaatcgaaatttctgagttgtttattgagagcacttcagtacttcagcataatttggtgggttaacaggtttgtaatatcattgccagcgacgaacgcaagactaaaatttaagggtaccaataacgatatgatgaattttttttaaaaaaaaatgagataaacccaatctctatattcaactagatgatggaaataatgcaaacataatataaactggggcactaaatataagtcaaaaaaaatataagacaaatataaaatacattcataaatataatatccaagtctctatttgtaaaatcaatataaacattttatctatagaattgaagagtttacactgggccattgtcttgtagaaagtcatcataacggcctccagttcctttttttacagagagatcagagatgcctctacaagttttggaaaaagttcacttgaggccatttttcttgtcgtcgagtttcaaaatcgtccctgaatctgaataccatatataactcttgcaaaactaggtcacattagatcccaaggcagtattgctctcaattctggttgacgtggcggttgagtcagcgtggaatccatgtggaccccacatgtcagcaccttattcttcttccaccttgatcccctctcttcccactcaatccaagcgtccagggtggccgatgatgggcggggagaaccaagaagggtggcggctggtggtagcgctcgctagtgaagacaccacggggccacgtgtatctcgcactggatcttggcctctagtgctttccactcgaggcgctggatgtcaccgatgctgagccgctcgacctgcacacatcctgtgacatcctggcccggggcttaatagaattaataaaatactcatacaaacaagttgcaacttcttttacaaaagccaatctccaaagaactctaaggctaaacgtgcttggcctggagcaatttcgggatgggtgaccgaccgggaaattcttccctggtgcacacgagtgaggaagtgtgcaaaaaatacttgtgttggtctgtgagggcagtctatgtccaagaaaaactgtcagatgtaagtgggcatggcctgggagaggatgccgaggcgacgggaatgacagcgagggatgcgacagcctggacacatagatcgagcagttgatacggtgtcgcccgctagctaagcaagaggccccgatctatggcgtccatggctactccagcctcacgggcaacttcttcgagcgccgcattgttgcccgccgccatacccaccaactagtttgtcgttgccgcgcacctcttcgccgtgccgcagacctgcttcgccgcaccccgcccctgttgttgtgtcaacggcgcctccaggaccacagggcgcctccgccttatgggcatcgatggcctctttgactctttggcctcgtccattagcattcgccaaccgctccgcgagctctcgcgctccctcccggacatgctgctagtgtccacgtcgtcggtgagggcgcggtgctgctgatgtgggacgtcgtcgaccacccgctcccgcctcatcgtcgcaggcctcctccactcccggcctcatccgctcccgccatggctacctctcttcgcatcagggaggggagagaaacagagggagaaggaggagagtttgtgtcattggcatatggggtccatcaacttttatttattttttagactgaaataccctgacatgtggttcccacactgacgatgaatcacctaaaaccaggagcaatattgccttggaacccagtgtgatctaattttataatattattatatccgatattttgattcaggaacaattttgaaactcatcgacaaaccaagagacctcaagcgaaccacaagtttccatttttcattgtcaaaacttctgacggaggtaagcaggtcgtcggggcaccaggccagcaggcctctcatagtagcgaccaaagacgtgcgtggctgaattgggcctttgcggtgcgcttacgctacaaggcctatatgacatccgcctgtcaaaaagcccaccccatctcaaggcccatttcaaagttggcacgcgagtccccgcgccgcgagacgagtcgcggccgcgcgccttcccttccccctgcagcagatggagcaccacgctgcacgcggcacgcctgcctctttccccacgtaggcggtagtcagagtccgcacggtgtgtagcgtggtcgccactcggcgccaccgcaaaagaggcgcaggccacttggcccagcccagcgatgggattttacagctccttggacgcgtaggcttttccaggatcgccaaattaagatgtctcttcttctggtcaaatctgactcatctcagctgttggacatcccctagctagctcccaaaaagaaagcctactactggacatccaaaatccagccactgctggtttggtctctctggggtgatcgagcttgtagtaggctgcacctgcacttgcattgcagccagccatgggcacatgctaaagcttgatctagatggcttcctttggggaaagccggaaagacaaaaggagatgagatgaagctgaaactgaacccattaagggtgtgttggctgctccttgttgggaacactctttataggtatagaaaacagagtagttcattaacacatgattaattaagtattagctatttatttttttcaaaaatggatcaatatgattttttaaacaactttcgtatagaaactttttgtaaaaaaaagcaccgtttagttgtttaaaaagcgtgcacgcggaaaacgagggagatgagttggaaaaactgtgataagaacgcagcctaaaaggccggtatactcgatcgatgctgcacttggcctgtctgcttccttccgtgccaagccatggacggatgacgggaactaactatagctaaaggctagcccatcaccgtatgcatgtgcaaacgtggtggaaaaggaatttttagccatctgttttgctgttgctgctatatatttcgtcctttttttctctctctctccgtgtacagaaacacacgtaatggagcccactggtatgtgttttctgatattaattctttttcctgagatgatgatgggagaattaaagctggaaaacaaaactgattggcacccagtgatccagaaataaaagggggagcttttcaatttcagcttcactttgggtatggtgttgaggtgtcttttgattattctccgcttaatcaatcaatataacggacagttttcctgttcattcagaaaaaacaaatatcagcttcagtgcatggcagtcatacagaaactcataaggagaatcaaattgactgtttgagatgcatattctattccgattttcgttagcacgctttttaaacgtctaaccggtgtatttcgtgtaaaataataaataaatctattttatgtagaagttactctaaaatattaaattctaaaatattaaataaatccacttttcaagtttataataattaaaattcaattaatcatatattaatggctttctcattttatgtatccttgcttaatcttaatttttcacctaagtcaaacggggcttacagtaaatggaaagatggaaagaatggtgaaacccaccagcaacgtacgtatataaaagaagaatgatagctgctgctagctgcaaacacacactagtattttgtttgttttgaggttaatgtatcttgagagcaagtttaatagtatcgtttgttgatgggctgaaaatttatacacgtaagtaatagatggtactaatagatgatacgtataataactacctgctaagttacctacccacacatccctaagcagttgatttttattttttaatgagacttgtttccttctacccaatctttgatgtagcaatggttaagtcattgagcaaaagctaggactaagggctggttctcaggacttgcatcgtttcctgtgatggagctcggcgattgcattagcgcccgctgccttctctcttcggttttctctctcttccacctatgatttctatgacgtggatgcttgtgtcgtcagcttatcgtactctattatacctgcgctgatagtactcactgctcaagtcttcttccgttaaaagagcttacctcaaattccgctcaaattaatgtacgcacgaagtggctggagaagtctacaagtaccaaccagtagctagtggccttgataggcaatcaatcaaaatacaggcttcatggtgtgtactacggctgtgtttagatctaaagtttggatccaaacttcagtcattttccatcacatcaacctgtcatacacacataactttttagtcacatcatctctaatttaaccaaaatccaaactttacgctgaactaaacatagcctactatgatatatatgactcgctcgctcgacgttgtatgagtatggtgtgtgcacgtatacatcttcagtactgtatgtagtccagaaaagtcgatgccatatagcggttgatgcacggggagggagagggtagtggttacccccacgttttctgaagcgatctcgcagtatcagtttttggcactatatatatactccatccgtttcaaaatgtttgacaccgttgattttttagcacgtgtttgaccgttcgtcttatttaaaaaagaattgtgaaatatataaaactatatatgtacatgaaagtatatttaacacgaaaatatataaaactatatatgaaaataataaataattacttaaattttttgaataaaacgaatggtcaaacacgtactaaaaagtcaacggtgtcaaacattttgaaacggagggagtatatattacccacaaaaaccttacatcagtttttattttctggaactcaaaaccttggatcgattgatgcgccctgcccctgcaaatgccaccacatgattgaacatgagacgatgcctaatagggaatattaagtggcccattatcgtcctgatcacttgccgtgggtgcagagcttacctctgcagtattgctcgatctcgcggtctctttacaccgagatatgtattttaatctgctactactaatctagaggcaatcgatcgatcatcgccgtgtcatcagctaggtattgttgcgcgctactctctcttgggtcccgctgatcatgtgaattctctcccggatttgctaattcgttgcttgggtgagacgactgatgaaacacttttgtgggtcgcttttactgaattttatatggttgtgcatgctttcatcaggtgatgatcaatcatgtcagtgatacgtacaggacaatacattactatgggctagatttgttgaacaatacattactgtatgggctagattggtcaactgagatggaggttaatgttaattacttgttctactgcagttaattaatggatatgctcataataaaacggtattactggtacattcttcgtgaaatggaaagcaaacacggtagtaactttttctatgctttccttgttagtactagtttctgatttcacgagcgcggcagccaaatctttcagatggttttatatatgcttttcccctgcatctccattattagttttccgacagcatcaggcaggttcggcagcccgtgcatgcttgtggaagtcccatttctctcgcgacaattagcgctgcaacctctgaaacttcgtcaggcaggcaggcagctcccgttctcccatgccatcgccatgatctatctccattctccagctagcttctcatgtagtaataagccgatggcaaattcgtccaatcgatcggcaatacaacgagtacgtcgaagaggagccaagtagtcagtaacagttaaagaccccgagctcttcttagtacaagtacgtacattggatacattagagttcgagagtacgagctagaaattctagtacaggtacagatttgtccgagctggtgtgcgatctagccagccttgtccgtttgaaaaatcctttgaaaatttcggcaaatccttacgaagcgagaacactacaagggtagtggtagtactcccgctttgttaaagcgagcgcgtccaaatggaaaggcgagcgatagagatagatagcttgggtttgggttggctctaactcgaaaccctttccacacgacgacgtgctcctgccctttgcgtgcgctgggactcaactcgagtgatcggctgatcgcccgctataaataacccgcggctttgcttacgcgacactactggagttagcgagcactgcgcactgagcacctcgacacggcgcgcgcgcggccatggtgaagaacacgagcaacaagtgcattgctgctgccggcgcgacggcggcggccggcttaggcggtggcgcggcgtcgtgcagcggcggcggagg

SEQ ID NO: 57628 - DNA, 16185 bp, Oryza sativa
acgagtgaagggttgatgattctcaacctgttcacacggccggttgcctcttttactgtttcattgcttaatatcaaattttctatagaaatttttcgtaccttccaggttaagacagtaaaatgtatcgtattaacagattagcctaaggtttttaaccaatggtcgagtagtccttgtttaagcttataagcattagacttcgcacgtcggcaagttttcaaacaaagcatatagaaagtacgcgtgtcctctttaaatcgagtggtgaatgggttgactccacagcagcgcaaatcgggaccatagacagtagctaaaccatgcatgttctggacaactcatcctgcgacgcagggccaacacgtatgtagccttttaatcttattattacaaactatgaaaattgggttgcccctgagcatcgcctttcgaatttccttttctgaaaaaagaaaaatttggaaacaaaaacaaaactttgcaagaagaagaattgatagaaatctttttgtagatctcaatcgcttttgtcatagatgtatcattgaataggtatactatactactgacgtgaatcgatgaatcgacagggaaggaatagttccctgaaattatgtccatttaaaccaaacaaatgaagttgaggtgctcaaaacaccggtgataactaatctgtagaagacgaacatcggtatgcactagtactagcagctaaagacaacaactagaagacgatcaaattatgtttcatgccattttctcttggatctaatttcacatatggatattttaatttgaactacaaaagtaaaatggtttaccaaaatggtattaaccgcaaaatcaaacttgaagagtccataaccaaaggatcaatgaacgaacgtcgggacaaggagctttgcttcagcagaatgaatcttgatcttcctcgacgctgatataagagaatctctatattctagtttccagggacttgaatctctatattctagtttccagcatttacattttgtggcttcaggagcacagcaatgcacccacttctctgtaaccagttgtcaccccttgatatataagagaatgacccgccgttgacaacgttttccctgtatttcgacggccaaccatacttgaccaacaactcatgcatgttcaggttgatctgatgcttcatcctgctgtgccttctgataacttgggtcaaccgcagtttgttgggtacccgtgttgtctacttctgaataaagagtatcattttttatgtcatcactggttttgctgcttccttcgctgaaatttactgcattcttcacatttttaggctcctcagattccacaagatcagaaacagtttgcatgctctgaacaggagggttttcaaggttgatacccatcccttgcgaaagcgctacatactttagtactagctgcttgtaggagtttaaaaggttttctacatcagcaacagtcagatcaccagagcgggcaaaaaggaatgggtactcttgaatttttttgttcaagtcatcatccttgagaagctcggctgctcctttcttctccaaatcagaaatcgattgcacacgctcaactgggttactacttgcatcactgtcccttctcatttccagtccaggaccttggaaattatctttcaaagagagattgacatcagaatccctgctagctttcagtgtttgtgatttttgctcccgtacatcaagattgttttggttgtcctgattctctgagctagctgataatcccaacatgcgttcccttgccaagtccatcttcttttggaaatctcgttcatccattgataatgattccccatcaatgttccagatgaaagactcagcggataagatgtttgtaaagaaatactgagcttctgacaccaaccgtgattgacgtctgtatcgctgtatatataatagatttgagtgtaactgtggaggatttgcctgcattaagaacagctactgcttaaattcttttggctaccttaatttaaatgacaaataaaaacactttacagatgattttcaggcaaaaggatcataacattgtagttcagatgatagaacaaaactacaactaatgctgaattgcggtgcaagggtagtttaggctaactgcagtaattccagaagcacgtaataccttgagaggccaaactagaagagcacatatatcattaactcttaccattcagtagttgacaagctctttccggtaatgaagagaaaagtaaagtgataaccgtacatgatctgatcttaagccctttatggtcatttgctgcagttttcaaaagcaagtccacaaccactcaaatgccaactattaggtttgtaatgaaagtttaaccatcatttgtaatcaaaactgatgtagtgcctagctagaggagggatgcccaactgatggttcacagattcatggttgctctaagcacatgtactgatgggcatgagtgcatgacaaggttgctctcaaatctggcaaactatttcagtacaaaactcactattagattagacatggaacctgcatcataatagataggtagaagttggaactaaaagtaatacgaagcaacagtaaatgaggttgcacagcgcactgacaactctattaagaggcaatgtgcccaacaaatcacgtaccactgcaccaataataggcttatattttttctagaaaatatcaaagttgagtaggtaatacacaaatagtcaccatcaagtcgacacctaatctgtgccatatcaaagggggcaaattttctttctccaatacagcaccaacaacttaatataatattgtcaatatttgatggttcatttgtatcatcacccagtactttaacaagtagtgaatcatacctttatggtaacatagatgaggactggaaggaattcatcagctcccgggggattttcatttgatacaatagacgcatttagaagtaggttgttgatgactttacagcagttcaggatgcaagcaagcttatcccttggagccttatacatgtttatcttctgcagctccttctgtgcaagctgtacaaagaagggaacatatgttagtaaagaacatttatatatttgaacactgagccagttaatgcatgccactggaagtattcccttaattaaggtccttgcaagcaaaaagaattgacattagaccacagtacgcagattagggttgacagtggcagcattactgtgatgataatgccataaactaaatagcgagtgtatataagaagtgggcagaatgttattcacatgtaagcattagtttataaatatacttcagacagacaggttcaacaggttcctcaatacccaagtagttcaatgttattgaaaggttctgcactgtaacagatcttcacaaatctaaaaatgtataaagagaggaaatcaacttccataccagccatgatgtttcactttgatattctggtttgatatccaagttttcaggccgtataaactgctgtaacaaagacatcttctcaaaaagttcttcatcactcttcacatcttccgggacagaagcaaatacccgattgaacagctttgtcataacgtatttctcaaggccctaaaatcacaatacaagacaatccaaatgttgatataacgacaaatatattggagaatatgcaagtaacgttatgacattttatggaatatatcaataagatgaagaggaactcggtaggtaaagggtagagcgagagtgaaaaaggagagtttaagtttaaaagtatcgagtttgaactgcactttaaaaacagcaacatgactagtggaataagttaataattccacgtaactgccagtcttaatcaaagtgtctaagaaaggcacctagctcggctggcagggagctgccaggagcagagcaccagcctgagttcgaatcccttctaacgcaggttttctcaccattttcttctctatcaataatggatgctaagttccttcctagtactccaacacattcttaatcaaaatgcctgagataatttgatgaagccgtgcattccaaatttccgatgggagtaaatacaagtcagatgcatttattatgtatctctgttaaacacagagattatgataacatgatggattgactgcctgaatctttggcaagcaggcatggtcaccagaaaataggataactggaaaatgaaagacagaaataattcatctcatgttaaagtagaaccaaaataggatgtttagttcatcccgttgtctaacagattttagtcaatgcattaatccgatcatgtcaaaaaggaaagacagcatggtccacgaatcaagaatcatatactcatatagcacagtgacatcaattaaaaatccaaaaataaaaagaacacaggcatatcttatctatagaaagttcatacggaaattacccataagacatttggacaaaccaaatttaacgacttactttgcaagcaggtaatcaacaagaacatagagctctgaaattcaattttgatgttcatctctctagttatgtaatattactatatcagcagtaccacggaacaaggaaattgattacctcaccggcactttctagttcttcttcagaacttccagcccagggggtgtgagccctgaaagcaccttccatattttccaggaattcttgaacagccgcactatcatgttcagggtcaggagctctgttcgagaacgttacgataaagctgtataacatgaaacataacaacataaatgatgtatttcccatacgaaaacatacataaatgtcaagtattggttagttatggatgctggatctagtattttaaaaggtaaaaaaagaaaggcaaagaaggcagtgctgaagcgtgctcctacatgtagaagaattaagtaaactcactagtttacaaagccttaattccaaattcccagcttctggcctaacatatagaaaagcgtatttgtcaagaattaactatggtgtcctcccagctgttgaatctccagatacaaccttggctactatgtgtcattgccactgtgcataaatcccaactcatgtatttctaaataagcatgttaacttctatgctctgtatccaaggtagatatttcacccaaagtgcataaaccgatcatgcaattttcctcaaacaacccccacacacatcgcattgttgcattgccggcacactgatcaattatatcgattgtgctgcgactcatctatccaaatgcagtaaccctagacatagaaaataggaatggcattaaacttcacctcggaactacacagacgacggttaacaggtaggcgaagagacaaacagcaaccctagattaagctccccccacaaaaccggcacggcgatcggtcatatcgccttgctaacacatattgaaggacacgggaacgtaatccccttgaacccacgccaaatgctccccaaatccccactataccagcaaaatcgcccatccccgcaccacacactatcgaaccaacacgcgccgcgtaacacgaaccaatcgcggcacacgctttccgtctcggatccctagaccacgaactgagatcgagcatatgcctagcaccgaaaatttgtggcggagctaaccccttgatggacttgacgaagtcggcggcggagggctggcgcatgcgctccaggaagtcgtgccaggccagcggcgcggtcgcggacccgaaggcgtcgcctccgccgccgccatccatcgtcgccggatcggggaagccggggaggtcggcgggctcggatcagccggattcggtcacgttttgtgggaggaggagagaagggggaggaagtcaagggtcgccgcggtggatgcccccggcgacgcgcggtgatttattttgtcggagccgtactcgccgagaagggagtggctcacggcgcttccgcgtaaccaaagatggccctgtttaaggacatttttagtttggaatttccaaaggttttatttattactcgtagcagtaatattttttctaactactccctccatccacaaaagttacgcatattatttttaacaccaaaaccaaggagaaattaaatcaccttggatgttacaaaatcaaggagtaaatgaaagcatgcaaccaatgagtattttgatgacttcttggattctaataaaacatttaatttatctcttcattcaatgcataaagactacacataagaacaacttatttggaaaaactcatatgtgaaacaggtgtaacttttgtggatggagggagtagatggtaccctgcgtgttgctgcaggagaattatacgataataaagtagatatgacttttaaaatttttttctttcttacctatatacagttttttcccgtgtttattttttttacatttatcggttatacataagttataaataattgagttgtatggtgtgtcttttgggaggaagagatataatttatatccttgataaatcatccaaaacctaaaaacaattaagatgatatgaagagatgtaatttataccctttataaattattcaaaggctaaaaacaattgaggtgatgtggaatcctgggaagaggaataccacgcacatgcagctgctacttgtccaagatcgcaggaagcatgatgatgcatccagcagaggaagttgtgaccaaccatggggagcatgtgatgcaggtgctggaaggctcgttcggtgcggattccgcgtccgtgccgagagatagcatttgggtgaggtttcaccctaccgtttgacggttacacagtaatcgcgtgcttactaaaaaaccacataattatcacgagatgtatcgtgattttaaaaaactaaaaatgttaccacgcatgataaccacgcgacaaccctggagcagttccgtgttgtggtctttgtggattcctgcacgtccgatgtgtagactagcctcgtgggctcatttgctcaacccagtttggctcttctgggcctcgtaacttcgtgcgtttcgccacatgtgtgtgtggcagtttctactagttggtcaatgcatttgctgtaatcagcgagcagtggtgcccttttgtaaagtttcaaattgctctccagcttcggctagcgcaccagacaatggagtgatggcgtcgctcgtaaccatctgataaagtcgagggatcctttcagtgctctgaaactgtctgtagcaatttccctgccactactgccatatgattttagaaatgggtgttaatcaaactgatacaatgatgtggcacgttcattataaatatttacaccacgctttgctgtgcaaattgcaatactacgttggtggaaagaagaggaaagaacgacgaaatgcgcagactgcgtactcgactacggccgcgagaagaaatgtactacaaagtataaaaagaacaccttcttaaagcaaacccctgacccagaaagctgttctgcctgtgcattatgctagttatggacaatgaagtacggtgcatttgatatgtggggcaaggctgccgatcgcaaagtgagcttgagcgctcttaaaaacactaacagtcaacacaggtataaaggcagaattagcaatgcctgcacaggttgcaattagcaactactcctaccaactcctaatctcctataatcagctcaaactgaaaactggtgcgtaactgacactaccattaatcctccagcctctcatggtcgcaccacaagctccaaaaggccaagggcctccaggtcatgcagattattggatacgctgcacgtatcagggagcaataagccactacgtgtccactggcagtctggcatcggtacatttctccaccatctcttgcacggtggagcccaacgaacgattccccaaaatgtctgctggtgcggtccagactccagactccagacggccactgtgatctacagtgttcaccagtcaccagtaggagtactcctctgtgccatgtaccgcatcggattgacgaacgaaactgccattgaccacatcaaagtactccgtatagtagagtgaagtggtcgccaaccgctctgtacaagacgtgactcgcgccgtgacagcctaactcgaccgaccgcacagtgtcctcttcatcactactactccctcagttatataatgagatttgctaccgtccagcagaggaaggcggtaccaaatcctagctatccgttgggataaatcaaacgattgagattgctcggtaccgtgcggtaccattagctcttatagtggtaccgtttcttaaagagaggtggaagggtagtatagacttttcacatgtaagggcgagacgccggcctccggggtgcgtggtggggtgttgatggcggcaccagactgtgggttccagacccgatgtcaatagcggcggtaggtagcgaggtgcgccgcgggaccagcatcgacggacgacgaggtctggggccagcgttgatggcggcgacggcgagctgcggggttcaagggttcgaggtggcgtgcagcctgcgagatccagccccagcttcgacggcggtggcaagcatcggggtgtgtcacagggctagcgtcggcgacgacgtgttgcgagatctgatcccggcgtcgacggtagggctacgggatctgcggccgtgtgcggcatgtgtggcctgcgactctgcgagatccagtctcggcgtcgatggccatggcgggcggctgcggtggcggtaggggcgttgccggccgcgacggcaaggtggccgtggagaggtcataccaggtgccacggtagcagcgagggtgttggcggccgaggcagcgaattggtcgtggagttgtcggattaagcaccacgccagcagcggcgagtcgtcggaccaggcggcggcaccggcggcaaggaagaactgcaaagacgcgcatatgagggaggaaacaatggacacaagcatgcagcggggtccaagaatgagaatttttcttttttgacgaagaactcaggaacgagattaattgactcaatattggaagagatttttactcattcccaatcctacccctaaacattggatggctagatttgtttcaatacctggtggtactggtaccttggggtaccaagtgctggacaatagcaaatctcttatataatacaagagattttaaatttttgtttgcactatttgactactcatcttattaaaataaatttagaattattattatttttacttactttattattcaaagtactttaaacataacttttcgttttttacatttgcataaattttttgaataagacgagtggttaaatagtataaccttatatatataagcagaaacttaaaatctcttgtattacgtgggacgaagggagtacagcttcttcgacggataaacggactcaaaaatccatcttacgaaagttccaatgggcaatggcaacagcgaaaggcaggctaacgtagaacaaaaatccgaggccgtggcgatgatttatgagcctgtgacgcacacgtgcaggtccggcgacgtaggaaacggcgaggttacggtagctcgcgagtctcgggttaggtcagcaatgattgtcgctacacaccaaatcagaaggcaaaaacgtcaagggaactcaacggaagggacacaaaagaaaaaaaaaactggccccagcgaggagcagatgcatttcacgactacgacggcctgccgcaacgtaccaacgtaatctcgcactggccgctatcaacggattgtgaaagcagccacttgtgatagtttaagtcaagaaaaccgagattcaatttagctaattacaatacttacgttaagcctgggaagtccaaacccggtgctgtgtccggagacccacctgtttacacgaatatggtagctagaagtacaccgaggaaaaagtatataaagtccaagaatattgacttaggattaacagagaaaacttaggctacttacaaatagcgaatcaatgcactccattataaacctccgagtgtccaactgtggcaagatttcgattcgataaaaggatctactagtaccaagattgaacttcgagaatccttctaccaaccaataaattccaggacagcacggtttaaaattcgggaagataacacgttcgtgcaccagagttattgaggaatcaaaacaagaactaccaagccatatgcaaaccgagatttgtactaatttaaccaggttcaagtcactaactcagatactaatttagggcccgtttagttccctaaaaatttttctcaaaaacatcacatcgaatctttggacacatgcatgaagcattaaatctaattgcacagttatggaggaaatcgcgaaacgaatcttttaagcctaattagtctgtaattagccataagtgctacagtacctacacgtactaatgacgacttaattagtctcaaaagattcgtctcgcggtttccaggctagttctgatattagttttttcattcatgtccaaaaactccttccgacatccggtcaaacgttcgatgtgacacataaaaatttccttttccccaaactaaacaaacctttataaccaggttcaagacactctccagtcggcatgaggactactctacggtatattcctgccgtctgacactcgacacaacacggaagggccacgttccttctccaaaacgttcttccgcaactctgcaggtctgcatttacaaatggtttatcgcctaacccacgcccctcatttccaggtaaccgtaaattctcgagtacacctcgtccccaccactaccaccggtcaccaccacgaaagttactgaccatccacacagcctaactcgttcgtctccatgccgcggcgccgctgccggctgagccagccagattacccaggggaggacatgggcatgggcgtgcggccgtggcagcgtgcaccggacagcggagtcccaccaactccgagccgaaacgaataaacaccacgccgaaacaatggcatacgcaccaaacgggcaaacggacacgaacaaggggagaagataaccgagcggaaagcggacaggtgacagatcccacccgctcgctcgctcgctcccaccacttccctttgcccctaagtaattgagaacgatgaagaaagatgaaggaattgaccatggcgaattgggcgatagtgataattaccggacagtaattcacaaaaatcagcggcgacctcctcctctagggtgaggtgagagagctcaaaatttaccccccacgtacaggaatcggaacccaggattagatagagaaagagagattagaatcgacaaacacgggtcacatccacttatctatctccattagattaagccttctgcatccttcttcttcttctgctgctgctgttgctgcgatggtgtggtggttggttgctgctgctagacgcttaggccatccacgccacattgcttgtatgtcagtgactgcctcctcggactgatggcgatcgcgcaatccaccgacacctgaggttcgttcacacgcagctttcacgatcaggtcgcgcgtaatcggccgcttgcggcggaggtagggggaagttgggtttgggcggggtggggtttacctggacttttggggaggagaagccgagcacgaggatcttggcgccgacgtcgccggtgatgcggaggtcgacgcggtcgctgatcgcggcgtcgcggacgaggtcctgggcgtcggcctggagcacgttgaagcggtcgacgatgacgcgggtctggagcaggcgggtgctgtgcgccggctgctcgaacccgggcacggccgccaccccgagcggcacgccgtggtacatgacgtcgaacgccgtggcgccgtagcggatgccgaccttgttggggttcacggcggtgaagaggagcgtgatgttgagggagaggtagaccccggcggggaccgcggcggccacggtcccccccatggcgtaggcggcggaggacggcggggtgacgagaaggtactggacggacacctggttgaggtcgaactgcggcttccgcggcttcaccaccagcaccacgacgagcgcgacggccagcgcgaggagggccaggaaggtgagcagcaggaagatgcagcagcagcagccgcggaacgaggccgacccgccgccgtacccgcccccgtagtgcgggcgccgctgctggtacgagggcggcccgtggtggtgctcgccgttggatcgggtcgtcatcgccgccgccgccgccgcggagttggatggatgggttggtgggtgggtgaggccgtgagcccgtgaggggaggaggggggtggtttggatttcgggagctaatggagcatttgcgaggtggtacttgtgggggtttgcgttcgtgggggtgggggtggtggtggaaggggaggaagaggggaaagtatggggaggtgaatacggaaactgccgttgcggtagtgggggtaaatttggtggggcccttctttttttttcttctgtctctcttcgttcctgtcgtgctccgtttattccaccgggaaattgggatttgttggataaaataatggaataatatggttctgcttggcacagtttcagctccacctctcctgaagctggagctcagctaaacagtttcagctccactaaaactgggagtagagttgggtgaagctctctcacaaaatgtactagagttgtggagctgggtttatgcagctccacagctccactccagactcaactcctgaagtaatatttaggagttgaagctgtaccaaacagcccctatgttccaaaacgtaaaaacttaaacctggcacggtgcaacgtgacttcttaagcatgtggccgctaaagcactcaaagctgcccaatcttaggtgcagaacagtatggagttttctgtatactagtgtcggtgacatgggaccgggagtatcatgactagagacttgggcagccgcggtcacccacgtggcctgaccccctcgggggggtcgggcccgagggagacgtgcccaccccctcctctgtctccccgaggggtcgggctgctcctgtttcggccccgagggctggggcgccccgaccccctgtggtattggcaccacgtgtgtgggttaggtgggcacagcggcgctcaccaaaccacatttattgcggaatggacaagcgcgccatgccgcatttaatgcagcacggcgcacgcatatccggtccgtgaccggtcgcaatgtgtgaccggtcacagaccggtcagatcgcgggttacgtggcagcaggcggcctgtcacacgcctcgccccgtcccgtcggaatgatgagagcctcttgacactcgtcccgagctggagccggcgtggtaactcctggagttagcacgtcagtcccgactcgattcatgccaggcttcatcgcaaccgttgcaaggaagtcactgtatgaagaggggcagatgtgcggcatgctaaactgacgcgtggtggagaagaatgaccggtctgtgactggactaacgccggtcacgtcatcggcagacaaccgtgctcccacgttgcatctgcttccggcggagtggaggtaagtatgacccatcccatcggagggtcattcagacagcggccattgaagatctcctcccattaatgaagaaatgacagggtgatcccctgtgtccgacgagtgacggcgctgggcatcactcaaggacaagcggtgatttagcttccaggcggaggcgcgagtcaagatttggtcaagatagggtgggtccccacccaaaagaagagtaggtagaagaagtgcatgtggtatccccttgagatataaaaggaggaccttgcccacctaaaagtgggggaggggagggagggtgaaaaaagaaccagaagagaaggaaaaagaggggttctagagcttgaactctcttgctctccatttgctctgtaactccttcacacacagatccaccagaacacaggagtagggtattacgcttctcagcggcccgaacctgtatacatcgcccgtgtcttgtgcatttgctctctcgcgaacgttccacagatcgagggtgaagaacctcactcagcgcccccggccgaaccggcaaagaggggcctgcgcggtctcccggtgaggagccccacgctccgtcatctggcgcgccaggtagggggcgcgtgtgtttttctaagccctcgtcctctttcgtgtgcgccaagtttctcccgctcagcccaatggccgaacgggcagtggcgcacaacctctctccgagcgctagcggtgacgacagggagcagaacccgcgccgtcgagctcgtactccatcgtccccctttcgccgaagtcttgggcgggaggaggcgctcgagggggtcgaaagatccgcgacttcaccacccacgggtaatgaagaaggacggcgagacggggagtgtcgcctcctcgtctacggcgatggcagcacgccccagggcgcgctccaggctgcgggcgtgctcctgcgtcacccgcccgtcgtccccgatccagagactccagctcgacgttggctggatgacgtggccgacttggtcatgacggcgcagcagcgcctaggcgccggcgggcggtccttcgcccccaaggcctctggcgctgctaccaccggctccgtgtcgtcgaggcggagggcgcggcgagcggcggccgttacccgccgttcgtccgctattccctcgtcaatgcctccgacccaagaagatgtgcgtggggggccggatgcccgcctcaatattgagcgccgacgcaatggtcgtcgtgctgcccacgcaacgaagggcgcttcctcgtccggagcgccacctcggtccgggcatgggggccagcctcccatgtccccggttggcggtgccggctgtcgagcctttgtggcgagcctttggaacgtccgttggcccccaaggttccggcccaccatcaccgaaaaatacgacggaagcgtcaaccccgccgagtttctccagatctatacgacggggattgaggccgccgggggtgacgacagggtcatggcgaatttcttccccatggccctgaaaggtaaggcgcggggttggctgatgaacttgccaccagtacactcttgggaggatttgtgccagcagttcaccatgaacttccagggcacatatccgcgcccaggtgaagaagcggacttgcacgcagtacagcgagaggacgataagtctcttcgctcgtacattcagcggttctgtcaagtccgcaacaccataccgtgcatccccgcacacgcggtgatctacgcgttcagggggggcgtgcggcacaatcgcatgctcgaaaagatcgcttccaaggagccccagaccaccgcggagctttttcagcttgcggaccgtgtggctcgcaaggaggaggcctggacctggaactcctctggttccggtgtggcagctccggccgcccccgggtccgccgctcggtcagggcggcgggacaggaggaggaagaagaggtcggcctatttcgacgacgaggggcacgtcctcgccgtcgagggcgcttcgcgggccacccgaaaggggaggcctgcgagcgacagaaagaaggaggctggcgctcccagcagggagcgcccgaccggcaagtggtgctccgtgcacaacacctccctccatgacctcgcggactgccgcgcggtcaaaagtttggctgagcggacgaggaagtgggaggaggagaggaggcaggagcgccgtgagggcaaggccccggcggcccccgccggcaaccggcgaggtgaggccaagcagaaggcccccgccgaggacgtcgacgatggcgacgataacctggggttccaggagcctcaggccactgtcgccaccgtcgatgggggagcgtgcgctcatgcttctcgccggagcctcaaggccatgaagcgagagcttctggccgcggcccctacccatgaggcgacgcggcgggcgcgatggtcggaggtggccctcaccttcgaccagaccgaccacccgccgtgcgttgcccggggaggacagatcgcgatggtggtttcccccaccatttgcaatgtgaaattgaggcgtgtcctcatagacgggggtgcag

SEQ ID NO: 57629 - DNA, 8454 bp, Oryza sativa
cgacgagaggctcagcgcctccgtcctggccgccccgaggcagcggatgatcacgtgcgacgtggtcccggtcaaggaggttgccctgggcgacggcccgtccaagaccacgcgaatcggtggtcttttggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccgatccggcagaaagtgcggcggcaggccccggaacgtcaagccttcatccgcgaggaggtggcgcgacttctggaggccggattcatccgtgaggtcatccatccggagtggctggcgaacccggtcgtcgtccccaaagcgaacggcaagcttcggatgtgcatcgactacaccgacctcaacaaggcatgtcctaaggacccttaccccttgccacgtatagatcagattgtcgactccaccgcggggtgcgaccttttgtgttttctagatgcatactctagttatcatcagattcgcatggctagggaggatgaggaaaaaactgcattcatcacccccataggaacttattgttatacgacaatgcctttcgagttaaagaatgcaggacctacttttcaacgtaccactcgaatttctttgggtagccagttaggacgcaacgttgaggcttatgttgatgacttggttgtgaagacgcgcaaccaagagaccttactctcggatctagcggaaactttcgaaagtctccgctccgcccgcataaagctgaaccccgacaagtgcgtgttcggtgtgcctgcgggcaagcttctcgggttcttggtcactgcccgaggcatcgaggccaaccccgagaagatacgagctatagagcggatgcgcccccccagcaaacttagggatgtgcaatgcgtcatcggctgcatggccgccctaagtcggttcatatcgaggttgggagagaaggcgctacccctatttaagctcctcaaacgttccgggccgtttacttggacggaggaggctgaacaggccctcactcagttgaaggcgtaccttagttctcccccggtcctggtcgccccgaaaccagatgaaccgttgctactttacctggcggcaaccccgcaggtggtcagcgcggcgttggtcgtggagcgcgacgaggacaaccctcgctccgcgcacccccaccctgtgtcgactcgacccgggagagagcagggaggagaggcccccgagccgaacggcggcccgaggcccccgacggccggagctggccctctgcccgcttgtccgacggtgccaggcgcccccgacccccaggatggccccggggccactgcgggaaggccgcgcttgtcgccctctgaccccgaggtcgtcggcacagaagccgagtgcgccccgcgcggcctctcggatgaagagcaccctgtatcgactcgacccgggagagagcagggaggagaggcccccgagccgaacggcggcccgaggcccccgacgaccggagctggccctctgcccgcttgtctgacggtgccaggagaccccgacccccaggatggccccggggccactgcgggaaggccgcgcgtgtcgccctccgaccccgaggtcgtcgacacagaagccgagtgcgccccgcgcggcctctcggacgaaaagcgccctggagatgcggctggcgaaggggatcggccccgccgaaaggtgcagcggcccgtctacttcgttagtgaggtcctccgggacgccaagacccgataccctcaggcccagaagatgctttacgctattctgatggcttcgaggaagttgtgccattatttccaggcgcatcgggtcacagtggttacgtcttacccccttggtcaaatcttgcataaccgagagggtactggacgggtggtgaaatgggcagtcaaactctctgagttcgatttgcactttgaaccacgccacgcgatcaagagccaggccctcgccgactttgtggcagagtggaccccagctcccgagcccgtctccatccccgaggccagctcgggcccctcgcagctgcctcacatcgcctactgggtgatgcagttcgacgggtccctgtctcttcagggtgccggtgcgggggtcacattgacctcgccgagcggagacgtcctcagatacctggtccgcctcgactttcgggcgaccaacaatatggcagagtacgagggactccttgcgggactcagggtggcaactggactggggatccgccgcctcctggtgttaggcgactcccaactggtcgttaaccaggtctgtaaggagtaccagtgctctgacccgcagatggacgcttacgtgcgccaggtgcggcgtatggagcgccatttcgacgggatagagcttcggcacgtgcccagacgggataacgcgctcgccgacgagctctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggactcgaggggagcgctcccagctcccttagatcgattgcttggatcactgagatccaggtgtacctcacagataagactctacccgaggaccgcgaagggagtgaacgcgtccagcgcatctccaagcgctacgtgctggtagaagggaccctctatcgacgcgcggctaacggagtcctcctgaagtgcattcctcgggaacaaggcgtcgagcttcttgccgatatccatgaaggtgaatgcggagcccactccgcctcacgcaccttggttggcaaggcctttcgccagggtttctattggccgacggctctcaacgatgcggttgacctggtccggcggtgcagggcgtgccagttccacgccaggcaaccccatcagccggcccaggccctgcagaccatacctctttcatggccgtttgctgtctgggggctcgatatcctgggtccgttcaggcgggccccgggcgggttcgagtatctgtatgtcgctatcgacaaattcactaagtggcctgaggcttatccggtcatcaagatcgataagcactccgcgcttaaattcatcaggggcatcactgctcggtttggggtgcctaaccgtatcattacggataacggcacccagttcactagtgaactcttcggtgactactgcgaagacatgggcatcaagctctgcttcgcctcccccgcccaccccagaagcaatggccaagtggagcgcgccaacgcggaaatcctcaagggcctcaaaaccaagaccttcaaaatcctcaaagcacggcgactcatggatcgaggagctgccagcggtgctctgggcaaaccgaaccacgccaagccgagcaaccggggaaacgcctttcttcctcgtctacggcgcggaggcggttctcccatctgagctcaccctgaggtcccctcgggccaccatgtattgcgaggctgatcaagatcagcttcgcagagacgacctcgactacttggaagagcgaaggcggcgcggggccctccgagccgcgcgctaccagcagagcctgcggcgctaccatcagcgccacgtccgggcccgatcactctgcgtcgacgacctcgttctacgccgcatccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcaggtctcgggctcaggccaaccccgcacccccccgggcgtgcagggttggccgggggctaccacatacacataattgtcttttttctcttccgtatttcaataaaagcattttcgatttcctaaggactgtgtttgtgccattgtttccttttgaagaatcttgacttgaattagcacgctcgtgctcgatcctgccctcggtggcccgggacggctaaaatcgccaaaaggggcccagaaccgagccgtgccccggggcgtggtgaactccgggggggaatcggcaaaggcccacaatcgggtcatccataaccctcggtcaccacgctcccggcctggccagtctcgacatgtggatctccccaggcactagctccgacccgcgccgtttgaggctgggacccgggcacgagcccttgttcaagctaagacacagaaggaccgcggcacagaccatcctcgtctcatacacacaacaaataggattgacacagaaatttcctctttatttgattgcagattaagttagtttatacaagaaggggacccgaaggcctcggaagaagaaagaaaaaactatataagattggcatgggcctgggggctcattccgacacgcccgggtcgccggcctcatcgccgctgtcgcccgcaccgccgtcaccgccctcttcgtcggagtcgagggcgaacgcgagccggggggccgtaccctcgaagctgtggacgatgtggtcggcagcgtcccggacctgcgcgcgcgcgtcgtcctcggtcccgggaggaaactcgtccagcgctgcccacggggagaagtccgggtccctggcctggtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggtatacttcgcagtccgtccgccccagaggcccgcttgccacccggcgcggtctagacgggagacggcgtcccgaagcatgccgggccctacctcgcctgccaagcggagggcctcgacctccccggcggacgagtccaacgcaccctgcagatcggcgatggtgtgttcggcagctgcgaggcgggcggctaggtcgccgtcgcccgcggccgccctgtcgctgcgcgccctcgcgtccagctccttcacccgcgccttgagctcagcggcccgctgatccagtgcggccctctcggcgcgggcgtcttccagattacggcgcgcctgctcctcccgcgctgcctcgcggagggacaggctgtccgccagccgatgcaccgcggcctcggcctcctcgagagctcgctcccgctcggtgagcgcgtcctcgcggaggcggagtgtggactcctcttcggcgcaggcggcctcgcggtccgccaggtccctctccctcgcgcgggcgcgctcttccagcgccttggcgcgagcttcaagggcctcttcgcgccgccgggacgccgcctcgttctccgccgcccgccgttcccgtgcagcggcggcgtcaaggactcctcgggcggcgtcgagtttcttctctagctccgccgcccggctcccgtattggaggcggagatcgtcccgcgcctcgttgagcatggcggtggcgatgagggcagtctcccgctcctcctccacctccctggcgattccgccagctccctccgacgggcctcgagctctgaggcgtgccggcgatgtgccttgcggcccgcctccaccatggcttccaccgagcgccgcccctcctcgacgcgcacccacgccgcgtcgagctccgttcgctctgcctgcaggacctccatctgggcacctagcccgtccagcaccgtggtgttcgcgacggctaaggcctgcaggaggggctccgctttcagtagggcagcggaaggcagaggggagagccgtctcggtatgggcgccgcgcggctcggcccgccgatcgacgtgccggacccaggggcgtcccccgaagctggcacgtcccaaacgtcgcccgaggggtcgggcccgagcggtgcacccgcgacctcgtcgtgggtggcctcggaagtcatcgtcgcctcgggcggagtcgggtcgggggcttggcaggccgcttggcgtgcgcgcgccacctccgcctcccggacggactcctcggcccggcggagtttggcctcctcccgagcggtttcctcagcctggcgaacccggacggcctcctaggcagcttcctcggcttcccgaaggcggtctgcggcttctcgccggtcagcctcccgcctccgggcctccgcggtcgccgtctcctcggcctcagactggccggacttggaatggcgggaggggcgcgacgggatctcgctgaggcagaagaaaaaccagaggacaaaaagaaacgggtgagtgaaaacttgccttgggagatgggagaatgaatacggccgcagtgggcgcggggacgaacctgcgaggaggtcggctaaacgaccaccttggggggagataaggtttccccggcatggttcggtctccctcatcttgcggagccgcttcttctttcgctccccctcgggctgcgacgtcggcacggcaccctccgggcgcctgctgctggcacgcgccgccccgccccctcggggaggagatggggaaggggtaccctcctgcttcctcttcccccgggcgtcggcaggacggctgcaccccaggcccccatcgtggggcccagaagcacgaccccctcccggggtagattgttcccccctgcggctcccgcccgcgccatcgtgacctcgaggagcccgttcctccgacgccccgaccgcctgcatgatggtcaggatgttggcgcaatctggatcgctgcagagggggaggactccttgggggatgagggatgcctccacggagctgagattcagcactcgttggaccaccatcttgaagtcctcaggggcccagtcccatctgcccccctggtgggtcctcatgtagtcctcggacccggtgtactcccaggcgccccgggcgcgccgctggagcggcgcgacccggcgatgaaggtagtcgccgtacaccatggcccccgtgagcccctgggatcgcagacctgccaggcggtcaagaacggcgtcgtagctgtctcccagatctaccggcgcccgctagttggaggcctgcgccgggggctggctcggaagtcggatgcgcgcttcatcggcgaggggggtgtagaaccagtcgctcttccagtcgtcccacttcttgcggaggacgcagggaatgtagcggttcagcaccggcccccgcggctggaagtagcagccaccgactaccgacggcggcgacaccggctgtacggtgaagaaccaccggaacagccggagagatgggcgcaccccgatgaacatctcgcacaggtgcgcgaagatggccaacgtcattaccacgttgggggtgaggtgcgccatctggagatcgtaaagctccagaacatccatgaagaaagaagagaatggcgggaccagtcctgccattgcgaaagagaggaagaagacggaccgccccgggtagtgtggcgccgggcgtccctcacccagtgcgaccacctcccggccggcggcagattccggcatgaatcggcgcggcagcccggcctgcctctcgctcacgatgcgggaaggcggcagcacgctaccgtcgagcggtgcgagccccgtgccatgacgccggcggaggaggagcttgagaacgagtgagtgcggcaagggtagggcacaggaaacaaggagttagggcgcaaacggcgaaggcaaggggaataatggcgaaaggaaggaaacgaatctcttccttggcgcctttatacccttgccaacgctatgcccggctcctcgtttcccgcgcccactatctcgccccctcgtttctcgcgcccacgcctccactaatcccactcgcccgtttgcggcgcacgaggcggatgtgcggccgtggcagtcgagatgggatatatcgtgcgcgcgttaactacgctcgccgaccgaagcgccatcatcatatctccaggcgaaatgaaccggctcgtcccgattcgcgcactactcgagtaatgtaacggtcttgaagaggccactcattgttatcggtcgtttttccctagccgatgcgcgcgatttgcgaccgctgggttcctgcccgcctgtagagagcggccccacctgtcaccaggtctaaagagtggcgtcacgcccgagcgcttccctcgaggggggcgaacgccctggcataacgccgggggctactgtcggtgacatgggaccgggagtatcatgactagagacttgggcagccgcggtcacccacgtggcctgaccccctcggggggtcgggcccgagggagacgtgcccaccccctcctctgtctccccgaggggtcgggctgctcctgtttcggccccga

SEQ ID NO: 57630 - DNA, 9666 bp, Oryza sativa
  unsure (1)..(9666): unsure at all n locations
tggtttaggtcaacacaaaaaatttggtcgagttaagcaacaaaggttcagggcctgttcactttgatgccattttcaaccttaccaaattttggtaacttatataagaaatcttgccagttgccaaaattttggcatagttgccaaaatttcggcaatgtcaaaatttggtaaggatttttttggcatcaaagtgaacatgccctcagttcttatccttccagttctccttttgtcttgaatgttcttgaagaagctataagtggaacagatacgttgagatcactcccagttggatcatcagcaccaggaaaggttccgccactaccagttttatgatcttgtttataatgggatggctaccacatatatttttctatttataggctgacaagaagtgtgctcttttttatggtgtaacaataagtgaagaacaagctcggtcaggcattgtagtcagagtcaactcagccgcacaaagtgaatttaaggtatgatgttgattattccttcggttgctctggaattgaagcttttatgttctgcatctcttttgaattttggaatattatttataattctctcaattgccaaatatttatctacagctacttttcttcgaacaagaatttgatggaggttatggactagctctgcaggtacttttgagtttcatggttgatgtgttctgtggttttgtaatcatttgccatggattaccacatgccaatcttttatgttttttatgaatgaatagtggaaagactggaggagtctcaaaataacttaaagggaaattgaatttgtcatcaccatcacaagtctatttttcaatagaaacttaaagatgtagatgtgctaaagcaaatgcgaccattagcctgtcacctccaaagcaactaatcctgacctcctgtcatcaactgacaaccctcctccctgtaacaatcatgaaaagagctgtgcctgtgcaaagctcgaattccagctgaacttggcaaacttgagctttttgaactgtaaaaaattttatcgcgtctaagaattatgttgtatgctttatttttattctgtgcaattgttgaccaaattttgcatatagaaatcttgccaacaacaatcttcaaggtcctattcctgcaaacatgttcttgcactgctctaaacaaatttagcctgttgtgatgcaattctttgttctgaaacagagtgaaacacaaattcatctaaaaccagcataaaaaaggaatttcattaagtccatgcatgtttcctacattcataaagaaaaagcagggttgattttctttagaatggatacaacctacgttgattgtattacataagtttcaaaattgcaaacactactttcaggcatccaagctgaggtgaatcacatgagacaaaatggcagtcttgctttcaatgaaagccttgttgctggtatatttcttcattttgccggtgcaagacccacactggtcttccagaccacggaatggtagtgcatcaatagggctgcagcagggtgacacaccagcaccacggttattggattcaggagttgccaaggagcagcaattaaatgattagcttccacctttaattttgctggcaggtagtctgtcaagggcttcttttttccaattatggcaatgtagctattcttatcaattcctcccctttctgctattgcctggttgtgcaggtacctagattcaatgcaagggtcagggtgttatcccaggcttcatggacaactccgtcgccttgaggaaataagcctcctccgtccctccatatgtatttcctcctctgctctgtactgctttgctctgcctcatgcttgctgtcatgtggatgtgctgctgctgaccaatactagcttattgaagttttccctttttgttcatgccgttgcattgcctctgaatcttaccttttttgcggggcctctgaatcttacttacttttcagtgctatatacagattcagttacaagacacatagtccctggagatgaaacaaggtgtttagtgcgtattacattaccagttaggatttacatagcatcattcacacctgattagcataagttccagataatattttattatcccctttgatgtttaagatggttgcctcttcagtatcacatctggatccatagcaatttcatttctatcgctttacttctccgtgcagggaaaatagactgcaccaagcatcagttaaggtacattcagcataagagagttaagcccgctacctagccgaaaaaaccgaaggtggggctctttgttgccaacatattgtgactgctttcgattttggtgcagtagttttggttagtgactattatatcattttttcttaaaataaggtcccacattatggctaggtgttgccgcgagggctgtgaatgttctttacttctgattaaagtgaagtatttgtgtaggtgatgacaaaagctacaattattcagggctgtcattctctcctgtaggtgatctattatgcaatttactatttgctgtaatgttacagtgtcactgctctcactctgcttttgaaagcaatatgtcaataatggattacataaggaaaggtttattgcatctgtcagctaacatttcttacggtgttagggcccttttgattcttaggagtggcaaagaattttatgggattcaaattccaacatatttttcttcctatgtttccctttggcttataggactatgttcctatgcttcactttcatgggaaaaataccaagaggtataacctctttgtaaattttcctttgtttttcctatggcactatcgaagggctcctattatcttttcctgtgtttttatcctgtagaattaaagaagcacaccacttttattcctgggtttttcctattcgtgtgctttgcctatcctgtgaatcaaaggggctttaagatgctatgccgctatgccataagccacccttacttgtgttatgacctactacttcctactagcagtacatttttgtatccatatggatcttttcttcatgatggttgtctctacttaaagctatgcattattcatacatgaagattaagtgaaaaacaagccactcccaacttaacttttgtttgatggatatgctagatagaaacctaggtgtatgttcttggtctcttaggtcattgtgtcacacaatgttgtttgttgatgagctccctatatatattgttaggtcaattatgttgcccaacaagttttttgtgctaatgtgaggttactaggctcaacagtccttagatatacggattcggtttggttatggtgacagttcggttttggatgattggattgttttattttttcataagcccaacaatatgatataaaataatgttatttaatatgtgaagattagtggccatacagaaacgcgtgccaaaacaacatattttctaaaactgaattgtcctcctatgaattacattcaatttctcttccttacacgtggggttttatgtgtgctcagtgactaccccgtagcaaggtatacttgctgatccatatgtatctttgctaaacagtactatgtatggtggtttaattttaatggttgcaaatcttggtttccctgtaagtagctagctagcatgatttttttttcagtcatagtttactcttttaacgggcaacttgtttataaacaaacagctcacgggatgttggccttatgtcattctagagcacttttcagagtttaatatgacacaaaggctttccaaacgatggcgatgcctacggataatcattttcctgctgctcttacatatttatatatattatatattcttttatttacttatttattttgactgataagagctggagactgctatatttcataatgaatattcttcttttatgtttaatccacttagtttggtgctcccactcttcagtcggtgctgctttataacgaaactattatgtgcattatatcgtccgacataagtataaccatttcatgtttgcaggaccaaagctgccattcatactgctgtgcttttgttgtggattgaactagcaggagagaagaatacacatgaacttataaatggaccatttcctgtaggcagctactttatttgtcctgtatattagtgtgttgttttttaatcaatgtaaatgatcactgacggagtacatgtatatgcattaatcacctaatcgttctgtaatattttctgtttaattttttttgctgcgcgccgtagcgcgcaaaccctttctagtactctaaaaaaaagggcaataatagttaatccgtcacccttaatgtactttaatattacaaattagtggtccatctatatatgattctctcttgttttattttgataaacaagtttactgtgcaaagatattcacaaatgtgaaaatgttcaaaaaacgtcagaattaacttgtttcaagcaatattcgagcacacaggcttttttttttatctgtagtgaagcactgatatttgccccttttttttccttaaggactatagaggaaaacttcgacctaacttgattggagagtttttccaacgatggatacttggatagggagctagttgcttatccacaggagcctttgtctatgcgtgaatccagttctgtagtcaaagaacagcgcacgcgaagtgcttatttctgtagtcaaagaacagcgcacgcgaagttcataagcacgttgcacgcaatgtatgaagaaatgggctatattcatggaagaaaagatgaccattaatgtgtcgtttgcaagaagcgtacagggtgaattgtcactcgaatttaaagctcgcattggcaggtcaattactacagtaagctagaggtgcctctctcgttcttcaccgtagattcacatatgtacaacagtgattggcatgacacataattatatcaagacctaggatgtttagcttccaaaacaaaaatttttacgttgtatatacatagagtattaaatgtaggaaaaaaaacaaattacacaaattgcgtgtaaattacgagacgaatcttttaaacctaattctgtcatgattttataatatggtgctacattaaacattttctaatgacagaataattaggcttaataaattcgtctcgtagtttcctggcggaatctgtaattttattttgttattagactacctttaatacttcaaatgtgtccatatatccgatgtgacaatcaaacccaaaagttttccccaactaaacaaggccctataataaattcattcatattatataggtgtttttacctctaaattaagaagtgcacctgaccacgtggaactatatatacagtaacctgtattgactctaaggcttacattaccgtcggtaaccacgcagtgaccgtccttaccgcggaggtacggtaatagaaataccgcggtaacctccttaaatttaaataaattaaaaaataatttaaatttttgataaattttgcatgatttttcacggttaccgtgcggtagccgtgcttaccgccggggcgcggtaactcggccccagcggtttgggaaaccctgattgactccacatgattgtcaaacattgtgaatccggccgtatacaccaacaatataatactatgattgtcgaaatgaaacatatacgtttaaaaccatgcttgtaaagaaatctatctttatgatgttatgttttagaaagtttgaactatttccctgaacatgcagaatgtgacctttcaaacatgaatgccactcctaatgtgcctgggttttacaatatcatgcgattacttctcttagttttttagatctctttctgttagtaatttcttggtttttagtaaccatgatattgttgagtagggtaacccctccccaaaagataagggaaccctagttgtgttagcatgttctcgtgtatagagtttgttccataaaattgaaagcgtaaaatttatgtcaagtaataacttacatgtaagatgtacatacacaccacatgtaaccgcgaataatccttagcacatgtttaaagaaacggagtctagcggtanatccttgactaaatattttcatgttcatattttctctgtttcataatgtaagtcattctagtattacctacatacatacatatagatgttaatgaatctagacaaagacatatgtcttgattcattaacatatatatgaatgtgtacaatgctagaatgacttatattatgaaacggagggtgtatatcttaagtcatgacaaggatccattttgatgcttgtactctggcaactcgaacctccattggaaaacaacactatccaatactgcgtaccaagcaatgaaaaacgtaacttagtcgagtgacactttgtagagaaaaaaatatcaagataatataaaaccatttttgttgcattttcattccgacaatttgttgtgaaatatccacagtggaccagctacctataagatgtttaacaattgctacatctattgattttcaccgagacgcctataaattgggtgcccgattttttttaaaaaaataaaaaatcaggcactattttactaagtagaccgaaaatgtttcactaagtagattaaaaatattttaatcttgtaaaagactgaaatacaaccaaatcacctcatgaaacattttgctacaacgtatgaaacaacggtttctaaaaaaataggcgttgttttaccctatataaaaacaatgtttcagcaaatagtgaaagaatgtttcaattttttaaaaaagtgaaatacagtcagatcgctagatgaaacaatttggttcaacgtatgcaacaaacgatttaaagccatttcaacacttaaaccctgtgtacatcaataaccatgtgtccatcaagatgaaattattaaaacattataaaaaatccactgcaacatttcatccatacatagtgaaacatcgcgagtacactagctgaaacattgtcggtggaaaaaaaatgaaatggatcccccctaataggatgtttctgttatatccgggcagatgttgcaacggagcgcgcgtggtggaagcaacacgcgcgcgcgggaggcgtccgagctataaaactaatatcgcgtaaaagcatttgaaatataaaataagagtacaatttttttacacacacatgtacttgtgaatgtaagtaattatcggttatcctttaaaattagataatctaagaaatgtcattgacaaatgtcaaaatacaagaaatgccatcgtatgaataattttgtcccaaaaatgccattgccgttagggttcctctatcccatgctgttaagtgatataggatgaacaatatatttaacgacacgagatgtgcggaactctaacgacgatgttatttttagaataaagtcgttcgtacgatggcaaactcacgcttgtcgatgatatttcttaaatttggacgcttgttaatgacatttcttaaattgtctcttaaaattaaaatgctctctacaaaattccacggaggcacagagcgagacgacaaccatgacattttagcgagttcagtccatcaaacaaaaaaaaaaagaaaagacaaacaccgtttactcctgaaaaagcccaaaaggccgaaacccacaagcccagtaggccactttccgatatttccgcgtcccccacgagttccattcccagttcccaactcccatcaaccatccttctcgactccactgaccaaacaccccagcggaccaaatcgccgcagcagggcgcgccatggagccggcggcggagaagagggaggccgagcaggaggagctgcagcagcagcacgacgagcccgccgtcccttccgccgacgacgacgaggctgaggcggaggagaacgagcgccgcaaccgcgagctcaaggccggcttccatccccttagggtaagtactcctccgccgccgctagatccagcttctatttccctcccggaaagaggaaaagttgtttctccagcgcgcctggaggttgagatcgagtagatagatgtatgtaagtaacccgtgttcctttgttttttttttacctgtgcacccgcagcgtagattcgtgctatggtacacgcgccggactcctggggcgaggtcgcagtcctacgaggacaacatcaagaagatcgtcgacttcagcactgtacgtcaccgcgaatttcttttggtggggattctctaatttcagggctgcagattggattgctgatgctgtttgggtgtcctgtatgtaggttgagtcgttctgggtttgctactgccacctcacgcggccggttagcctgccgagccccaccgacctgcatcttttcaaggagggcatccggcccctctgggaggtactcctcagtagtcagtaaaccgtgttgttctatgtggttgtgttttgtttagagttatctctgttatgcttctagttgttgacggagtttggttgagcaggatcccgcaaataggagcggtggcaagtggatcataaggtttaagaagaccgtctctggtcgtttctgggaggatttggtaaatacatctgcactttactgtatatgcattcgggttctcaggagactagtaatttagtaagtgcatgtctgtggtgacagatgcgaaataatataccgatatatacagtagtgaaatagttatccacatgttttgaaaactatatagatgacagcatgagattagccaaaacacacacacatggatagggttatttttcctacaaaaatatgctgcaattatctcatgcatatccacagatatctatgttatagtcacagaatgttttgatgggggatgggtgtggaacatgccatcattgcccaactcttttccgaggagtgaaaagatgactcttaggattgatcatgtgcaagcttatttgtaagcacctacgtatcaccgcattacaatgacgctgcttaatttatgcaattttgaagtggcctagttctacaaacctaatattgcttggtttacaaatataaagtatctgtcttttaccatgccaacttcacatggctacaatgccaatgcatgatgagcaataaggccatggcataaaaatcataggatggccatgcaatgggcccatatatcctgtagcaggccaaaccttaaatcaaatagccctaaatgacacaagaggttgtgctggtactgtttgttcatgtcaatattgtgacattgcattgtttccatgttccaagacatgatattttagcttggaagatgtgtttgccacattgggttttagccatacttttttctgtcactatttcagttgccatgcctgctcagcattggtaccacattcacgctgcctttttcttttgttccattctcattttcatttgttccttttcttttcctgctattctgttctatctattgttcctccttgatctccgttgttgtgatggtcaatttggtgtattctgaaatcattaagggcccatttgaatcactagaatgaaaaaaaaaggaggaataggaaaaacataggatttggacaggaatacaagtgtaaaacagaggattgcaaaacacaggaaaaatataggaatgaccgtttgattggatcgcaggaaa

SEQ ID NO: 57631 - DNA, 1119 bp, Oryza sativa
tattcaaaggttatataggaaaaaaaatcctataggaatgaaaccctctgaaattcctataaatttcctttgaatcaaagggcccgactttcataggaatcattgtcacatcacagtatggtacacaactatatttaggtctatgccagatactgtataacctttagcatcttcaaaccttttctgatggcttgtttcatgccatgatctgggactagcatgttccacattcagttttctttaccttcgcagaagtcaccttgagaatgatttcaaactgctaaatggttctttcaaggttccaatgactaatgatgcatgagaccagccatatgcatgtaaaagttttcagaataatatgtacttttctcaggaggcttgtccagttctgctattaacttgtagatgctcttcaatgcttcaccaaactgttctttatggtgcacatgtatggtagcttgaattttagtaactccttttgcttattgtgcttatatctcaggtgttggtgctagtgggtgatcaacttgattatagtgatgatgtttgtggcgttgtactcagtgttcgtttcaatgaggacattctaagtgtctggaaccgtaatgcatctgaccaccaggtttgggacaacacaaatgctacaatagctattatgtttgaactctagacttgtactcactttctttcttctgtcgtgcaggctgtgatgacattaagagattcaattaagaggcatctgaagctgccacacagctatctgatggagtacaaaccacatgatgcttcactgcgggataactcatcttacaggaacacgtggttgagaggataagctccatggtcacatatttagctgttatcttcctctaaactatcgcctcgtggatttcttttgaacctgtgcttgcatgggactaaaccttgctatgtgttgtgcatccaaactctgttatgctatggacaatcaaaatgcccagaattatcgtgatgccttattgttatactgtcatggttggttcgttttaacaacctatttataggcagaattgatccaacatgataagctggaaatagtggaataggccctgtctctctagtgatatatataatttctta

SEQ ID NO: 57632 - DNA, 725 bp, Oryza sativa
aggacattgcccacctaaaagggggggaggggagggagggtgaaaaaagaaccagaagagaaggaaaaagaggggttctagagcttgaactctcttgctctccatttgctctgtaactccttcacacacagattcaccagaacacaggagtagggtattacgcttctcagcggcccgaacctatatacatcgcccatgtcttgtgcatttgctctctcgcgaacgttccacagatcgagggtgaagaacctcactcagcgcccccggccgaaccggcaaaggggggcctgcgcggtctcccggtgaggagccccacgctccgtcaactagatatcttaaacgtcctagatttgccgcgagctcagccgatccacgccatcgaattttgcataagagcatcctcaatgttttagatcaactgagccataagatgagacccacattcttatattgttttatctatagtacatgctacaatgtatgtggtagcttcttgaccttaaggtgggacccattgagtaaaaagacacatatttactcaagattgaaagtgtgcatgcatgttgcaaagccatgatatattttttaattcttatggctagccttaagctaaggttgcacatagcactattctctccctagctcatctcccaatgtacaaaggtacaacaaaaattactactttattccttaaggttagtttccatgcacattatggttgccct

SEQ ID NO: 57633 - DNA, 2134 bp, Oryza sativa
ctctgagacaacacctaatgatgttacagcagcctcacgatacttgggattaatatgacgaaagctcacagaagcaaactcaagaactggtgggaaacatgtctcggtaaattgatagccattgtatcaatgacttctgcagcagaacgatctgctgctagatcagaatctccatcttcatcagctgtttctgtaagcaaggggcacataacttgtagaataggtattaccagcttatgttttttcaagaaagatgctttaaattttacaagccatgagattatctgtatagcctgaaaaaatgagtgcacatttgaaatattagcagtttgtaaaatcagacggatgtataaaggatgtggctgactgatcaaacctgttgcctaatatttatttccagttcttggtttgagcaaacttcaagcgaaaattgtacaattgatctcacagagtccccaagaagtggggcaggggattcaattagttcatcaaatatttcaaaagcgatggaagcaacatcttcctctccattagcaaggcactgccttgatacattcaagatactaggaacaaaatcccgaaatatttttacctacaattacccagtactaattagttaaacagtatactctgcaacaaacacaaaatcaaaatttatggaaagggctagaggcaagattaaagagcacaatgtgaaaacagctgacacttatgatagtggcctagtgggcagtgactcttgaaaatagttagctgcacatgatgactaagctatactctggcatcttgctgcatgtccagttctacattttcttttctggggcacacagctattgttttattttcttttacacaggagaataagaaatagctcagtgaaaccacaaggatcaaaatgagattaggtggattatcttcaacgaatccctccctgtaccttgagctgaatgtatggtagaagtttgatttgcttttgtagatctattccccatgtgggtatgtctagagatagcagggtattatatctcagactaagatgatgctaaggaaaacaactgctctaaaaacttacaaagttaacaaattcaagagataaaccactacagtaatgagcaaacaaaacaagcaacccaagatgagctgaagcctgaagtgtcactttccaaaagaaaagggcttttactggaaatacataacaaccaggaggttaaaaattcatgcagaacaatagcacatttttcccatagaaagaaaacataaacacagaaatatctgtggcggcaggaaactagaaaaacttacaacatcacccccatcattaacatactctatgaaagatccaacagccctgttccacagaagacaaaactcttactcacagctaagaatatcaaaccagaatggtcagaatagcatgattaaacttagcatactttagggcagcaattctgacacgagagctagcctcgtcttgcaggcatttcagtaaaataggttgcaaatcattcagatgagattgaaaagtagttccgatagtttcagtaagggaactgaacagtatcaaagctacctgttaagaaaaaagtgagcgagtaagcattgacattatccaccaaaaaatgctgcaggttatagaactaggaaattggtccggatcatcagacttgtcaatatcaaatattgtactattagtatgttgctaaccaaaaaaaaatacaacttttatattcttatagcataaatcaagttcataaatttataaaaacagacaatgaaaatgtaaagcacaaaaggctcttcttatgtttaacaacaatatgattcaaattgccaattctcaggttgattctatggtcctagacaattacgtagtataagcatgcataactaaacataatatcggaagtaacacaagtttgataagaacactgaaactcgggatagacttacttctctatgatcttcctgtggactttggctgcattggaaaataaaaggtaacaactcaggccattctcctgcagggacagcgtacttagctataatactcacaacatttgcgctagctcgtcttacaagatggctgcataaaagtaagattcagtctctaacagaagtacatgtcaaaatacga

SEQ ID NO: 57634 - DNA, 8856 bp, Oryza sativa
ttttttatctggctgaaccaggtattggaatgggctgggctggaattgaactctagtttggaccaattttatccaaatagactccgaagtctaattctattgttcttactactggactacggctcccatcggatggcctaatcaaccaaagaaaaagctcaaatttaaattttcaaatttaattttgagattgattttgagatattttcaacgtagtttctttttcagcattggtttttaagtcacaaagaacacatatataaaagttttacctataaatttatttttaggggaaaagccaaacgatggtgcctgtacggttggttatgtagcaacaaacagctgataaaaataaggaaacgttagtttttttataaacttctttcttctaattcattttctaaatcatataactacatattctcaaaatttagctgagaatctaggcgagctgaagattttgaactagacctacagcacatgctctagctaaggcgtcacatcaaaggaagaatttacacgaagattatattattttttttagaatatcatataaaattcgtgcgtaacaatgaattcttcaaactggacttcagacttttttatcgataaactgtaaaaagaaaaaactcaaactagtgttagtctgttagatatgggtccttctcaggtttcccttaccgtcggtaaccgcggggtacgataatggttactagcggtagagtttggggaatttttttaccaaattcaaagtttttttaaaaaaacatgaatgtagttcttgatttttagtggcaggtggtgaagaatttttatttttgaaaaagagtaatataaaatcaaatttgagggaaaaactaataataaattaggaaatggaaataacaaaaactattggtacttaagttgcactgtgcaactagtccgttaagacccgttagagaaaaatatctccataatataggaaatgtcatgccgaatttttatattttacatttaaacgttaggtttgcagttatcctatatattattctaactatccctaatctatacatttaagtagttttccaaaaaaaaaagcattgttctgtgttcagctacacaattaatgttaccacacaagtatcgcagttaccgcatcaaaccatgcagtaatcgtgaccaaaccaccgttttttaattcaaatgtttaccggcaaaaatcacacggttttcaacggttagcgcggtaaccgtcttactgcagaaggcgtgcgccaactccctccaaacagtaaggggaaccgaaaccctggtccttctaaccaactctatacaattgtactatcaaaatattttactcacttgacccacggataccagtttccactgtaaaactggcaagcattttagataatcttttgagtgatccataaattgaaacaaaagaatatatcagtttaactgatttcacatcggacaccttgacgattgggtgttgtttgaatttgacaaaagacgtgaagaattctcatcaataaaaggtagttcatgaccactcgctctccaggaacaggagtccaggtcgaactaaaaaggagactgcacggtgttctttcctaaacgttaacaatgacattgcaaacataaacataatctcaccaatatagtaattgcaagttgaacagtacacacagctcaccttgttacagcttccggtacccagcagcacagctcgcgctgtcacctaacatcaggcaaggggctcgtcacgtatagggtgtgtttacttcatgaaaaaagttataagtttaaagaaagttaggagtttgtaaaaaaagttaaaattttatatgtgtagaaaagtttttatgtaatatgatgtgatacaaagttaggaatagggggcaaactaaacacggccatattactccaatttagttgcagctttcagtaccagcagcacaggttgcacagctcacttctgtcaccctaccatcatgcaaatcgcaaaggttctgatttctcaaggtttaccaacctgccatctcccatgagctgttttccgacgagtacggaagtacgggctgccgcgggctgcgacgtgcacccgttagatgggctcgacgtgcccatgtatcccccggctcgcgacgccgccgcggcccacccacgattcgcaggggcggaaatccacacggaaaaccccgtcaaaataggcccatccgccgagacgatcatgcaggcgaggcgacgaccaccccccacccccacgccgctgccgcgtgccgccgcgctttttatacgagttccagctccgccgcgagtccgcgactgctgctgctactgctactaccctagcctagtagtagtactactactgctacttcttccccggtcgcggccgcctgcctgcctgacatcgcttcgcgtgccaaagccgacgcgcgcaaaagcaaccaaaagcgaaagcaagaccaccgcctgcttgctgctcggtctctcactctcacggtctcacctcctcctcctcctcaaagccagccattcgtctcctcgtctcgtttcgtttcgcttcatctcgtcatcgatgcgctcccctagaatgagagaaacctaggactagtactgcgtcaccatagaaggcgaatcactactctgccccggatcgaccacccacgccgccgtgattgggagaggagacggacgcgcatgccgccgcagcagggggagtgctgccgccacggctggctcggcgtgggggaggccgcggtgggcggcggcggggaggaccgttctacgtgccgtgccaagcggctgtcggtggacggcaaggcatccacggcgccgcggatatgcatctgggagtgcgacggcgaggccggggacatcacctgcgacatcgtcgccgcgccgctccgccgcagctgcagcgccaaggcaatgccgccgccggccccgctcttccggatgatgacgccgccgccgccgaggccgcagagaggggacggggaggaggccaggaggcccggggaggccatccgcaaggggcaccggagctacagcctcatgctcaacctgcagcttggcataaggtgataccaattgctccatccctttctgctcctcctcctaattcctcaaacactctgtcccaatgtttggtttggttttgttctccgtgctgagctgcagctattcggtggggaagtcgtcggcgctgccgttccagaagctcgccgcgtcggacttcgacccgcgggagaaggtatggacacggttcccgccggaggggtccaagttcacgccgccgcatcactcggtggatttccggtggaaggactactgccctgccgtcttcaggtgccacattgcgtcctaatccatgaactcggagaggaattcgttgatttcttggcttctagagtgatgtgattgttgggcatactgctgctgagtgatgccaggcacctgaggaagctgttcggggtggaccctgcggagtacatgctcgccatctgcggcaacgacacgctccgggagctggcgtccccgggcaagagcgggagctgcttcttcatcacgcaggacgatcggttcatgattaaaaccgtgaaaaagtccgaagtgaaggtcagttcatgttcatctttgagataactaggcagttgtgggcatcctccaccttgtattgtcgtggacttttaaccggctttgcctttagcttccttactggactagtcacgttttaattgcattcttcagttaactttctactagttatgtacctggaagcatcacatcatggtcatttcaaactgcttaaacgatccttttctatttcattttgcaacagatgtctatttcctataccaagatggttagaattattgcatattttattatccacctaaaggagttattccataatataaattataaatccaggttaatacattatctaaaaaaatatgggtcaataatgtaaaggggcacatactagtatcacatggtgagtagtgttgtcttactcgtaaacatattggtccacaggttcttatccggatgttgcggagttactacgaacatgttcgtcagtataagtccactttactaacaaggttttatggcacacattgcattaagcaagctggctgccccaaggtaagcgacaattacatgtggatacataactcattttaactctgttaactgttgttatgtttgaatgtacattatttcctccctaaacttatgtcagcgtatacaactaggtccggttcattataatgggcaatttttgctgttcggaatataagatccataggcgttttgatctgaaaggttcctcacatggtcggactatcgacaaaacagagcgcaagattgatgaaaccactactctcaaggacctcgaccttcagtatgcatttcggttgcagagattttggtacgaggagcttatgaagtgagtttcctgctatgttaacacaaatatattgtctgcaatttcatttgaattgagatactaattgtaggtctgatccttcatgtcacataggcaaattcagatggactgcacattcttggagacacagggcattatggactatagcctattgttaggagttcactttcgtaatgattactcagtgtctaaaataggcatatctcagcacatagctttcccaagtaagttatagcacgggttgctgttggtgtttacaaaatctggcttatgaacccagctgataattcaccagctttgatctaatcttagctgcatccctgatcagaatctactggcaaaagaaaatcatttgaaggtggaagcagtttttgtgagctctgctttgtggaatcaggttgcaaagacagagatttgatagactctcggtaactcctcacttcttacttttcttgtgaccgtttgcggtctaatgtgtgcattccaggaatagttgaaataccttttaagctgttctgtaataatcaatccaaatcagttacagcttggtagatcaccttaaacagaacaatgtgacatctattgcccttttcaggttctagtaatccttcacatattgtcaaatatattttcaatatatttttaattattaaaagctactctgttcttctggtaacttctgactgtagctcattagttgtttgtatgcatcttgacaattttgtagcataagtggagttatttaatctgtcgttgacaagtagttcatgctcctactttagtttgggacataatgctaatctccaccagtgtaaggtactttttttctgttgcatttttctaaggtaattttgtgttttctcatcatgatacctactttgttgctcccttcgtagacaacaacgaagaagcatcatggggccttgcttgtttgtttaagtgaaatgtttatataaagagagtgaataatatatggaactttagttattgcatctcatgatctgaatatcaaatatagaaactttttatccgttgggctaatgcaacctctgccttctcatatcaggaagccattcatccagttgggaattaacatgcctgcccaggcagagcgcagctcaaaaaaaatattagataattttctcctaaatgaaagacacttgttcataaccccaccaagtggaggatcatgtgatgtctacctcttctttgggataatcgacattcttcaggactatgatataacgaagaaattggaacatgcctacaagtccttccaggtcaaccctgactacatttctgctgtagacccaaagctatactcgagaaggtttcaggatttcatccgcagggtgttcataaaagagcagtaagaaaaagtcattgggttcaatggtaactatcccactgacttcttacatcatgagatccattggtgaagtttaggctatgatcgtattgccaatcccgagcatgcctgaaacagtgaaaaccgcaaatgatggttggttttaccatacgcacagtattctgaataattggggtcaacgagctccgccgacacgcatgctaatatcggatggatgggagctaaaactatgtatagctcggccttttggaagacctgtaaaccgtaagtgtcgaactccatgattgcaaagctagttagttcttccataccactttttttcatttcctttttgtgttctttctttggcatctccccaagaatctgaagtttttatttgcttcttggggtgctgtgctgaatagcatgatcttccaatggagtgacccgatggaaatcagctatttgtacatgtacatatttgtcgtgtatcagacaaattattactatttacaaactggtgcatcctgtcaaaatctaaaaaagaacgaggatgtccatcttgccttcgataatatttgcatcctaccttttgcttgcagatgacaatttccttggcagagctgtatggctgggttttcaagtaatgtcatgttcatagttcagaaaaggaaaagaagttgtttgctgtagacattgttgccttctttgcaagcatttgcagcttatctttcgctcgtgcctgcctggtgtgaccacagtcgagagaaggcagtgtcaatgtgtcacttgtacagttgtagtactcctccaccattggccttgtgaactgaaggtagaaataaagcggaagggaggcgacaggcatcaaaaggagagaaagcaggtgcagggaagatgctgggacagatctggtctgctcctgtgacttgtgtctaaacatttttctctcctgtccttctctctgcattacctggccttttctcggctctactttgtttcccatgccaaggcctctagtccatttctccttctccatcctgtgctctttttttgcatgctttgctttgctttgctttggcctggagtcatgcatgactggtaggagcagaccaggtgagaagaaattcagaaattacggggctgaagtgtgatgcatgctgctttcacgcatgactcatcagatgcagcaatgcatgactgatctgactctattgtggctgtaaaataggatgggtactaattgggtaaatactaaggctctgtttagatctaaagtttggatccaaacttcactccttttccatcacattaatctgttatacacacacaacttttcagtcacatcatctccaatttcaactaaaatctaaactttgcgctgaactaaacacagcctaagtgattgtttctttttacaattgccattacctgttgatgtggagtatatttggtgcattcacgcctgtgtttctttgtatggtatttcctgtctcagtgtttgttctgtggggctaacggttgatggaccagtgttgatcggctctgagagtctctgagatgagactgtcgccatggtcaaaaagaatttaactcgtatatcaaggttggatctctcttgctcagaaaaaaagcataatctatctttaacctttatgactgcgcatctgctgttactctggagttgaaaacaattcacggtttgggcaagtgctgttaatattttttttcttcaaaaccatagagcgtaattcctccttttcacaatgtaagactttctagcattgcccatattcatatagatattaatggatctagactttctagtattgtccacattcatatagatattatgaaacggagggagtagctttataaactagttaccaaatctctttctacaatggatacatgaagatgacggataagtatgtgcagaaaactactatcagaatttcattgctttatcatatactccatccgtttcatattataagactttctagcattgctcatatttatttagaagttaatgaatctaaatatatatatatatgcctagattcattaacatctatatgaataaaaagtcttacattgtgaaacggaggaagtaggagtatcttagaaactatctagtgtccaagaatatcctttaagataacatgctgatgttttttttaagataatggataatccagccttttcaccacgttaatgtgtctagataggtgtttttttttacaatttattgaatatttttaaattctcaaatatagaaagccctccgaaaacttattttcaaatttaaaccttttactcacagcatcctgcttggcatgacgggataacactgtcatgctataagcaatgggcatgtcactgttctcctgtcattctagtctatctgtcgtgacaaaaccctcgctacgttgttctaattggcttggcaaaaccgtggtcaaattagtttgagttagattgagatagctcactcaaccgtacagttttacaaataaagtttggggcaattgcaaatttaccactactttaaatcgttattgcaaaactgccactagaaaattgcaaaaataccattagaactgtcattcgagtggcatccttgcaatattgaaaaaaccggtggcaaatttgcaaatgccccataaagtttttggaggggttcactggtggagaaaccatctttggtcggtcgaccaaattccacaatagtcccggatgcaataaaaaccgggactaaagatcatttttagtcccggttaaaaaaaattttatctaccaaccgggactaaagatcatttttagtcccggttcaaagaagttggtgggtcgagtcaggctccaattacaaccgggactaaagatctatttttagttctggttgtttatacaaaccgggacaaaaatgaactgccgagccgcgcgcatgccgctaccctctcctcggtacccggtacccctccctttttttctctccttcattaagactccctctcctcttccattgtttcctcggtatcccagcctcctctcgcttcat

SEQ ID NO: 57635 - DNA, 3483 bp, Oryza sativa
acgggggacggcggccgtccgggacccggtcgggcggcgacgcccgtgcggcggtgtcggagcgaggcggccgcgcggcaggcggccgtgcggcggccggtggggccgcgcccctcgacagcgggcaggcggccggcggggccgcaggtggcgaccggtggggctgcgcccagcaacggcgggcagggggccgacggcagcggcagcccgtattgttttttttaattatttgtgatttcactgatgtacttttggatggataattttgtgattcgttgcacatttgtatggatctgtgatgtatttgatttgtttgtaatttttataggatttgtgatgtatttgatttatgtgtataagtaactttgatttgtgatgtagatttgagatgttactttgatttctggattgggggtttgatttgggatatgtatcccatttgatttgggagaaaataaaaaagaaaaaaaaaaaaaaggggaccatctcactgccgcaaccctctctttagtcccggttgataacaccaaccgggactaaagatcccctctctttagtcccggttggtgttactaaccgggactaaagatcgatttttagtcccgggtatttgaaccgggactaaagatagcgatctttagtcccggattggtagtcccggtttgaaaaccaggactatagggggttgcgaaccgggactaaaaagcacttctccaccagtggttatttttaaaaattatttttaaaaaagaggtttagatttattttaaaaaaactgtagggttaagggcttcctcacccttttttatcttagtgcttgtcttagattatgggccttagtccaacctatatttttaaaaataatgtttgttaatttcttggaatttggttgtctcaggtttactagacctaacatgatccaagtttgatgaaacgaattgtacaacaagcaatatcgtctgaactactacgggtgacaagcgatcgtggaaaaataaatgaagcaacaaaaaattatttataggtaagaattttatatttgttttcttaatacagaggggaacatcagtaaagggaaagaaaaccatagcctgaactcaaatagtcttaggccctatttggcacatctccagttctagctccacctattctgtagctggagcccaaccaaatagttttaacttcaccttaaacgggagtaaagctgggtgagacgctctcacaaaaatgatctataggagcggagctaggggttaggctgctccacaaccacaactacattttagactcaactctttaagctaaatttaggagtaagctaaatttaggagttggagttataccaaacaagtccttacaattacacctcgtaacgaccccaccttacttagtaaggaccggtgacctagcgagcaaatcacggagcgtagaagcttagccaaacaccaaagtgcaattcacggagcaaatcactttttatatttttgttattggaggttttggaggtttagaaaccaatattggaaaaatataatgtgatgaagaagtccaaaattaacactaaaaattaagtttgtaccgtctgagcttgatgcatcacggcatgctttccatgtggatgacatccgaaagttttttaacagtcataggtctttgatgcgtggagaatcgtaatgtgtgggacgcgctgtcaatgataccaaggcatgctaaactaatattttggtatagatagaacattttggaaatcttctgcaaccagtcatgtataagggttccgttatacttactccctctttctcacaaaccaatctcgtacaaaatgtcacacaaaccaatctcgtacaaaatataatatattttagtataacaaatctactccagagaagacataaggatgtccggtgtccaaattcatcgtacgagaatgtatcccatcttatacgagattgatttattttgtaacggagggagcagaaattatcagtagcatataagtattgaagaatggactattgttttgtactttcgtatcaccacacttactccgcaggtttagaaattctcccgttaataaataaaacaaaacataaactgcaaagatgattttgttcaaaatacgattggaaacaaaagttaaagttgtatatggaatccaattatattttaaaactattgtatagaaatagtacaatatatctatgaaaatactccctttgtactaataaaggaagtcgtttaggataatatttaagtcaaaccttggaaatataaatcatgaataactcttaagttgttgagtttaaaaatataaaaattatatgtatagatttgtcttggaaaatactttcataaaagtatacatatagcacttttcaataaatatttttatagaaataaaaagtcaaagttgtgttttggaaatcgtgtcgttgttctaaacgacttcctttacaagtatagagggagtatatggtaagagctgtggaccattttaacttttaaatctacaatatataagttttaagtatatttatagaatcaaaacataataataaaatttgtatatcaaattcaattatgcttttacttggacaatccgctagttactttaaacacagatgacgtgtttgagtcggtttttaagtttattcgcttttggaaatacaaatccgtgtttgagtcatgttttaaattaatttgcttttataaatacataagaagtcatatacaaaatttttaattaaaaaatttttgcatactaacttgttatgatcgaacttctaattgtagttcatgattttattaaaaaatatatattcaagcaaattctaatattaaattttatcttaactaaactatataacaataataatattaaaataaccttcatctattacaacacgtaaaggaaagaaataaaaggaagaaaaatttgaccccagcgcccaaatctcacccgacccgacccaactctggtcttaactccgacgcccgaactcctaaacccaccccgtgcccccgccgtcgtcgccgccgccgccgcagcagcagccttcctccaaatccgcgcgcctcctccggccatggccacagccagcgacggcagcggcagcggcggcgagcagcggcgcctcctctccatccccaaggagggcgagcgcatcatcgcgccgacgcgccgccccgacggcacgctccgcaaggccatccgcatccgcgccggctacgtcccccaggaggaggtcgccatctaccagtccaagggcgcccaggtgagtccacgccccgccccgccccaatcatccccacactttgctctccaactgaagaccgcctctcatggtgcctgctttgttgcagatgaggaagtcggggcccgacgtgccgccgggctacgacccggcgctcgatgctaagcccaagacgaaggcggccaagcggaacgagcggcgtaaggagaaacggcagcagatacggccg

SEQ ID NO: 57636 - DNA, 3194 bp, Oryza sativa
ggtgaaagattaccttaaattagaccttggctgtaaaaataaggaggagcaatatctcaggccagagggataatacagaagaagtgctaccatcaattttatcattctgaactgtctaaccagcaatcacaatacttttattggggtacttctgttgatactcacagttggggtaaatgtagcgcatttctgctctccacaattacattgactaagtagggtcttaattggtctactgacacatcttaatgccaacagcccaacgatacctgtagcatgttccaagttattgctgaatttacgcaattaaccaatttctgaaatgtatacaagtcactggtacagtcagatttctggccagtcaggtgcataaaaacttgctatgagatgagaagagacatcttatgagaaaaatttttgtatgcttcagaatttccatagaatacaaaaccagcagaacagagtcagaaaaggattttttttagccatctcatatttgaactaaaatgcggtcatgcctgtcatctcaatcaataatcatgataatctggcaccgacacctaaacttggaagaattgtcaatagttgcattattgtacctgtgtattcactttttttttatactcaagctcatgttggttcacaacttcagacattagaagccctgggggcagctctagtagtatgttcagtgatccttgactgttgttactacagtaccaatttgtttcctcactgtttctcaccatcatcatgattgcatttctttcttggttagtaatgatctggaggaaaacatggggatctaccaaatgaataatatgttccactcctttcgtccatggaatgtaactgtgttcaacttcaattcctgatcgcatgttatgttctaactttgttgtctgcacaatgggttatcttggtaggttttatttggccaagtcgtctcatgaacccattcaaccacaatgacacaattagaaaacgggtcgatataggaagcctctacttgactattaagcatgaatgaacataaatgccatggtaaaggccagtttttttgtgttatagcattagctcttaggtgcgttgatatgaatttgtacataagttttaaagagtcagcacaatcagctattcatggcaggcataattatggacaataagagaacaaggttcttcataaatcctctatctgataattgggtcaacagaacagtgtttgtttattgtttgcctcatgggtgatgattttatctcttgtagattgagctactggtttattagagttgctttatgatgttgtgctgggcattctcttatttcttagcaggccagtacaacaaatgataaaggaaagggcttgcatatagaggatgatgcaggagaaactgacaatccgaaggatgcagtggacagtgtaacaaagcagataagtggcattgctatttctgaatctctggttgtcgcaacctcctccactgatgctaccgacaactcaaaatcggagtcatctgctccagacatagataagaaaattcgagcactgaagaagaaggttgtcttcctctctccctccctccctcactctctctccagttcatagtttttctgggggacctgagcctggtaggttatcccgaagttcccaagtaatttttgtctggtttctggcataaggcttccaaaatttcaagccatttttcattttctgcatagtactcaataattaagttgtatgcctggaaactaagttacacaatcaatcttaattagttattacttggtctaacttaagataagcacttgtactcaattttatcctacattgtaattttataagcacttgtaatcagtttttcttcttgtaagtttaacttattcatggtaactgccaagaatctaatgtagtagtaaccaatcattgattttatgttcttaggacatctcaggtattcagtccatgctttcaacctctaggagcaggcgagcagccatagtatatgttaacagtgctattttgatctgccaccatgggactaaattagatctgacctggataaatttgtcttgatttatcacagatacgcttagcagaagcgcaagtgcaaggagatccagaaaatttgaagcctgaacaactcgagaaaatgaagaagatagaaggttggaaagaggagctgaagcttttggagaataagagctctcctgctgcttcctagacaatgtcgacctcagcactgatgttgagtagagccatcatatatcgaatgcctgcctgctgtgatgttttgctgatccaaagtccaatcagtcattgtcttgcttgtcttattcccctcggcctctggaaaaagcaatccaattgatgtggggtttcacacagagtggtagctttttgccacaaattgttgtctcgtgtacgtcctccagttcgaagattcgtattgcaaaatctgtttgtcgtagacatcgtgcaatgagacaaccgattggagttggggtatgtgacggtgccattgtagctttgtatattatgccaacattggcaattcctcttgacactggatttacttctctgctgatccagtaataaccgtacaaatttaaaggccacaggcctcattgcatcgacaaagatgacaggcgagtccaatatcctgatccatctttgaacattcagcttatatggtcatcgtggttttcttctggtcatcgtggtttgcaaagcaataggaaactggcttgttttgggttatatagctagtatggcaagtctgcctgtttggttctttgtacttctgatgaaaagcttaagttggaaatgcattttatgctgtgattgatttcgtattctggactaaatattcacctatgggcattgtgcaacgaaacaaaattttattccatgccttttttagcgaaaaaatatcactccattgatgttccttttctccttttattcgttgtttttttcttggaaatatctgctcatgtgatagttaagaggcaacacttcacgacagatgttcaagaaacatgaactaccgttttaagggttgaatagtaaaagccgttccgctttatactaagagcacccgcaatggtaaagtaaggtgctatctataaaatatatacatctcaacaataggctagattaatagtaaacaacttcaatggtatgtctacatggg

SEQ ID NO: 57637 - DNA, 3751 bp, Oryza sativa
atagacagagacatgtaaatatttttttcccactattttttttgtgaattattttctgtccctcttcttttgtgaattacacgcaagtcaaacaacgcgtaaaaactgagaagtgatcgtcaagacgccaaatgccaatcgcgacgtggctgtaaacgccaaactgccaactggagaacaacaaccaaccaatcgtagcttttcctttggaatacccgtaccactgcataggaatcgttgatgagctgccgtacaccctttgttctaacaagaagacatgcacggcaattccaacctaagctactgtcatcggaagttccaaagtttggcaaagcacggcatatgatggcaaagacaaataaatcaccaccacgaacatgcatatttacatcgtcagttcctacttacactcatgcgcttgaatgcacatttaacctattctccgggctgaatattagccgctgactaaaccacgacatatcccctcgcagcaaactatgagaaagaatcaacaaatgaaacgcaatggttggggttgacgactgtgctgttgacaatattgcttcccggtaacgaatcgtcctccccggccagctccacatgattagcagaactaatatctgcaagagagaatatgcacgccagtcaaaagtcagattaaccacgcgctcaatgtcaacctagtgcgccacaaccgggcagctgacggtaacaactttgtattatatttgatatggacgaatctgtgttccggcgatgatgtgtgaaaatcgtttgcccaacttttcttacgaagcaaaacaattgtgtaggaacagtttaaatatttactatttttgcatgagtggaaagcaagttaaagaagactaacttaccattccaccgatattctgaagccgtcctcaattctatccatttatgccgcgtaccgatgaatttgagcgcgaagatgtcctcatagaccttatcgaccgcattgacctattaacgaaaggatgctccagcagctttgctgcagagggtctgtcttgcggattgggttttacgcactggcttataaaatcacgagcatccctagaaaggcaatttggaattgctggtggttcccccttcccaatcctgtataaagcttgtgtctgcagaacaagttgagaaaatggggtaaatgcaaaaaggaaacaaagtaatatgcatactggataattatcaaacttggaaccaacaccataactgaatttggaggagctaaattagattcctgatgaacaataactcacccattccagaccaggatagggaagttgacgtgtcaacatctctaggactgtgcagcccagactccatatatcagcttcaggtccatatgttgtcttgggattgacaacctgaaatttcatcattatcttaggaggcaactacaacattatctaacatcaatgcattataaacacatttttggctttttacctcctacctattagtttgttattctagataaaccatcaaaataaaagaaggtaaacaaatactacctctgtttcaagttataagattttctagtattgcctacattcatatatatgttaatgaatctagatatatatgtgtgcctagattcattaacatctatatgaatgtgggcaatgctagaaaatcttataatatgaaacggaggaagtaaaacccaagcatgtccaaatctaatctaatagaaatattgtgccatacctcaggtgccatccaataaacagttcctttgcacgatttaagcacgttgaatttggtaatctgagagatttgacagaaatcaatcatataaatgagataaattttaaaataataactgaaacattcaaagattaaaaaggaacataaagatttcgcgagagtaagcagacctccttagcaagaccaaagtcagcaagtttcacggatccattggcatgcaccaatatattggcacatttgatatccctgcaagacgagatttgaactgttattcacttattcagaataaatgtacagtaccagttccttaagaatcttcaagctaacgataaaaatcagtgagcaggcattaattagaataactgtcagctgaagtgaaaaaaaaaaacaataagcctccttagaaggctaaacagcagatatgctgattcaactaatgttattacctatgaacaatgtttcgctcatgcaggtaagtcaacccattaagaatctgtcttgtatatgctgaaacatgagtatctcgcagtctgtacttctgatacaaagatgcaagagatccttgggtgactaattcaaggaagatgtacagttttgagtcctcctgcagtagtcacaagaatggttcaatatgagccttaaaagaaaaaaagtacaagaaaactagaaatttacatacagcccaatagcaaatggtgcttcaacaaaatgatgaatggtcgatcaataacttactttgtcggtaccatagtactgcacaatattttcatgttcaaactgactcaaaagtgcgatttcctaaaatatgaaaagaagttaggacagatcacatttacaatacaacagaaccagtaagatattatagccctgggccctggcattattgacaaacaaaaaggaaacaccaacctgctcaagctgaaaaatgcactgctgtgcattgctcccttgatcacacaagcagacctctttgacagcaaagaagacaccttcgctgtaaaacatcaaatcataagatgtcgatatcaactattccggcatgtaagagacatgtgttatgcaaacattacagcagcctatactaagaataactgttgcaattgaacaccacataaaaggaacaacaggtattacaatgattcatttaggacagccagttcatgtgcatcttctagaagctaagtttcacatgtttcagaacccttagtgattaaacatatgtttacatcatgtcatattgaacacaacaaatcaaataaataaagtactattacattcaacattctgactctagcggaattctgattgtctacagcgtagggttatgctattcaagtaactgaaaatgaaatcatgttgatgattcaattaccacttactagtaccctacacgccatctagcaactgtacttaaagagatataattggagacatacagtgtacaatcaatcagagaatcaattttcctaaattcgggttaacaatggcttccaagatatgccttatgctatcttagggcaggttaaattgttgggtctcacaaattctcgaccacaaagtgaacaatcagcatatagaaatcataagcacaaagtgaacaatcaacatatagaaatcataagcacaaagtgagcgatcagcatatagaaatcataaaatttactctttagagcacttactcgctgatcccctcgaagactgtcccaaacgagccacttcccaggagcatcccccggttccacgaccggatcttcctcctaaacctcccattcggcgagatgtagaacatggactcggtggttgtgctcgacgtctcgtcatcgttcgtcgtcgacagcgaagacgtgcccgtgaattcctcggacgtctcccctagcctgagctcctccagcgtcaacaccgcggccgcatcatcctcctcctcacccgcgtcctggcatgcggaatcaccaccagatctgctcgccggggcgtgagcatggctatcctcctccggcgcgaacgaccgcaagatatcccacgt

SEQ ID NO: 57638 - DNA, 1803 bp, Oryza sativa
taataggggcgctggagcttcaattgccacggacttgggcgtttccttcgccgggagcacgggagcagcggcgggggcgggcagggagggcggctcctcttcggcggcaacctcgcggcggacaggagagtccctcgcggggggttcctcgcgcggcttgggggtggaggcggaggaggagaaggaggagcggccggccttgtgcgcctcccagtcagcgacggggacggcgaagtcgtcgacgccggagaggccgaggctggagcagagcagctgcacgtccctgcacccgtcgccgctcccgccgatccggaagctcgtgaggtcgagggagcacgccggggagcaggcgagcgacggcgacccggacgcaggcgcggacgcggcgggcggggactgcgggtaggcgcagaagttcgaggcgtcgtatccgatgtgcttcgcggcgttccggcgttcgagccggcggcgccgcctcgacgagcccccagacgacgacgacggcgacggcggcgcggcgggcggccccatcgtcggcctcagctcatggacgagagagagaggggaaggatggttcgtgataagtgccaagcgagcgagactcctcttggcttggctttgggtttgggggagaagaggagagaagagaagggaagacggcaagctgcagatttttattttttttctccgtttcgcccactagctttggcgctgaggttttgcgagtattttttgggtgggtggggggcggagagggggagatcggatggcgctgtcgcattgacccgcatcttttctggtgcgcgcgcgcgctcgcaaccgcggacagatcggccccacgcgcgagcttggcgcggcaccgcagccgcggctttttgcgcttttcgtgcgttttttcttgggtccgggcggcccggaatggctgcggtgttggcgtgcgctcttcttctactctatccctggatcctataaaaaaaattaacttaagcgtcagatgtgacatcttctaagagcatgtataatagcagattattagtcagctataaacatattttaataagataaaagatgagagagaagagcagcgggttatatatctgtagccagctgcaacacggactccaagacgcaatgtatgtatgacaggtgggaccatatattaatagtgggctatactattaaacttgctctaataacgaatctgaacatatatttatctagattcactctcctaggatacgtgacatctaatcctagattattatttttttggacggagggagtactctctactatagtgagtttgagctggaacagtccggtcgtcggggactcggggtgtttgggcacgtgcctgcgtgttcttgccaaagtgaaacaacccaatggtatttcattacgtgttagcgtatgagcgtagttagtcgtatacatgcggggcagatatgcacatagcggacgatttttcaccttgaaattgcagacgctttatgctttaacaccgagtttcggttctgccaaatttactggatccggatcctctgcattttgaaatgctaaagcaaggttccacggtgttttatagtagtacttgggcagtaagatgaaaaatcaaatcaatataggtcgtgtttagttccaaaataattcttcaaactttcaacttttccatcagatcacaattttcctacacacataaacttccaaatttttcgtcacattgttccaatttcaactaaaatttcaattttggtgtgaactaaacacaaccatagtattgtagcatcaatattttaccttacg

SEQ ID NO: 57639 - DNA, 1791 bp, Oryza sativa
  unsure (1)..(1791): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccgaagacagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatcaagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgccccccagcaagcttagggatgtgcaatgcgtcaccagttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctatgctggcttggcccgggagagagcagggaggagaggcccccgagccgaacggtggcccaaggcccccgacgaccggagttggccctttgcccgcttgtcagacgacgccaggagcccccgacccccaggacggccccgaggccactgtgggaaggc

SEQ ID NO: 57640 - DNA, 1393 bp, Oryza sativa
  unsure (1)..(1393): unsure at all n locations
tcgccagcgctctcggagatagccgggacttcaacggcttcccgaggagctcgagaggacgattaagtcatcctcgagggacctcgcccgaggagcggtggagctcgtactggcaagttaccaagccagggatcccgacttctccccatggacggcgctggacgagttccctcccgggaccgaggacggcgcgcgcgcgcaggtccgggacgccgccgaccatatcgtccacagcttcgagggttcggccccttggctcgcgttcgccctcaattccgacgaggaggacgatgacggcggagtgggcgacaatggcgacgaggctggcgacccgggtgcatcggagtgagcccctaggcccccgccaatctttaaatagtttcttcttttcttcttccgaggccttcgggcccccttcttgtatagactaatttaatctgcaatcaaataaagaggaaaattttttgtgtcaattctatttgttgtgtgtatgagacgaggatggtctgtgccgcggtccttttgtgtcttggcttgaacaagggctcgtgcccaggtcctagtcctcaaatggctcgggtcggggctagtgcctggggagatccacatgtcgagactggccaggccgggagcgtgatgaccgagggttatgggtgacccgattgtgggtttttgccgattcccccccggagttcaccacgccccggggcacggctcggttctgggccccgtttggcgattttagccgacccgagcccccgaggcaggattgaacacgagtgacctatttcaagtcaagatccttcaaaaggaaacaacagcacagatacagcctttaggaaatcgaaaatgcttttattgaaatacagatataagagaaataagaatatgcatatgtggtagtccccggccaaccctgcacgcccgaggggggtgcggggttggcccgagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57641 - DNA, 719 bp, Oryza sativa
ttcgccgcttgcgccctaactccttgtttcctgtgccctaccttcgccacacgcgctcgctcttaaacatctcttcctccggcgtcatggcacggggctccgctttgcttgatggtagcgtgctgccgccttcccgcatcgtgagcgagaggcaggccgggctgccgcgccgcttcatgccggaatctgccaccggccgggagatagttacgctgggcgagggacgcccggcgccatgctacccggggcggtccgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagtcggtgtcgccgccgtcggtggttggtggctgctacttccagccgcgggggctggtgttgaaccgctacattccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgccgtcctcgaccgcctggcgggcctgcgatccctgggg

SEQ ID NO: 57642 - DNA, 2453 bp, Oryza sativa
agtcggtgtgcttgtggattggaaagacaagcttccgctgttctattatttatttggtcggtcggccaatgtaactaaagtagatgtagtttataatcactttcatcttatttgtgtttgctatgtataatcatgcttgagatgaaagtgtgaatctagtgcacatcctgggaattagattcacatgagtatgagttaagaatatttgagatgttgtagatcttaagccatttttgtcaagtctcctaaatgtgtaacatatctggtcaccgccttcgagtggtttaacgggcacatctcaggctgaagttgactggcaggctaaaggcccaacaatatctccaatattactctctcgaggcgtcggatatttcattatgcttgtttgatgacttgaattatttatttcatctcttaattataatggaagattcggagagcctacgacagataaaaagaattattgcaattatatgcacgcataatcggataaaaagaattattgcaattatatgcacgcataatctctatccttcaacgctctcttcctctactcactcatttaattcctttatctcctaatttttaactaagtaaagaaatatcaataattagaaagctaaatgattataattcttaaattaaatcataattttaacttatttgaatttttgtttttttacaattaaataaaatatttaagatccatattacccatatttcactctataaaaaatgaaaatatgtcatttaagcatagacactgttcctttgcatggtaaccaaatagaaaaaacacggaccataatacaaaatgaaaataagtattatattaccgtaaatcactggacatcctctgagcacactcaaggcgtcatgtgttacgccttaaataaaaatataactttacaaattggaagaaaaaccatcttagcatcagtttccacttaaataggtagatccattattttcaaccaatagatattcttttaagaaaatcttaagcaaccatgtgttacgtcttaagaattagaaaaaaataacataaaatgtgagaaaaaaatatatcattggtttcacttaaatcatttagataaaatagaaaaaaaatacccctccacttcgccatcccccacacatacgcacaacacggcactattcgccccatcccttctcgtcttgagctctccactctaccccttcctgtttatatagccgaaaataatcaaaaattttaaaacttgcataaatttcaagctacacatccgatttctaatttagatattgttgtatttataattaaaacattgatttaaagatcaccacagcaatgatgcacatgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgccattgagtcgttatggttttctgaggacgtccacgttcccgcctctcaggaagtggctccatcagcataaaaatcatcatgcaatatcccatcccacacaagttaaagaatttagagtctagccaagtgtaatacatgtcccggtgctcaataaccgtgagcacggctattcgaatagatttggtttactcacattgcagtggatgtacactttacccgcactccgcgactgcccaacacatgagcctcgtcccaacacatgagacacgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattagggttcaagttaagttctctctctcacatactcatggcagtcctaccaatggcgacaccgatgtagggcacgcctctcgaccctacctcaacggctgtcccaccgtagcgcacctgcctcactcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccaccccagtcgaaaacagttgtttaattttatttctcctttcacaaatcatgtcctcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacat

SEQ ID NO: 57643 - DNA, 772 bp, Oryza sativa
atagggggagtgtgcgcccaaaccgacttaaggacttcactcaatgtcagttcattccgtatacagtacaaccacatatgctagtatgggatagcccaagcttagtaagttgtttatggtttagccttacattctggtaggccggtgtgtatgagttcatataattcagaggagcttcctatttaccccgacgtggtagtttaggtgactaagtgtgtccaatacaacggtattgtgccacgtggtgggttcccgttgtgtccgtcaccacggcgttaagtttaaggcgtgggcccaccacttaacggttctaggccatatatcgagtatggcttaggatggagtaacacgtatcgtgctggtgtaaggctaaatcatgaattttggaaaagctttgttgcgggtaataaatcgggtacttatgtatcgcgtgccatgcttttgcatgattattatttcgtatcatgtgggtaaagtgtacaaactctgcaaagttaaaactaatcgattagccgtgctcacggtcatgagcggcgtgtggatatgtattgagtatagacttgtgtttattctcctgaatgctgaaatttaccttcaaattgtgatgagatttgagaatgatctccttgctgccatggatggcaatgaggtggatatttatacatgattaatgcctactttgatgcccatatgttaagtactagcttgctgaaattttatttgaaagcaaatccgttttgaatgcgttttatgcaaataaaacttgctttat

SEQ ID NO: 57644 - DNA, 978 bp, Oryza sativa
ttgaaatcctcaaaggtcagctggccattcttgctcacatccattttatcaaacatgtcctttatgtcagctgcttcctctgcagacaaatgctcagcaatgacctgcaattaagcacaaataagctaactacaagaaaaggagaaaaatccttatgcacatctcgtgtttagaatttaggaagcaaattatatgtgatctctatgtagaagtttttattcaataagaataataatctattttggtgctaacatattataaatgctaccttaagggctttcttctttaacttgttcatcgcagcaaattgctgcagtctagctcggacagcatcaccaagaggaatgtcaggcatctttttagaatcatgtaaccatggatgttctgtacatgcaacgaaaatcagagaaaaacaatgagaaaaaaatgtctgagccatgaaaaatgttaatcatggtgccattaaaaaacattctggataaaaacacagtaaaaaaaagggtacagctagccatttttcggagaacttttctgagattagccctgcatgatggtccctgaataataaatagccctgggctaattttatatcttcttataataatgtgagttcattactcatcaatcacatcatagataatatatagtacagacatatccttcatatattccactaaagtaggagtgagatagcattatgtatgctgctacgcgttaggacaggtgattggcgatgcttaccaagtacttgttctgcagtaagccttgtcatgggatttgggtccaacatccgataaacaagatctttagctggctcagataccctgggccatggttctcttttgaaatctaccacagagcgtataattgcctgcgctactccctgctcggtttctgcatggcaccacaataatatgataagaatggtgttctataacttccccgcaacacatgcagtctagtcaagagaaagaacac

SEQ ID NO: 57645 - DNA, 1710 bp, Oryza sativa
ggggacagccgcggcggtggcgggggacagcgacggtagcggtgggggatgggcgcggcggcggcgattgaggcgacagggggacgggtgcggcgacggcagcggtagcgggggatagacgcggcggcggcggcagcggcgtcgacgggggacgggcacacggcggcggtggaggcgacgagggacggacgcggcagcaacgggggacgcgaatcgcgtttatgaagaggagctatcccgttgggggacggtatcccgtccctagcattcccgtataattaattcagtattaatttataaaattttgatgaataaatttgttggatttttttaagcaatttaattttcacacgaaacaccgtttagcagtttaaaaaatgtgttaatgaaaaatgatgaatagctaatccaaactactccttccgtttcacaatgtaagactttctagcattgctcacatttatatagatgctaacgaatttagacattattatatatatataaattcattagcatctatataagataatgctataaagtttccattgcgaaatggatgaagtaggtacgaagaacgcagccttcggcccgcatcaccgcggtgaaggcgaagcatgggcttttatcggcctttccaaccgtttcgtcttggaccgtcgtctgcaagccgcgagaccggcccggaaaggtggagggggccacgcacgcgccacgcgcggttcacttcacagttcacacgtcgctcgcgccgtctcagcgtggcagtttcggcgcggcgcggcgcagcgcagcgcggggagagcagcgagcacgggaaaaaaaatggtgggaaaagcagtacagtacagtaggagcgcgaaaccgaggggaaaactcgaaacgtctcccgcgctgctgctcttggatttcatcctcatcttcttcatctccttccttcctcttcccccatcgcgcgctctcgaatccggtgttccgctctccgctcctcggctcgcggcgtctcgattcggagtttggtggaagggggagagagagagagagagagagagaaccctaggcggcggcggcggcggcggcggcgacgacgtcatggagacggagcccttcgatgaggcggagctcctcgcgctcccggcttcccccgtcgcatcgcctccccgccggctcaagcggctgaagaagtcgtcccagatcgccaccgccgcccaccccgtcgtcggatccccacctccaccatctccgccgccgccgccgccgttggacgaggaaaccctagctcagttcccttccccgcccactaacccctccccacctccgccgccgccgctggatgcggatgcggctgcggaagctgctccctcccctgcactgacctctcctcctcccaacccgagctcctcgccgctgccaccgacagataccaccgaggaggaggaggaggaggaggaggatgacgggctggacccgctgttctcggagaccttcggcgccgcggggtgggacccgctggggatgccgaggatggaaggggagggcgacgaggaggagatgctgggtggagggctcatcgaggagctgcgcagggagaagtcggcgaagaagcggctcgacatggacgagggcgaagaaggcggcggcgaaatcgccatggatgccgaggtcaaggggaagcggagcaagaggaggaagaaggatgaggcgcccaaggac

SEQ ID NO: 57646 - DNA, 2292 bp, Oryza sativa
ccacacgtacacgtacttcaccccgtgctccttcttcgcctcctccaccaacgccttcagccccgccgccgacgccgccgtctcgccgccatccgccattgccgtcgtcgtcgtcttctggaacttggtgttctccttgatcccgatcaacctgctcgcgaacctgcaacccatcgatccacacttgttactgcacattgcaaacaggaaacagcatttgctgccaaaatcacgtactgggcgccttcttggacgacggcattgccggcatcctccttgttctcgctgccgatctgctgccacccgtcgtcgatgatcaagaaccgcggcggcgtgccgccttccgccagctgcacaccaaacacatcccaaattcagaccaaaaccaattcaaatttcatcaaatgaaccgaagcgaacctttggaggccttgcttgacgccatcggcggtgacgtcggtgtagaaggcgtcccatgtgcaccacccgaaccagtccaagaacgacggcaactgcatgcgtagcgcacacaccaatcaatcaatcaatcaatcaatcaatcaaattcattcacatcccgccgcgcgacgcaaccgcaacgcaacggaaagcgaaagacagcgccggcgccggcgccggcgcgccgccgcaatggtgtcgctgtcgcgtcaatcaacaccggaagaattagaaaaatatctcacctttttcttctcccggtggtggaacgtctgcagatgcctctccaccaccctgcaatttctcaccgtcgtcgtcagagaaacaatcaaatttcacctggatctcaaccaaattttactactccctccatttcaaattataatttgtttaaacttttttctaagtcaaacttttataaatatgtccgagtctacagaaagatttaccagcacttacaataccaaattaatttcattaaatctaacatcgaataaaattttgattatatgcttgttttgagtttaaaatgctaagatatttttctctaaactttatcaaagcttaatactccctccatttcatgttataagacgttttgattttggttaaagtcaaacgatttcaggtttgactaagtttatagacaaatataataatatttataatgctaaataagtttcattaaatcaataattgaatatattttcataataaatttatcttggattgaaaatgttactactttcttctacaaatttaatcaaatttaaagcagtttgactttgaccaaagtcaaaacgtatttgttctaaacaaagggagtagtatatttgattagaaaaagaattcagtgaaggtgagacacgcacttgacggcttgggtgatggtgtcgaagggattggccccggcgtgcacgtacaccatgtacgtcccctgcgccgtctgcaccgccttgtcacctgctcgccgcggcgtcgcgtcgcagccacacgcatcacatcagaacggagacggagacgacgagaccgtctcgtgcgcaagcaaaagcagcacaggatttgggcagtatggcttaccgctctcgatgcagatctcgagctcgtcgcggtcgttgccctgcagcgccgcccggaactgcccctccagcagcggcagcatcacgacgtacaccgcctcgccgccgccgccgccgtcgcggctctcgaggagcatgaactgtgtctccagcgggacgtcgcggccggacgtgcccatccgctgggtcatccaccatagcttgaaccggaagcagcacatgaacctcaaatccctggtaaaaaaaaattcagccaattcaatcaattttttcttgaaaattttgttaaccccaacagtaaaaaaagagagaagagagcagcataacacaaaacactttgttattaatgaacaaataaaacagtaaacaaatgtctaatcaattttacgaaattgatattcaaattattcttttacgaaatagaaattcgaaatggagcttgaagacgcaattctggctcaagattgcctctgcttcaggcaagccggcgtatgcgcgtgtgccgatggtgatgaccagtcaggatggcggcgatgagccaatgtttgtcacatcggtgacagactgcgcgctggttggcatgccatgaagcaccggcaatcattccagatttccgtccatggagggatcatccaccggcgacggcgaatgaatgcgagttttgagcctcacctgacgtagatcgggcagccgccgatcgcccgcgccgcgccgtggtactccgccgccgggtgcaagctctgcaagttcatga

SEQ ID NO: 57647 - DNA, 1156 bp, Oryza sativa
gattcagcggtgtaaagttttagcatgtcacatcggatattatatagggaatcacatatggtgttcgggtactaataaaaaaataattacagaatacgtcggtaaaccgcgagacgaatatattaagtctaattaatccgtcattagcacatgtttactgtagcactacattgtcacttatagattcgtctcgcaaattagttgtgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgtttttgtggatctatgtatgaagaagctacaaaatagctggagaaccagagagctcttactctctccctctctgatcgttctggatccgaaaatcaatcctcccccttctaagtgggcaaggtcctccttttatacctcaaggggataccacatgcaccatctctctcttttttgtggggacttatcctctcttttcataaacagacggagacttgtatggttgtcgtccgaatgaccttctgatgggacagcccatacctacctccacttccgccggaagcaggcgcgacgtgggaacatggctgtctgctgacgacatgatcagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgag

SEQ ID NO: 57648 - DNA, 789 bp, Oryza sativa
cgcggtggttttgctctacactagtggatcccccctttcgatcggcacctcttcttttggggggataatttgatcgataaccaccttagaaacaaaagttcagtcctttttccttgttcattctcggagatctcaacattttctttccaatcaagcataattaggattaccatgcatgcgtgcaaacattcatttctgaagccgaagccggagagcagagctctggtcatatccaaagggggtcggagttttgaactccgatccccttcgacctctttctttctcacgctcctgtgatctagaagcttaaaatgcagcatgttggtaatgcctgcgcctgtgctttactgcttttcttctgaaagaggaatatatgaatcagttttcagtttgccgacagaaaacataacaatgacaccgccaacaaaaggaaaaacaatagtttcagacttttaagtgctagtagaaaggataaaaggaacatttgtatgaattttatataacattcttatgatttatttattcctttatggcagtagaacccagcatacaaaaaagaaaaagtaaacttcagagaggggttcggagagttaaatttcggtgcatgtctctcgctcagccacacccacacacctctctctgtctcttctcctttgtcgtgcatgctttgatgcacacacggtgaactactcgatcgatcaacagttgagcttcaggaccttaagaagaaaaatgcagtccttgattccctgaaatgtcaacatttttctgccgacgaagcgtaaaaaa

SEQ ID NO: 57649 - DNA, 799 bp, Oryza sativa
tttgctgggcaagggcagcgattttctttgctgtggcttcaggttctagcccagtcctgagagcctcaacaactatagcactgatctcattgctgtacaaattgtcgaaaagcccatctgtgccagcaataataacgtcgccaggagcaactggaaagtggaatgtctacataaccaaatatgagacatcaataatattattgatgataaagaacgtaggagtcattcaacgaagattcaaagatgtttgctcaaaccagacagttcaaaatttcaagaagggtgattactcacctgagcagaactaggaagatcactgccacccccactctctagctgataagtgaaattaaaatcatgctgttgtacaggtgatctgagaacagttcgaccatctctgactatgatgaagccactatctccaaggtttacagcatggataccctgcatgtttaaatacatctgcttcgttattttccagaaatcagaactgtgaacttctagttctgttgaaacattgtgctacactagacagaaagatacatgaaagaattatccagttattgtggtttccgtggatgagatgttctctagaatcatattcatagaatcatagactcaagatgtacattcaagaataacttcaacgtgattttagtgaagaactcagttgcaattttgtgtgcactactgttcaccagtcataaaaatggcaatggaaggggactacactaagcatcagacaaaggaaagctggttaacctgctctttaagagggacgatgcaacagggctgcagg

SEQ ID NO: 57650 - DNA, 6675 bp, Oryza sativa
atccaaaaagaaacttgagtttggtacacacaattttgttgaaatatgcaaaaattgttttgaaaaaaaaattctagtttccaagatgtaaaaaaggttttggttttcatgagggcacccactgttcattctgccataatacaagtctacaacttttcctttgtaccttcaccttgaaacctaggatgaattttaaagggagtttcttaggtttgtacaaccttatatgttctacagtcacaatgtttgaattctttaaatcattgcagcatgtcaaaaatttgagttttcagaaacgggtgacatgggagactggacccttgaagattaaataattatgatgctcatgacagcatatagtcattgatgagttgggctgttgcagtaggatgaatactagggacctagtaaagctttctgttgcaactgcattcgcttgttcccagttggctcatcccttgtctaactaggcctcgatggttgcagctgactatttagcacacacaaagcatgatgaaggagatgggttacgatgtttatgcttgctgaacttgtatggtaatgtaggatagtaggtgggctggttgatttgttttccctttgcccctttccttttattaatcacttctgcctgtttttctctctgcattttcagtttcaatgctttctatggtattaactcatcacatgcctgatgccatggcatgtgatgagtatgtgtcgtggtggtctggtaccattcctcgctacctttaggaaccatggcgtggatgctatagcaaattatcatgaatgcttaaacacatcatgcccaggcaaccaattctgtctttttccaaatccctaaagcatggtggtagttgctttagtaatatctcatacagtcatactttccatgcatcatgctgcaagtcttcatttgtttagtattcttgatgatactctgattcagggagcacctgtgagtagaagtataacagagttaaagtcactagggagtatggcgttccagagcaagaactatcttcatgctgcaggattctacagtaaggtattaacaccatatttttcctgtgtgtttgccttttccaacctttttctcaattgtgtaaattatagtaagggggtgtttagatccaggggtgtaaagttttagcatgtcacatcgaatatatggatacacatttgaagtattaaacgtagtctaatagcaaaacaaattacataatccgtatgtaaactgcgagatgaatttattaatcataattaatccatcattagcaaataatgtttactgtagcaccacattgtcaaatcatggagcaattaggcttaaaagattcgtctcgcaaattagtcgcaatctgtgcacttagttatttttttagcctatatttaatactttatgcagaagttcaaacgttcatggagagggatttaaacagggcctaacttgtgttgttcactagttcactagttgaacctggcaaggatcatcggagtatatgatttacaggggttctgatatggcttatttcgtattattcttgaacataaacacgtgggacttcaaacatttggaaaatgtggtttcagaatgttttaaaatgcaatggaatcaatttgaagcattttgcaaaagaaaacagcctttcatgcatgcagattttgatatggcattggctgatttctaagattctggtcaagggacagtgaattccctgagtgcatctgggcttcagttggcccagttatctctagcaactggataggatccaaataatagccagctgcattctttatgttatcgctttgttttgttttaaattatctggggcattcctgcatctgcaaaaaaaatatatgttgatgcagtcttacatttgccttattgaggatagtgtccattttgtgataatggaaacgtaaacgtgtattcaccaaattatgtagtgcacggcagtactgatttttttttaccacctttttatctcgtgtcataaaatagtgctgatttggagttctgtgctttgtcagaacatagaaaaactatgttagacaggaaaattatcttaaatatcatattttataagagagaagctagctgtggaacgaactatagcaaaatgtattttgaatccagggtcacccacgtcccccttcagggaaaatcaaatattacacatgttcctgtgattttaattttctgagaaaattcatgaatatagtgcatataaagatggcaaaaatttgctataggacactcataaaatgtgtaattggctgagagacaccgtaaaaacgtgacacagctgatggacactaaaaaaatggtgtaattagctataggacatcagagacaatattttataattccagggtcaaaagagatgaaaaaaatttcaaaatggcgagattgcccctggcgctatcttctttcacctgaaatcacaaaattagctgggagcagccgccgcgcaaggttgtcgacggcgagtcagcggcggcgcggagcgtgtgcaggaggcggccacgcgcgaggcctgtgacggcggctgccacggcggcgcggagtgtgggcaggaggcggctgcgcgcgatgcctgcgacagcggcggccgcggcggcgcggagcgcgtgcaggagctctgctgcttgcctgcttctgctgcgcagcagcaattgttgtcttcggtttggatatgattcgcaggatggcgaacttgtcattgccgtcgctgcgggaccagccgccgacgccgatgaggtcgcgcaggcgccagcgccgcgatgatgaggacgacgactctcagccggcggaggcgctcttgggaacctgtcgtggatgggcgagccgtgagatgaagatggcgccaggggcaatctcgccattttaaaaaatttctcacctcttttgacccataaattataaaatattgtctccggtgtcctatgctaattacacaatttttgcagtgtccatcagccgtatcacgtttttgcggtgtctctcagccaagaacatattttttgagtgtcctatagcaaattttgcctataaagatgtacaaatctgcaaaaaataaattcaaaatccatcctggttttcaaggtaaaaaaaggacatgttgcatcattaacaaacgagcaaatagtagacatctccatgaacagcgctgcttgtctccttttgtatcttgaaatctaggaaacaatgaattgattttttgctggtttgcacatcattatgagctttttctggaatttacaatacactgcaacatgctgaaaattcaaatttatttgtaaaggggtcgccagtgaccctagacgctagaattgcattccagaatatatctggtcaagtgtttcttttaaatatttgtatgaatctatgcacaggaatatgcagatattttcatatcttgttttggtagttctgaaaattgtgattttttttaaaataaaatcttgttaatgatgttgtttcttgttggatgcaggcaatggaccttgaccctgatgatgccaccttgttctcaaataggagtctttgctggcttcgcagaggtcatggaggcaaggctttgctggatgctcacgaatgcagaaaaaaacagcctgattggtcaaaggcctgctaccggctgggcgcatctctgatgtcactgaaggttagaacttgggagttatcctttttggctttgtgctgcaaattgttgttttgatcatgttcttttgtcatcaggactatggaagtgcgtgcgatgcactttttgatggactcaaattggacccagcagatgttcagattgagaatgcgttacggtatcccatctttccctttgtatacataactaatgtagtcagtaatgcagtaatgtttaccatgtgccagttgctagtctctatgaacaatgaactccatggcttagctcatcttttgtcgttgtcgttcatatatcaaaatctttgtgggttcaaggtcgattcacactcaactgcaaaagagttgtgaacgtgtttctttttattatggtgttttgggtttgttaggattttgcgaatccaatgtgcatttcgatgaaagtcaatgcattcatgccataacatcacacttacgtaccttccatctccacaactatatttctatgaattatttttactacatctgtcccagaatataaaaatttttagggttaaacatgggtattaaaaaagtaggtagaattaaatgggagaagattatgattgattgagaattgcaagtagttgagaaaattgaatggtggaaggtagtgattggttggtaggagcatgttggcgaagaagttgtattttgggacaaaccttaagtgttagaagttgttatattttgagacgaagggagtattttgaaggcatagtgtttctcattaccatgtgttgtcacgtaaggttacccttaccgctgttaactaggcttaccgcggggtacggtaatggttactggtggtaggatttggagaattttgaccaaattcaaaatttcaaaaaaaaatcatggatgtagttcttgttttttagtggcggatggtgaagaattttttttaaaaaggagtaagataaaatcaaattgagtgcaaagccgataatagtttagaaaatagaaaaaagaaaaaagttattgggccttaaagttgcactgtgcaaccggcccattaaggcccaatacaagagaaaatatctccataatataaaaaaaggccatgtctaatttatgcattttacattcaaaagttaggttagcaagtatcgtatatattcttctaattatttctaatttatacttttagtggtttttcaatttttttagcattattctgttcagctaaacaacttgcggttaccgcataaatatcacggttaccgcatcaaaccgtgtccaaacctccaaatttttgaattcaaatattcgccgacgaaattcacacggttttaggtggttaccacatggtaaccgccttactgcgggggctagggatgctatgtggtaaccgccttactgcgggggctagggatgcaagtgggtagtcctattatccgcataaaaacctgcttgctagtttatttcttatatggtagtacaaaatttagaagaaaaaaccagcttacccgccccacttgcatccctacgcgggggtgcaataattcccttctaaacggtaagagaaaccatggttgtcaagcattggcaactacaggccaccacgtccagcttaaagaaaatgtttttaggattgaatgtggtcaaaacttctgtaccaatatctctatagtattcatactgactttgttaaaacgatgtctagattgtcctgaaaataaatgttttcatggcagtaatttttaataggttataacatcatagtacaacagaaactagccttagaagttccatgttccaaaatgagactcattcaatacttgtggttcttggaatatgcagggaagcttttcagaacttgaagttatctcgaagcaccaaggccaagtgaacttgttcttccttgatggggattcactggtggagaaaccatctttcgtcggtcggccgatttccacaatagtcccggatgcaataaaaaccggggctaaaaatgatctttagtcccggttcaaaagggtagcgggcatatttgatctttagtcccggactaaagatgatctttagtcccggttcgaatgctgtcagggcctgtcaggccccaccgggatctttagtcccggttggtagagatcgtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttggctccaaaatttatttgtaagttgatgagagagaaaatgtgtgtggggaagaaagaatatatagaaatttagttcatttgctaaacagggttttataaaatagttgagaaggaaaactctagtgaaagttaatcttaaataatagaaaacaaactaaaatgaaaattaaaagaagtaaaacacattaaaattagtttaaaactttacgaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaag

SEQ ID NO: 57651 - DNA, 5437 bp, Oryza sativa
aacatcgacagaaaatttaaagaatttggaaaggacgcacgaaacatacggtttggtttaagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttaccaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcagactccagagcagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttatcactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcttgctccgccagcaccgtctccacctcaggctccagcatcgactcctcctcaggatcctgcaccgactcctcctcatgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttaagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacatacaaaatttcattcccatacgaacttgctaagtgtttcatatgtaatgcatcccacgcacattgcagattccactgggtgcttttactcttcgacctggatgcctgcaccatcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctgcatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccacaagagagctcgaagtacgtacaaataaattcaaaatttcattacgtagcgatttattgtttaattactaatcaatttcatacattcatatagtttattcgcatgagggataacctgaccacacacaaggaatttatcgcggcggttcaagaacaactcatgggattcatcaacgaagaaatccttgatcctaagggtgaattctactacgacggaaacacaattcaccggtccttagcttctgagctagcagcgagtactactacatcgaaatcgtagctagctaggacatataatggattgtaataatacatgactacatatgtttctatatgcatgtgtacacattttctataatgtaaatatatttctggtcatatatatatctatatacatatgcatttgcataacatatatatgtataaatacatatatattatgcatgtatatacatataatataatataatatatatatatacatatatatatgtatgcatatatatgtattgaaacaattatatatatatatatatatatatatatatatatatatatatatatatatatatatatatatatatatatatatatatatttgtcccggttggtaacaccaaccgggactaaagatggctcagcctgccacgtggctgagccatctttactcccggttaattcacccgggactaaagatagcgatctttagtcccggattggtactcccggtttagaaatcgggactaaaggggggttacgaaccgggactacaaagggtttctccaccagtgattaatggagttatgtttcctgtccacacattctatcctcgcgcgaagctacccgtatttcctgaacaagtttcttttatttaagttaattaagaaccgtaagcattatgaacttccttttgtggcaagtagttggttctgaacaattttgtatttcatgtgatagtgatgccattgagatactttagaacttggcatgctcgacacaatgttacctaaaggaatctcttcagttgctgtctgactcatttgatcatcctgcctcggttttcactacacctacgaatacaatattggttagcaacgcatctactaacggcaagtgctacgataaatgtgaccaccatctttaaatttatttatttttttcactcctgaactgagagacaacttatacaatgtatcacctctggtaccaatatctttaatactctcacatctttcttaaaatttgtgtggaggttacttcttgatttaggggtggctcatcatctatctcctttccatctcatcactcaatccaatgtggcactcttagaggcaccatatttaccattgtagtacttgccataatctcctccctcacacaaaagagatgacaacattcaccgtcgggaaatgcatcaccatccttaccctgtggtaactttattcccatccttgcccctgcacggggaataaatccccgtggggtctttgttcctgattaaaacaatatatgcatgtcaaattatatatgcaatataacatatatttacactttatattaatatatcagcatatatctagtaaagtatctactatctactgctccctccattccaaaaaagacaaaccctgtttccgtgcccaatgcttgaccgttcgtcttatttgaaaaaaatataaaaaaaattaaaaagacaagtcacgcataaaatattaatcatgtattatcatctaacaacaatgaaaatacaaattataaaaaaatttcatataagacggacaatcaaagttggacatgaaaatctagggtttgtcttttttttttttgacggagggagtacttcacatgataaaaacataatattatcattttttttcccagggaagtgctacgcctccgcagctaatgcagacatgtggttttccgtccccaaagaacaaggtgctttagcatcatttggggcctgtttagattcctgtcaaaatgtttcagcatgtcacatagaatatttggatatatatatggagtattaaatataaatggaaaaactaattacataaactgcgtgtaaattgcgagacgaatcttttaagcctaattgctctatgatttaataatgtggtactacagtaaacatttgctaaagatggattaattaggcttaatagattcgtgctcgcagtttacacgacgaatctgtaattggttattaaatcgtagactaataacacaa

SEQ ID NO: 57652 - DNA, 2118 bp, Oryza sativa
  unsure (1)..(2118): unsure at all n locations
atatgtttttttacagcaatctatcgtatagcaaactttttaaaaaaacaccattgtattacgccagtattaaataagnngcgtgacgctgcgaaaaacgagagagatgagttgggaaacctagggtaagaacacaaccaaatgatgtactccttccgtctcattttaaacacagttgtaattttctatgtctaatatttagccgtccgtcttatatgaaaaatttgtgaaataattaaaataatgaaatacatataaagtacaattcatattttatcatctaataataaaagaagtattaattataaaataattttaaattagacggaaggttggacatggaaatggcacggaggttcctagctggactaccggggtagcgtgtcacactgccacattgctatgtcacgtcttatcaaaatttagtgaggagcaaacctggttgactacagtccggcctgcttctcatctccttttctcccttctctctttcttttgacagtggccgctgctgtttaggagtagtaatttttttattttaaccgttcatccatccacagttctctcctcctttccttccttcgtaaggttcctctctggctgctctacatattttctttctccatcgccaatttcttcctcgccccatcgtcctcctcgcttgatcgagctgttcgtctaggtgggttctccattcttccttactaaatactccgttcttgttcccttctcaggttggttataatgtcaaatgcaatacttgttttttttttcccttctcaggctgtttatttgatttctaataactgagcttttcgggctgtgtacatccactttgggtgcagaggccggttaatccattatctaaaaaaaagtagcttttcattgcttgagatttttcatttgggtcccgctcgtctacactacaacgccctttcaccatcttttgggttcagtcgtgacaaaactgtgaaaatttgtctttttgcaccgtcgcatttgttttttctctgattagcaccaacccggatgtggaaatttctctgattaaatttagcttccaagcgggaaatatggtgattcacaggcctttttgttgcattgccatggtcctgaactagtgaaaggatgagaaaaaaaaatatccccactgagaagtagtgattttttccgacactgtaggggtttgttgaaagatgggcacgtggtgcgaaagatgtagacggcgcgatgagcaggactacaggaatttggatgattgccagaaacactttttgctgcttatgatgggtgattttcaacatgagattgtaagccaaatactctattatttatgaaaatgcaatgccttcttttcttgtcccttgccttatgtaacttttgtgttactttcctacttgcagacccttttttttggaaaaggattgcagacccagtttggtagtagtaggttatttcaagcttataatcttgatcttccttgcaaatttccatattaatcgatgactagattgtaccctcttaaaaagaataaatattgatgaccagatttaagccaataacataacagcacattaggtttgttggttggcaccagatgtcatcatatctaaaagagcaagaaattgggcttttcaatttcatcagtttgttctgtagtcacatacagaaatcagggcctgccctgagatttttgtcgcacagggtggaactaaaaagaaaggccccattttgaacataaacatgaaaagtactcatatgaatatatcaatggcaaagatcgtattatgtgcatgactgacatacatttaaactagcaccaaaattatgttaacgtcgctgtagcaatgaaagaagagtctcgttacggtactctttactggtagtagaaattaatctaaaccgtgggtctagggcttgttcaaattattgtcaaaatcaacattgccaaatttttggtaagttgataaaattgccaaattttggtaggatggaataaatatgttgtgccaaagtttcctatgcgttaccataatttggtaacaatctaaatatagtaatatatttgtcaattttaccaaataatggtatagtttaaaatgacaccaatctaaacag

SEQ ID NO: 57653 - DNA, 1801 bp, Oryza sativa
caaatgcagtcaccaccaacatatagatggacacaggtgcaaagagataacttaagtgagtgcaacaagaccatgatgagttcctcctccgagtcatcggttacaactcagttcttatatgcattgccttataaatctcatctggtgttgtcatgtcatatttcacagctataactggttgatgttttcttttctttgcacacaggatattctttgccctctgaagatcagggttgcagagtaggtgttatacctgatcccatcattgggcgtaggaccaaactaaatccagttcaggagaaggtggtgaacttcaagatccaacatattcattctgaaatcccaatatttgtagctgtcattaaaaggagcaacgtgtctggagtgttatccactctagtgagtgtcatatttcttttctcaaatgtgcatactttcaaatacgcactaatataaactggtgtttacactactgatgtccatactgctcaattacgcactatttaaactaccgataaacattattctcgatgttgttacttctgcggttgcttaagattatttaaactatccactgaatttacatgcgatacacttgctgcggttgcttaagatttatgatgcagtgccagattgttttacttataatttatttgcaataactccatcatctccatttccttttcatgtatgcaactagagtgtcgccaaacggtacgtggatgaataccttggaggcgagagattcatcagtctttcgcgacttgggggcaagtggggcatcaggcttttgctggtgggggtgggagtggcacaaggatggtaggtggatggcaaaagtttgtgaatgagaacgattttggagtgggggatatttgcctgttcgaactgttgaagaatcataagggcacaatggaagttcatatcatcaaggcaaaggatatcttttgatcgaaaagccattctgtttaaatctgctgattttactgaattctgatgaatgttgctggtgcttttgtgttgctgagaatggtagcctatctatccagtttatgcaactaattaatgacccaagtgattactgatacttttggtgcaatgctgttatagtaaacatcagctgttcaggggcgttaagcagactttcctctgttctttatttccttcggttctcagaattatatcacatttattgctctcaaatacaatccagtaaaaaaaaaatatctcgttttgatgcacctcctatcgaattcctagaacttgaaacatcaactgcatatttacgcatgctcatgggatgtatatttacagtaacagtgtgtgtgttcgcttacaatttcttgttacaaaaatgattggagagatgtctccctttaaatctcattctcaacacgctcgtaatctcttcttcaaaaaaaatatcatttccaacatgctcacaatttcttctttaaaaaatcgttcccaacacattcacaattttttaatactttctttgtttcaacatattataagtcgctttgattcttctataattaaacttatttaagttggaccaaatttatagaaaaatacaaaacaaacgtatcatcaaattatataaattgagatgtttctaaatttgtctataaatttaatcaaacttaataaagttattttttctataaatttaatcaaatttaatacagtttaattagaaaaagtcaaaacgacttataatataaaacgtgtggtggtattagatttacgtaccgaatttgaggattataccaaaagttcattttacaatgctacgctt

SEQ ID NO: 57654 - DNA, 3246 bp, Oryza sativa
ttattttattatatctagagaaaatggagagagaaacatttattaaagataagtttgcccatgggcccactggtcaatctcacatctctagctttctttgttcatgttcttcttcctactgctaccttctctctcatgcgtgtgcacagcagcggcaatggagagcatgtgcagctgctggctagggcagagcatgcggcagctggttggaggaggtaggcctggagcttggccacccgtcagcggcgccatgagagagccgcacagctagggtgtcggtgcgggacatcgggttgcaaaggggaaatatgcgcagcttcaattcgaccaagcagtagtacgacggggtgtctaggaactttgggaagtcgatttccaatgattgcaggatagagcaacgtcggggtcgtgtgcccgtgatgagcttgatggcagcccaatggagtttggactggcaaggcatcttcgtctaattgttaaaattgattgggtgcagtgcctctatgggtagggaaaaatttaggatgtaatagattgccggaaattggcgtgatggtgaatgatggcaacgacatcgtgctcgccatcaacatgtctccaggcctacctactcggcagcttcaggtgcggcgtcgccgtcggcggtgaacctgggtgatgcactgccaccaccgccccaccgtgggctggccgcgcgcgtcgcgcctatgctcggctcagtagcaagcacgaggaagaagggaaaagaaaaggagagagcaggggcattttggtacttacacaactttctctctccattttaactggaaataataaaaaaatgggagtagtgtccaacagctaattactacttttttacagtgtccacgaaaagattcacgatcttcggatgtctcacagcaaaggccgcaatctttcggtgtcctgtagcaaattttgcctaaaatctacttcctccatcagttcatccctaaaacaaaggaaaaaagtacgaattaccctttgaacaattgtggtcgtccgatttaccaccctaaacttcaataccagttatttttaaccctaaactttacaaaccggatgaattaccccccctaaatcgatctaggccggttttggtcctacgtggacgcatacgtggcaatctagtcagccaaaacagataaaaaagatatgggaccctgttgacgtaaaacacgataactccagtgcaggtccaaaactcgccttcgggtgtgctagcgtgccagttgatttgatcctgcaatcaataagaaataaagacaaagaacccgcggttaaatctataaatgatagccgatcggctaagtgccgatgtcatatcatttatctctgagccgatgtcatatgtaaatcgatcggcggttgtaaatagataataaagaactaaatctattcgatcggctttagatattaacaatatataattcttatatcgatatatacttaaatcaagtgattgggatagatcggtcgtcatgccgagacagtataaatcacttagatcgaaatatatattaataacaggactatatatattcacagcttagccgatcagatagatctagcatgtatcggctaatactccgatacgactctatgttaagatgtaaaaacaagcagaatataccaaacaaaagcttaatatatttagatgcaataatatcttgatataaagggcagatttaacgtgtcaatgaagcatatagagcaaatatagttaaatcagataagattggctgaaaccccgatactaccctaatcggcaaccagaaggcaggctagagattgatattctaagcacaacttaatagaccaaactcagctgatgcagcattaagtatgaaaagaagaacaatatctagacaatcaagccgctggaagtttcatagagtggtagatatcttatataatctaaatcaacgtcaaaatctaacctaatcggctgccctcttccaataaatgttagccaattgtaggttagatagcgatatggccagagattatgtaagatatatgataactcgacgaattacataaacaagattagagtatcataaagatggaagcactaatcccgagaacgcaagccgtcataacaagttttacctcctgttgaagatcgaaaccgatgtagctcaacccgaaagcaagaactcgtcgaaataaaactaaagcaaaagggtggcgatgggccaaaattgtattgaacgtgtgtgttaattgattacatggggttcggggtctatttatacccgaaaattacaaactatgtccatgtcggacacgactcttatttctaacaaactctaagatatcataagtctttacggcagacttttgccctaaatatatctctaagaaaattacataaaacatcctaattaaaagatacaattgccttcccaagactctatccatgtgcagcaatcattttgaagcatatcaactcaacccgatgttgtacaccaagtcgtattgtcggaattggctgcatcggcttacccagtctgactcgaacccagccgatcctgatcgtagccgatccggactccagccgattcttgctctgttcttgaatcgatctccgcctttgaatccgcttcgatctaatcctcttttccgatgctgatattatcaaatttggccgttaatagacccacttgtcagcccaacccctcttcttctccccctcctcttcacatcttccccacctctctctctctctctctgtcgagtgcaatggcacaaggatggtgggcggcggcgcgcgggggtgcgccggcggccccggaggcggagctccccgagcggcaggtggctgagtaggagcgggcggccggcggcggagaaggagctccccgggcagtgggcggcagaggcggaagcagagcgggcgggcagcgggcggctgaggcgaaggccgagcaggcgggtggcggcggaggcggagctccccgggcggcgggaggcgggaggctgaggtagaggtggagctccccgtgcggcgggcggcaggcagctgaggctaaggcggagcttcccgggcggcgcggcgggcgaccgtggaggagggcatcggcggtggcgacgcgggagcagacgtgcgtggctagcggcagacggcagcgcgcgggggacggtggctcgtgggggcgagcggtccgcggcgccgcaatggtggggaaggaggatccttccccttcctccctcgtcttcctctct

SEQ ID NO: 57655 - DNA, 9267 bp, Oryza sativa
tcctccgcatataccagcgcacagctcctccttggtcttcgccggcgagcacgtctcctcctgtcatccccgttgtccccgccacggtaccgtgtctggctctactccacgccgcgcccgcaacatcaaagggaaggagagagagagagtttagtactagttgtactccatatgacatgtggggcccatgttattcttttatttttttcggattggaatgccacgttagcgccacatgtatgccacatagaaccaaaaccgttccggtttggagggggggggggggtaatttgtccggttttacaagtttagggtgtgaaatatctggtattcaagtttagggtggtaaatcgggcgaccgcgatagttcagggggtaattcgtactttttcctactacacatcccgtttataagtatgtgtacaaggttggatcttatgttaaaaatctttaaaatttctatgtttgaaccaatccaaagaaatttcatataggatttttggatggatattcttttggtcctaacaatacataggaaagaatttctatagggttgaattcctctaaaattccttaaaaaccatttgttctaaagtagccctaagtattgcactaagcatccaatgaaacatatccgtatcttatactactgttttaagttctaaagtaatgtttcacccttctattacaatgttgcattgattgtctagtaaaacacagcacgttcgattttacagttcagatcgaacgtcaacgtaatgtccttgagaaaaaagaattacaaaacataaaatgcagggaaagacctaagagaatgcatgattagtctacgtttaatacttcgaatgtgtgtccgtatatccgatgtgacacgcctaaactttttaccctgtatgtaaacacaacctgactttgtatgctcatagcaggccaaatgctatgttatgtccaatgagcagtaaatttggtgagacgcattaaaaaatattagtataatctaagatggttcattatatggctactcctaggctgtgtttgcaatcctggattcccaacatgcttgtgcaggtttagtagtcttctatgaaattagactaatctaaattactactccctctatcctaaaatacaagagaatttagttgaatgatacaaagaatttacacaataggtcaacgttatctttttttatgctagtcactattttttttaaatcttcattttttttagtttataagaaagtccaaaaccttacgccgaaaaacccaaatccataaactaatataaaatcccccatactccgcttcttccttcccaatcactatcctccgcctccgcctccacctcttctctctaccaaggaatgcccaggccgtgtggcaaagagctctccgatcgccgcatgtgatgtgagcgagggtgtcccgatctttcgatgagaggataagtcgattggtttgagcgacgttggcgatccgattacaactatccagggatgttgtgccttagcaatcgttacaccaactccagaggcggtcatgaatctcgacggatgcacgataagcccaaccacgaggtgtttgttcttgcaagcaattgagaactagcaagaacaagatgaacaagcaactcaatttgtgaatcaaaagaagatggattgtgtcgatgggggatacccgtagacaggatatagagggtattggggtacgccggtacgagcatctacgtagtacgacatcaaggaaacaagagacagagattatactggttcaggccccttgataggtaatagccctaatccagttggtatgggattatatagtggaaaccacggattacaaagggaataacagaactcgatgataccgacgagatcgtagtcgaattggttcgaccagatcacctggcgacttggctcctgtaggctccggcttcgtaggctgtggtggatgtcttagctatgagattcgatgccttaggtcctcccgagggggtcccttttatatcgcaggtcaggtggtctccaagtaagactcggagacatcggaccctgtatgatacagtgacgacccagtcctatacgggtagaaacctttccattggtggacttcgtgatgaatttccttagcgtatacagagaacgtccgtacacgcgcagatgtaccatattgccgtatagcgtacatccaagggtagagggtataccttatctgtaaccctgatagtagcccctaacttctgcttaaatgaactcatgtaaccgatcgcgacttctgatgttggagttgttgtcattctcgactggtcgatctcgatgtgagaaccgtagagacaaggagtggtcgacaacaccatgcgaagttcaactgttatgagtaaatttaaattgaagtccaaaaaccgcctcgcgtaacggacccagaaatttccggcggccatctctctcctttccttggaattcgcaccgttggtagtgcgcctatttaaggctgttgtgaaaactttctagcctccaaacactcttcgtcttctccgcttccacgcaaaccctaactcacttgcctcggtttcttctctggcgatctccggcggcaatggacctcgacaagtccacttctaccagcgcgtccttgaagaagttgcaggaggagggcgctctccccggtcgcgggaccatggagagggaaccaggaggtactgaacctgaacccatcctgggccgcatggttgcggttgaggactatattctctgtggttttcttcctccgccttctgagttgttccttctcgtcttgaatttctacggtctttctctgctccatctgaaccccaactccatagccttcctcagcattttttcccatctttgtgaggcctacattggggtagagccgtttcctgacctcttccgtttttactacgagttgcgctggatggaacctaagaaggtatccgggtgtgttggtttccgacttcgggatggcctgaagtcgcgatacatccccttccagtgcccctcttctcgtagtaaatggcgggcgaggtggttctatcttcagatagaaaattcggatccagtcttcattgtccctgaggaacaaccagacaagattttgtcttggaccgccaaacccgccttgaccccatcccttcagtctttcatcgatatcatcgatgacctccgagtgagagggttgtcggggtatgatgtcgctgccgacttcattggtagatggatccagcagctccaggctcgagcccatccagcttgactactctgggctggaggacgcgacccgggtttcttctcggggtatttttcttgtattctgggttcctttccttacgtgcgcattcctcctgacttatcgaaatttggttctcgatctacaggtttgaacagcgaaaccgtggagcgctgtgtcggccaggtgatggtcagtggccccatgacggcgagcaacgtccccgcctccccgcccctctttgagagaaaggggcggctgagcgcgaagccgcaatcaacgtgagtgtaatcgatgaccctttatctttttcctcttagatcgcatcatgacttcatgttgtgcaggctctccctcttactgacgtcattgagccgctcgtggaccaccaggcggcggcttcgttgaaagagggcgtcgccctagaggcgtccgacgtggccattgccgctgttgctgccacgactagtggcggcaatgttccgaggaaagggaggaagttttcctccgtgctcggcaaccgccagaagacgcctaccccatcggtaagcctctttggttatcgattgcgtagtcagaagatgtcgccctcacatcgtactcggtttacttcggcctcgaatgcgtctcccccgcctccacgacgacagaggctggtgacacttggcgagaagtaagtggacgaaatttgaggcccttgacttaatcaaattctggcagcttgttataatgaccaacatggaattctttcatagggcggcacgggcgaaggcggcgcaagatgggtctagagggaactccagcgcgtctcctgcagtggcctcgacagatgacgtggtcgtgcccaggagtcgtgaggtgacgcccagcggccctgccagcgatcttgtgcccgctcgaggcccgcctgctgacgtcctcacctgggaagagctccaagtcgagatggggcgcatcctcgaggccggcgctcacggcataagtcgcgagatcgcggaggcaagggcggcggcagcgtcgtcggcgaacgaacgcgccgacaagctagcgcgtgacctggcggaggttcgcgaggacctccagaaaatgagggagctggtggccggcaatgagcggcaacggcaggggctcgagaaccgcatgtcggaactcgagaacaacctgtcggagatccgtggttcgctgcgggtgtggtgtcacgaccaccatcccggcgaaccctgacgagttctcgctgacgtcttcgctcgcggaactggcgacggcgatgaaggcgatcccctccaagcacgcggccaagatcggggaggagacgtccaacgggatctacaccggggcgtgtcacgtccatgcctctggtttttgagggggtgattatgatccaggaatggtgcactgtggtgagttgtgttatgcagagggtattgtcacagcctctattcgggtacttttcagtatcgcgacgcatagtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagttagatctgttcagccgggtatggttgttcagaatggttgggcctgtgcagcatgggtgtgttgttcagtgttgattaaaatttctgattaattactccactgttttacttctcttaaatgttttgctaaatgctgctttcgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccctagttgagctgcctgtgggagtggagccggagcttcgctagattttattttccgcagcagttttcttcatgatgaggactaagtgcctcataagtaagtatttatcgttttagtcaatttgatgaatctgtatattaaattgtcagtttgtgtacctcggctgattcctggacgaggattttatgcacaaataagttcggaaattactagtgaattttcgggcgtgacaaatacccaggaaagcctcacaggcatggatgaaattacaatatgaactatggaattggggtttaggtgatgcaaactaatcccatagaactccagaatcccccggaagaatcttgaggttggaagagaaaacccactgtagaagaaatgagagaacaccacaacttcgtgtgtgtcaggggtcaggaatgcttcgccgcatgccagacgctatccgatgactctttcgctggaagaacaccatgcgccaccatctccttcacgttttcctccgtaacatcggagggtgcccattaactttcgaaggtttctctttcctctgccatggatgtgagttgaatgatgcgatttgatttggaagtggcaagaaatggatgggagatcgatgcggtggttgcgcggaagatttttgtgggagctgtgaagctctagagagatagattggagtagatctttgaaccctagctttcgccggtgtggttttgcactatagcagaaaatggggaaagtggcgaaggtttcggcggggaagacgaaacgacgccctgtcttcagcatttatttcgctagggtatcgggagtgctaatgggcctgggcctaaacaatactttcagcccaattttgttatcagcgtggctagttgtgatccttggggacttaggcatttgtttttgctttggcaacacttgctcatggtagaatagcccaatgatgttaaaatccattttaacatagttagataattctttggaattattacgatgcaaataaaaaggtgccaaacagaaaagtgctatactaattttgtaggcctttttaggctacaaagctgttcaggtcgcattgagatgactgatattgaatagtcactctcggcatgttatatgcttactttggtaatggcgtgagtcatagcttaggctatttagactcctcgtttatcatgctttataccacatttgatggatctttttgagagtttttactcggatttttgtcatatgtgttgatttatagacctttagagtgtttctcactcgggcctcttctatatcttctttttggcgtatcaaggctaaagcagtcggctggatgttttatcagacgccgcatatgcttagctatatgatcccttggatgattcggttgtaaaaccactcggatggatgttcagatgcactttgactatgtgtttagtttttatttaactaatcacatagttgggggctacacctaattaggtgcatctagtcgatgcacctgatttttttattttcagcccatcacagtctttgattttagtactcaggagaccaaggcaaaggaagttgaagcactcggatcaccattttgaattacgagggaagactatttcgtcgactgtaaaggtctcaggggctactgtggagattatggatgccccatacctagacggcatgtatatccgactgggtatgggttgccatgtatagatagaatatctttaaagggactcgggttaaattccaaacttgtatgtcaaggaaaaacccgagatcctagtcggttacgattgtatcttatctgtaactacctattccgttagggatatgggctgtactttgtaatacggaccccttcccctatataaggaggggtccgggtgcctcttggggtacgatttttctcccagatcatacgatcaataatacacttggcggatcaatccccggacaggagtagggtattacttcttattaagaaggcctgaacctgtataaaattccttgtttctaaacccatccagttttctagcttgatagccaccccttttagtattgccgaaatcttgtttcgacacgcctcttcggcttcccgtgtacatacaaatttgtctagttttttcagcagagcgaagaaaggttgtcctcgttctcccatccaagcgacgaacctgcttagtgccgccatgcatccggttagcttctgtacttccttgagtcttgtaggcgacttcatgttcttaattgccttgatcttctcggagtttgcttctattcctctgccagagacgaggaacccaagcagcttgcccgatggtactccgaacatgcactttcagggttgagcatgaggcgatatcgtcggagattgtcgaaggtttcccgtagatcgtcaattaatgagtcgcctgtcttggtcttgacaacaatgtcatcgacgtaggcctcaacattgttacccagctgatcattaagtgccccttggaccgtgcgctggaaagtatttcatgcggttatcagtccaaacggcatcttaacgtagcagaatacaccgaacggcgtgatgaatgctgtcttctcctcgtcctcttttgccatgttgatttggtggtagccggagtaagcgtcaaggaagcttaacagctcacaaccagctgttgagtccactagttggtctattcaagggagagggaagtgatccttggggcacgccttgttgaggtcggtgaaatcgacgcacatcctccacttcccgttggccttccgcaccatgactgggttggctagccactctggatggagtacctctctgatgaaaccagctttgagaagtttgtcgagctcttctcgtatggcctatttccgatctggtgcaaatctccgcagtttttgtttcactggcttggcatcgggtcgcaccatgagtttgtgcttaatcacctccctagggacccccggcatgtcgggcggctgctaagcgaacacgtcagcattgtcgcggaggaaggtgatgagcgcgagttcttatttctcgttcagtgatgccccgatcttgactgtcttgtcggggttggcactggagagtggaacgattttgattgcgccgtctggtttcggcgtcttagttgttttgctcactttcttgggtggctcggctgtggcgggtgggctgggcatgtgctcgaccatgtcgaggctccgcttgtcgcattggaccgccagctttgcgttcccttgaatagtgattgttccctttggcccgagcatcttgagtacttgatacgcgtagtgagatgcggccatgaacttcgctagtgcagttctcccgatgatggcattgtatgctgtgtcaaactcagcaacatcaaatgtgatctgctctgttcggaagttgctcgcttggctgaaagtcacaggaagcgtgatcttgcccaatggcttggacgatgactgaggattgatttcgtggaatggttgatcggtgggtgtcaactcacttcgtggaatccccattgcgtccaaggtgctggcgaagagaagaatgaaggagctgccgccatcgatgaggactcgcgctaccttgatattccgaatagtgggttcgaccacgatcggatatcgtcctgggataacagcagccttggggtggtcctcatctgaaaactcaaacttctgttcagaccacttcatcttgggtgcagccccctgccatgtcgaacaaacttcacgctccactttcttgtattctcgctttgaggagtacgtcatggaacctccggagatgtgcgagacatgaagatcggaatctgggtacgccgagtccgagtcctgagtggaagccttggcggctttctgtcacaccctgaaaattcaaaatatataaattgttgtttaattggaattttttagaaataattttaaaaagtcttgaaaagaagatctaatttttaattaataaattccaatataaaatgggcccagataaaatttccttaaatactttgcttaatgctataattcctagatttttctgggatttatttgagctaagaaagtattttttaataaatgaaat

SEQ ID NO: 57656 - DNA, 13523 bp, Oryza sativa
attcctgcagcccttccttctccggccgaatcaatagaggggaaacaatctccgggatctcctctaccttttctcctttggaatctttggctaaatcgctttggaaagagttggattcgagttcgtctcggatttgttcttcccgagctttccttcgccgttgccgtcgcgtgggccttcgccgccgcctccgagcccctttaaaaggacccccggtgtctcctctacccgtcgccaccttcgccttcgcctctcgtcgtcggaatcgctctagcgccgtgtgccctagcttcgccgtcgccgccgccgctccagccgtgctccgccgctgttccagacgtcgccgtcgctcgggaagaccgtcgtcgtggtcgccaagtcgtcgccgtcctcgtccgccccttcgccgtcgccggagatcgtcggagcttcgtcgccgtcgacaacccgaaggtttccgccgtttcctcctcgtcgccgtcgtcgttcgttgtttttccgccgccgttttggtcaccggtgtgttcgccgcgtcgtcctctacgtgctggtgccctccgtttgcgtcctagtgccgccgttcaccggcgagcgtgcgccacccgagccgtccgctccgccgagccgccgccgctgtcggtgacgtcattgccgacgtcatcggggtcgtccgccgtgagccggtcgtggatcgttcgatctcggccgtccgttttggattggatcgatctcggccgtccgttcgcgtgaaccgccgcccgtgcgcccggtccaccaaaaccctagccgctgacgcaataaaccctcttttccttttcaaaaataattcattattgcgtcataattcaattttaaccgatttaagtgttttaatccgattaaatctttaaaaattcataactaattcatcttagctccgttttagttggttcaagtctctaaatttttctaaaattgagatctacacattaaaaatatccacatgtactgttcatgcttgtttatgtgctgtttttgtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattattatagcccttttgttcttgattactttattccttgataccttgggttataataatttgactagttgagctttatttatattggttcaactagatattagatataattgcttagccctgcttagaaaccttagcacatttatgggataactaatgattcactattatttcatgatggcttattgatagttcacgatggacaatcgtgattggttaattaattaatgtgccaactaaaacctgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgtgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgtggttatgggcgggtctaacaatgtctttcgtgattagtctcacccttctcaccatagtaaatgatgctataattggtaataatttgattagctcctggtatggaatagtaaaactattcgaatttctttcactgacagtgggccccacaccctctgggacccacatgacagcctcccactctcccctcactgcatccaccgtccccccatgcccaatggatgctcaaggaacacaatgaaagcaccagccacctctctctctcactcccccactccactcttccttatatcccaagccaaagcaccagaagcaacggcacactccccacatcgcgttccaagtccaagaaaacacaccccacacacagaatgcccagagctcggccgtcttacccggctccggcgaattagccgtcgtcgccgtgcatccccggtgagtccctctctcttccctcctatggaacgtgacctacgcatcacgccgagctcacccataccccttttgccctaggaccaatctgtcgagcacgtggtgggtgtcaccatcctcgccgccggccacccgaaccgccgacgccgctccggccgccgttcctcaccaccgaagcaacaccaagctccggtgagttttcgccggattcctcgtgcatgcaccctctgtggctcatctctaacacccccgtactctcgaagttgcagttcgcgccttgagtcgacccggcgacgtcgacgccggagttttgccgccgttggccaacaaccaccacctccgccgctccctggacctcgctgcctccgtttctctacttggtgagcaccctggtaccatatgagagcacatgcactaaccctttccactaaccaagcctctgcatgcacatgcatgggcataccgagacacaccgccgctgtagctcatgttccatgggctacagaccaccgtttccctcaccaccaccactcacggatgcgcaagaacgtcctctacattttctcttttgggctcgaaccgattcgatccaccgatcgccgccggtgagccatagaccgagctcagccatggctgctcccgatgtgagctagctggggacttcatttcttgaatttgatcgactctagggtccaatctgaaaactgccatgactcatattactatagcagcaccttgatggaaataaacaaaagaatagagactcttaataaagtttgctgtccaggtggcagaaggagtgcgggttgattcccccaacttccgagggcctctctgcaaatctactttcactgacctgtggacccggctggaatccaatttcgaaaattgatttctattttggtttaaaacagagaatgagcagaacttctaaaatttgtagaaaattcatcttaacttcaaaaattgtgaaaccagtttggttagattcataaagctgtgaactattttacaaaaatataaaactgggtactttctgtacaaacttttcctttattttgttttgccataatgttgcctagaacttgttaaatccataacaaattgaatatagctataaaaattgtgaaaccacttctgttaactttataaaatcatgctctgtaagtttgtaaaaggaatttgttcacttctgtacaaaaatgttgcttaataaaacttagccctttttaaaccctttttaattgtaaaatgcatatctctgtaaataaaaaagtgacaaaataaaaattccttcaccagagaccacctaagaccagcacacactcactgcataagtttcatgcattttcatgcattttggtttttatgcatttttgtatttatcgtatacgcgtattttgtatagaggaagaatacgtcgaagaagaagagggtgagtttgttgacgaccaggttcaggagtttgcagacgaaggcaaatttgcccctcctttgatcacattgatcctatgttttattgggctaaatgattctattgcaaacatgcatacgttacctagtattacttttggttaaaaaatatataaatgtgggaatggtagatatgacctaattgctgcataatccaccttgaaatattgaatccttgctggttgtaaccatagagtgcttttgaatacaattattgtgttctttgggattatactatgcttatattgccgctatatgcttatattcggttaccgccttgcaaattactcgttttgataaatgttatatgtgaaaatggttattttgatgttgctggacagaaatttaaatgtgtgagtattgtgaactgaaaatggagataacttgtttttagacttgggcggcgagtagtgtacatatggtggtagttgtacaccgatagggggagcgttcgcccgggtcgattaaggaccccactctatgtcaccaactaatgaaaacagtacaaaccacatgtgctaagtatgggctggcctcaacctattaagttgtttagagtttagccttgcatcttggtaggccgaagggtatgggttaccgggacttggtaacttatcggaacttcctatggtttgtgatatgatgaaattgattaatgatatgtggtatgtgatgattttagtgggtagtctatccaatacaacggtgtcgtgcctcgtgagggattccgggcctgggttccttactgcgctaggttaaagcgtgggcccgctacctagtggcgctaccttgctagtagcgtgggtaaaacacacatcgtgctagtgcaaggctagacaataaacaatgtaacggttccgttatgacctctagatcacactcaatgtgtagagtgtggtgataccgacgggtatcggaaaaactagagcgatccatatcatgtgggcttaaaagttgtacaaactctgcagagtctaaaactaatcgattagccgtgctcacggtcatgagcggcatggtgaagtgtcatgagtataatttgtgattttgataaactcttgtgaacttggaaaatggttggaatgttttgtttgtgaacttgggtaaagttcggtgaatggtgatgagatgatggaaagtggtgatgatctaccttgaggggtagatgtgtgttatttatccatttacattacaagttttacttactctatactattgttataaaattccgttgcgaaacatgttgtgaactaaaattggcatttatgtaaattaacctatacacagcttatccttgaatatggccaacatgtagaatgctaggattgcttccgacttgccagtacattaatttgattaatgtactgatttcttgctttcttttacttgtttatgctcagaccccgctgcaggtaatgactgtttggatgaggagtttgatgcagcttgtgatgttgcagatttccaggatggttctaactagggatttaccctagtcggtttgcctatgggcttttgggtagcacgcttaccgcatgaaccaatatttatggcttgtcgccaagtactacttagaaccttattaagattatttatgcttattgcttagaaccacttattatttggatatcatgcttgagatgatttatgtgaggctatgttgcattcctggacaactagtcccacatgaggatgggtttgaaatggttgagataaccggggaatatgcctttgttgagatcgagtctctggggtatgcttttagtctccaccatcgagtggttgacgggcgtatgacgtagatgactggtgtggctattccaacggttgtcttctatttcatatccgatggcttagagcctatgtagtgcacccttcaagacatgtcggggtctgcgatgaggttggatggttactgtatttatttgggctttatttgagaccccatccatccagatatttcgcgctgacatgccttggagcgttgcaccacctaggctttgggacgtccttacagctttggtatcagagccgtgaccgactgtaggaaatccctggaaggaatagtcgtagaatggtattctcaaaactatcttggaaaaaaaattatttgtgaaaccctatttctagaattccaactccttctaggtgatactttattttgaaaaacggttttctctcctcttgatcctataggctacggaaatctcatatatatatgctgccatctgcaaatatagctctcattcaatataatcaacttaaaatgagtgccaactaaattagaaactgaaaagaaaagcttatgcaaaaccttcccatgagagacgtttgtttttgccaaaaatgcttaggttaactagttaagcataggtttttgaatgacttgagcaaataaaattttgctagaacttctaggatgagatgctgggtaggtcgtctcaggttcagcaatgaaccctcactaaaaattctaaatgccggaataaaaaaaaaaacgtcttggcctagcatgggtaggatggggcaggatgggtatctaggattttgtttgctttctgtagctttcaacagtactcacccctgaaccagattagcttagtatcaacttagcttcatgtagaaaaattttgataatttttggcaactaaaacatggcttagtaaattatttagcaactaacggttatctgtcagggactgcagtcggcagtcttaatctttttgtacaggatagaccgtaggtggaaaaattatgaagcttggccagttgttagaagacccctgtaggatgttgcttgaatttttgtgtgattttatcttcagttttgcatggtctaaaaattcgagccacccactgaaccctggaaaaacagaactgcaccctttagctttaaaatttcttgtaggtcttaaaacttgcttaaaaattcctaaaattttgaggggggtagataacctatacagaaacttagttgtgcaaaaatttcctttttagcagccacctaaataggctttttacccctgttgttgctgtggtttgctcctgtccagaacctgaaaactaagtcttcttgttcttccttgatcctccctttcacttaaggtttctaatctaggtaatcttgtcctaatcttgtagatggctcccttggaaccctcttactattccggaggcttcgtggctggcaccatgcagcaaacactctgggaaatgatgcagcacgccggctatactcggcaaccccagtacactgtcttcacgcgaaactatagcgcctctcaaaggagctatcaggttgagctggtccttccatcgaggggcaacgacagacaccacgatattgtgtacggcactgggtggactgccgtgggagctatgaatgatgctgcctacagcgctaccggctttctccgtgacacgagcccgaagtgcgctgtggattaccgctttgttccctctaggccgggtgctagtcgctttgccacctaccctggtctggaatctgctcaaggggaaccgccctcccctcacctccgtttgggctacttcgttaggtcccaggagaggatcatcgaggatctgatgcatgagctccatcgagcgaggcggcgcatcgctattctcgaccgtgaggtggaaccccgagctgggatttgggccatcccacccgaggtcgtgtacggcgaagacgccatgctaccagcggaggaggagctgccccctccatcaggttactacaagctgattacaccatctcctactgtcaaagggcatggtggtagtcaccgggttgttgctgatattccacccccttctggcctccttgttgaggggccaaaccacatccgatattaccgcgggagctgttaccgtttggtgatgcaggcacctccgcctcttgatgatgatgcggagatgacttctagctcttcgggttctcccggaccttctgacagcacctaggcttgttctagctaggtgacttagatagtttctttagcatgagatgtaggatgacctctgatgtactccccttagccacattttggatgtgtgcgcgttttgtaaacgtgttttggtggctatttatgtaagctcttttgtatggaacctttaatggaatgaatggcgcatgataagcgtgtttatgaaccattttcgagtatccatgcttgctgtccagaaattctaactgtgatgatttgttgttatcaaagttaaattactgcttaaatacatgcttttaagtgtctatacctttccgtacttttggattgagttaacttattgcaattcctttaagcactacttctatatttctgtccttcctttcaacttgaatcatgccatgtctatcaatctcaagaaccttttccacttccgtgttttgtgtacagaatgcccgttacccgctctaggagcaataaaacggcagactcagcaagaaaccaaaacaacaaccaccacaactcgcagcttccaccacctcccactcggaattcgggagcgagtggtagccgtccaaccggcgcgatggatcccactttggctcagattctcgcggcgcagagtcagctcttcgaccgcttggtcgcgactcaggaggccttgggcaatgctctcctccagaacaaccgtcagccacagtctaagctggcggaagtgcagcgtacacagccacctgtgttctctgctgctgctgatcctctcgacgcggatgactggctccgcgatatcgagaacaagcttaacttcgtccgttgtgacgatgaggagaaggcgacctacgccgcctactaccttcagggcgctgcagctgcctggtgggagacttacaagtctacactcccccagggcaccgccatcacctggaacgtgttcaagcagggcttccgcactgctcacgtcccagaagggcttatgaaggccaagaggaaggagttcctcaatctcacccagggggacttgcctttcatggagttccttagtcgcttcaactaccttgcacggtatgcgactgatgagctaggcactactgaggcgaggaaggtgcaactttgccttgatcgccttagccctgagttgaagcacggtctctctacccatgagatcgacagtatgaagacccttgttgacaaggccctccgctgggaggcaagtgagaaggaagtagctgtggaccgcaagcgcaagttcttggcgcgcagggctactgtcagccgttcgagtcgcccacgcacttggcagcctgctccagctgcacgtcctgcttctgctccaccgcagaggctccagtacgccgctccacgtctgcctgccgctatgccaccgcaggccaaccgtggtgcaccgcagcccggaggctacaaccgtgctgcaaatgttaactgcttcaactgcgggaagttgggacactactccaacaactgtccttacccgcgtcgcaccggtgctcctccgccgcgccccgcagcaccgcagccccgtcctccacagggccgtggcgcccctgctgctgctccacgtgggggccgagccgctcccaagccggctcagaactttgggcgcggtcgtctcaaccacgcgaccgcagaggaggctgttgacgcacccgatgtggtgctaggtacctttcttgttcactcagttcctgtttggtgttatttgattctggtgcatctcattcctttatatccaccaaagtagcaaaacaaaacaacatagccaccacccttttagacacccccatgataatccaatctcctgggtcaaccttcaaaaccagaacaatatgcaaggatgtgcctattctcattgataaggtagagttcaaagccgacctaatccaagtgagttccttaagtttagatgtcatcctaggcatggattggctttccaaacacaaggggaatatcaactgtgcttctaaaaccatctcttttgtcaacaccaatgggaaaacagccaccttcacttccaataaagccaccacctcaaaacagccatgtatcaagtctctcatcaaacctgagcttgaatcaatacccgtggtgtgtgaatatcctgatgtcttccctgatgagctaccaggaatgccacccgatcgtgacattgagttcgtgattgatcttgttcctggtgcgacgcctgtcgctaagcaaccctaccgtatgaccagtgatgaattggttgagctcaagaagcaaattgatgagcaactggagaagggtttcattcgacacagcagctctccttggggctgtcccgttctttttgctccaaaaagtgatggtacgcttcggctgtgtgttgactaccgtccactaaatgaggtgacaatcaagaacaagtatccactcccccgcatcgatgatctctttgaccaaatgaccggtgcgcaagtattctccaagattgatttgaggtctggatattttcaactcaagatcagaccggaggatattccgaaaacagctttcagaacccgctatggtttgtttgaatacaccgtagtttctttcggcttaaccaatgctcctgccacttttatgaacttgatgaacaaggttttcatggagtacttggacaaatttgtggtggtgttcattgatgacatcctcgttttctcgaagaatgaggaagaacacgcacaacatctaaggctagtgcttgacaaacttcgtgagcatcaactctatgcaaaattcaacaaatgcgagttttggatgaatgaagtggcctttctcggtcatgtgatatccgggggtggtatcgcagttgatccaagcaaagtggaaagtgtgcttaactgggaacagcccaagaccgtgacagaggttcgagcttttcttggcttagccggttattaccgccggttcattgggaatttctctaagattgctagaccgctgacccaacttctcaagaaggagaacaagtttgtatggtcagaggtatgcgaggcaagtttccaagagttaaagaaaaggctcacaacggccccagtgcttataatgcccgatatccacaagaatttcgatgtctattgtgacgcatctcaaaatggcctcgggtgtgtattgatgcaagaaagaaaggttgtggcctatgcttcacgtcagctgcgccctcatgaactcaattatccgacccatgacttggaattggcagccgtggttcatgcctgaagatctggcgccactaccttatcggtaaaagatgcgaaatctataccgaccacaaaagtttgaagtatttcttcacccaaccagatctgaacctaaggcaaagaagatggttggaactcatcaaagactacgatctcggcatccattaccatcccggtaaagccaatgttgtagccgatgcactcagctggaaacttaaccacatttctgcttctgaacttgtcacacaaccagagttgttactggaatttcagaagctcaatcttggtgtggttgaagaaggttttgttactgccctagcacttcaaccgaccctcctttctcagataaaagaggctcaactcactaaccaggaggtagctgaaattaaaaaggaaatggcaagtggcaagccaactatcttttccttggatgatgatggtgttgttgttcatgggaagcaattgtttgtccccgacactcaacatcttcgggagcttattcttacagaggcacacgagtctcccatgtccatccatccaggttgcactaagatgtaccaagatatccgctctctttattggtggcctaccatgagacgtgatattgctgcatatgttgctatttgtgatgtgtgtcagcgtgtcaaggctgagcaccagcgtcctgcaggtttgcttcaacccttgcaaattcctgagtggaagttcaatgaagttggaatggatttcataacaggtcttcccaagacttctaatggacatgattccatatgggtcatcgttgaccgcttgaccaaggttgcccatttcattccggtgaatgtctcctacaatggtgcaaagctggcaaagctctatttgactcacatcgttcgcttgcatggggtaccgaaggccattgtatcagaccgtggtccccagttcacttcccggttttgggagaatcttcatgagctccttggtactcaattgttctttagcacagcttttcacccacagactggaggtcagactgagcgcaccaatcagatcttggaagatatgctcagatcttgtgtcctcagttacaacaccaattgggagaaatgtctgtcctttgccgaattctcatacaacaacagttaccaagctagcctccaaatgtcaccctttgaggctttgtatggaagaaagtgtagaaccccactcttctggtcagaggtgggagaaagacaactctttggtcctgccgttatcaaggaagccgagcaaaacgtcgctctcatcagaaaccggctaaaggaggcacagtcacgccaaaagagctattccgaccgtcgccgtcgcgaattaagctttgaggttggtgactatgtctatctaaaggtctcgccgttgcggggcactcgccgatttcaagtgcatggaaaattggcgcctcgatacattggtccatatcgagttcttgccaagaggggtcaagttgcttacaagttgcagctgccatctcaactctcagatgtgcacgatgtgttccatgtttcgcaactcaagaagtgccttcgagttcctacggagctcactccgctagaagacatcaatatccaacccgacctctcctaccaagagtatccaatccgcattctagaggaagccgagcgacacatgcgaagccgctccatcaagatgctcaaaatccagtggagcaaccacactcccgaagaagcaacatgggaaagggaagaccgccttagagccgattttcctagtttcttctcctagatcctatcaaatctcggggtcgagattttgtttaaggggggtaggtttgtaacatacccaagcctgtaaacctgagaactaaatttaatttaaatgcatcatgtggttgtggagtgattttaattgtttttggatcttaatcatctcatcacatgcatcttgataggcctagagtcacaaaaataattaatctggtaattatatgcatccaaaacttccacaaaaattctcaaaaatacattgatatgtcagaaatcaacccacaaattttcagagtttttcagtaaggattgctaacttgttgatctcctttaatctctccaaaaatcatgaaaagaactgcttagcagattcaaacttgctctctctgtaaaatttatttcaaaacccctttttgaagtttggtttcagccaaagtcttctactaactttcttctagcatcctgaggagtggcacaccctggatcactctctaaccctttcttctctccctccaaaaatccaatcagctgctaactgcactgtcaactgctgctaaccaacactgtcaatacatgttcatcactccatcaaacctaaaccagagacttctaaccaaatccacttcagcacatttactctccacatcacccctgaccaagaggatatctagcccagatttcttgctgcacaaaatccaccttgaatcccctccaaagatccttggcaggcaaccctctttgacttagcctccaaggctattttcgaatttctttcactgacagtgggccccacaccctctgggatccacatgacagcctcccactctcccct

SEQ ID NO: 57657 - DNA, 1005 bp, Oryza sativa
accccgctgcaggtaatgactgtttggatgaggagtttgatgcagcttgtgatgttgcatatttccaggatggttctaactagggatttaccctagtcggtttgcctatgggcttttgggtagcacgcttaccgcatgaaccaatatttatggcttgttgccaagtactacttagaaccttattaagattatttatgcttattgcttagaaccacttattatttggatatcatgcttgagatgatttatgtgaggctatgttgcattcctgggcaactagtcccacatgaggatgggtttgaaatggttgagataaccggggaatatgcctttgttgagatcgagtctctggggtacgcttttggtcgccaccatcgagtggttgacgggcgtatgacgtagatgactggtgtggttattccaacggttgtgtcttctatttcatatccgatggcttagagcctatgtagtgcacccttcaagacatgtcggggtctgcgatgaggttggatggttactgtatttatttgggctttatttgagaccccatccatccagatatttcgcgctgacatgccttggagcgttgcaccacctaggctttgggacttccttacagatttaatttttattaaattctccatgattaagtcaactctctggaatattctcggatttttcagagctcaattcctaaatgatacaaagagcagttcagtaattatttgatcattaatgatctaattaaaatcctaaatatataaattgttgtttaattagaattgatcttaaaagcttaaaagagaagatctaattttaatttgctaaatctcaatataaaattgggctagataaaattttgttaaatactttgcttaattctataattcctagatttttctgggatttatttgagctaaggaagtatttttaataaatggaattgcatttcatgaattatttaaactgaaaaaggtttttaaaagtctcttttggctttgggcc

SEQ ID NO: 57658 - DNA, 3905 bp, Oryza sativa
ttgagttggattcggattcatctctctcctctaaccctaacctttccttcgcgtcgccggtcgccgtgggcctccgtcgccgctcgctagcccctttaaaagcacccccgagctctcctctatccaccgccacctttgccttagcccgccgtcgcgtctagcgccgcctccgcgtagccctagccgtcgccgtcgttgccgtcggttcagccgcgccgcgctgccgttgcagccgccgtcgtcggtcgccgtcgccaccatcgggatcgtgaggtcgtcgccgtccccgtccaccgcttcgccgccgccgaagaccgccggagcaccgccgtcaccgtcgacccgaagaccgccgccgcttcttcctcgtcgccggcgccgtccgttgctcttccgccgtggttttggtcaccggtgagttcgccgtgttgtcctctacccgttggtgtcctccgtttgcgtcgttgtgccgtcgttcgccgacgagcgcgcgaggccgagccgtcgccggtgatgaagtcatcgctgacgtcaccgctgacgtcatcgtcgccttgtcccgtgaaccgcggtagatcaagttgatctcggccaccggttttggatagaatcgatctcggccgttcgtttccgtgagcggccgccgtgcacccggttcaccgcaaaccctagccgctgacgcaataattcccttttccttttcaaaaataattcattattgcgtcataattcaattaaaatctatataaaggttttaatccgatttaatctttaaaaattcatatctaattctttgtaactcagtttaatgtggttcaagttgcaaaagttgtataaaataaagatctacatattaaaattatccataaattgaattaaatttatttaattctttttaaatgggctttaattagatttaatctagtaaaattcataataaattcatctgaagtcagaatgaggccgttcaagtctcataattcatctaaaattatgatctacatgtttgtttactttatatgtactgtttatttggtttttattagtctttttcttcattttgcgtgttagcttgtcgtttccgtcgttgcgaaggttcgcgagtgcgtcggaagtgttcaagaagattatttgaagaccgattattgcaaggcaagtcacacagatcctaaacacaatcctttgagcatgttgatcctatatttaaattctctatttatttcaactgtgcatttattttcgaatgtcattgggtggtgtgaatctattcctttgttatggcctttttgcattgattactttattccttgataccttgggttattataacttgactagttgagctttatatattggttcagctagatattagatatgattgcttagccatgcttagaaacattagcacactattgggataacttatgactcattattatttaatgatggtttaatgatagttcacgatggttaatcgtgattggttaattaattacttgccaactaaaacttgataatggtgggttgtgagcacatggttttgagagtcatgctcatgacaattaaggaccggttcgcgagctactgttgtgaaacattaaccgtgccaaccacaagccagcgtgggcaacggctttaccttttgtataacatggttcattgcggagcaccagactgagaagtggcggagataagcccacgggggtcgctggggagtccatgccttgtttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcataacaattatggatgttatacctggtaataatttgcttagctcctggtttggagttagatctgtacagccgggtatggttgttcaggatggttgggcctgtgcagcatgggtgtgttgctcagtgttgattaaaatttctgattaattactccactgtttcatttctcttaaatgttttgctaaatgctgcttttgcaaatgagcctatattatgccatcctttcgtatccttgtgcacttgcatatttgctgtgtggcttgttgagtatgtcatatgctcattcttgcaataatcaatcaacctcagttgaagaaaaaggatctaggaggagaagacgtttggcttataccctagttgagctgcctgtgggagtggagtcggagcttcgctagattttattttccgctgcagttttcttcatggtgaggactaagtgcctcttaagtaagtacttatcgttttagttaatttgatgaatctgtatattaaattgtcagtttgtgtacctcggctgattcctggacgaggattttatgcacaaataagttcggaaattactagtgaatttttgggcgtgacaccagactgggccacaaactaagccttacccactagacatgtggaagtacggtagtgctttgcaacagaggcccgaagaccggtccttatatggccgaggtgctactatcaaaaccatgcaccctgagcccagcctaaaaccattttgaggattttgaatagagggggaggtgtgaatccaattccacaataatccaaccattccatagtgtccaggtgatatgaacattcccaaaatctagagttgtaaaaccacctaatgttgcctaattaaccagcgaaacatctacctaaattcatactagtggtaccatgcatagggtacccactagttgggggttttgtttagtctagggtgaacaaggtaataataacaataacaataataaggtcaaaacaaaggtaaataggcatggctagataaaacagtgataacgcgggaatttaaataaagcgataatgcattaatttaaatcaaaataattttataaactgggattcaatatgttcaaggatgatgtgacttgccttgctcgctttcccaaacgtcagcttcaacctccacgaagagtggatcttccgaagctgcagcgtctacacgaccaacggaaaagaaaaaggtttttactctaataaactccatataaaaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaaaggtttattgcgtcagccgaggggagggggcgcgcggaccgggtccacgggagtggggcccacacggcagcctcacggtccacggtggaccgggcgcacccgggctcgcaccggccagcgccgtggaccccacacgtcagccgcacccgatggcgcgggcggctgacggccgggccccacgcggcagccactcggcgcgcccgggggcggccatgccggcacggtcggcaggaggcggcgcgcgcgcccctatggtcgccggcagcggccataggcacggcgtagaggcggccgagagaggggaagggaagggggaaaagaggcggcggtccacggctcaccctaggtcgacggcgacgacgaaaaaggcggccggagcagaggaaggcggcggcgcggcttgggtcgacggggacggcggcgctccggcggttggcgagctcgacgagggggtgaacgggacggcgacggtgcggcgaagccgaaggaggcgacgccggggcgggaaacggtccggggcgacgacggcggcggacc

SEQ ID NO: 57659 - DNA, 16999 bp, Oryza sativa
  unsure (1)..(16999): unsure at all n locations
gggctccatcaatggcgccggcgggattaggggaggggttccaaacgaatccaagggagagagggagggaaaattggggggaaagggagagggaatcacggggagtatttccccccactttattgcacgcggggacggcgggatgtggcggatttggcggcggcggcggcgcttggcgcgggcggagcggcgggagcggcgggaggtcggggatgacgggtgggccccacccgtcagcgagggtggcgggcgggcccgcccgtcagcggcgcgcgcatggggagggaggccgactgggccgcgggggagaggagagagagagaggggggagagagatgggccgggccggcccaagggaggggagggggacttttagagtttttctttttataaaactttttcaactttgtttatttcttaacaattattatttgtgctctgaaaattccactaaaatttatttacacattttaggcttttagaaaatacacaaaaatcctctaagccttgtatgacttttactttgcacattttaatttttggaggctttcacacggattttaattattctagacataatttagaggatgtattttagagtcgttttgggacgtgacacatccttggctggcttcttctctccccccgtctttggcttgtcgttcttgcgtctcaatgcgtcgtccgcatgagcgcatcgatcggtgacctcgaacaatctttgagtagttgtgattcgccttgttgccaactcctgagtagtatagcgatctctgaccccggttttgaaaaagcgaatcacagaggcgtcggtgatttcggggattgtatttctgcactcattaaagcaccgaacatagtccctcaaagattcgcccggattttgtgttaacgcgtgtaggtcgtcttcgatcgcgtggcgcttgtaagttccttggaagttagcgacgaattgctgccacagatctgcccatgaagaaatcgagtagggcgggaggtgcatcagccatgaacgcgcagaacctttcaacaccatcggcaaatagtttgctaacgcgttgtcatctgctccggcagcgtatagtaccgtggagtagacctaaaggaattcttctgggtcggtactcccatcgtacttctctattgccctgggtcagaatctctcaggccatcggacatcacgtagggaacggttgaaagctccacacccgacgctgggggcggtgggttgtcggcgatcgtatgtcctccgtggatatctatcggatgacaagaatgaaaaggatgatgatgatgacgatgggtcactcggctccggtgtccgattccgaggacgacgttcgggttctcaagagttctgtcgtcgtccaccattgttgtcctggcgctgatccccattatcatcgtcgtcatgtcggcgtcctcgaccagtatcgtccggcgtccgctgttcgcgatcatcgcggtcgtgggggttgtgacgattatcatggtgtcggtcttcgttcgagcggcctcctcgttcttcgttctcgcgacgtcgtgaagagacacgatgtcgggagcgattctcgttgtctcgcgcgcgtcctgcttctcggcggccattcagatggtcgcggagatcgccggtgccgcgaggtggaggggtagctcgtctaggcgacgtccgttgctccggtggttcgccgtcggcaccgccagctatcggatgttctggttgtgctctggtagcggcctcctcgaacgcgttactgagattggctaccgattcctgtagtcgttatgtccatcatgcgagatcatcgttaagtacaggatcatagggggtttctgtcagtattgcgttgatggtgccgaggtgttgggccggtgtgaccgcttgattctccgcctctgcgttagcgtgtgcagacgtgctggtcccaccgatggcaaatacgtcgcgtggtgtactggaggatgatgagccatagtcttcgagcaagtgtaggactgacgactcgtggggatcgatgtcgattactccaatgaatcgatccgagatcaacgtcgctccttgttccttgtctgcatccttaagagagatttttgattgctggaccttaggaagcggcgtcttaatggcgcagagaaggaccttgtagcttgagaagtcgtgattcttcatcttgtgaataggacaatagacatcacgagttagagaagtacgctggattccatgctctttgcaggcatgaatttcagcttgtacgttgagaaaaacccagcaagcttgcaagttgtgtttcctggacttgtggataggacactagggctttgttatctcggaagttgtccttgtcggctcgtggttcttgtcggaaggacaaggtttggccgcactaggaaccttctcaggctcgtatgacgtcgacgtttcgttctccgctacggcgggaggatccttcgacatggagttgcccggggttatagccacggcgttctcatttccggtcattgatggaccagccgagataggtaccgtggtgtaaaccgggaagacgatttcgtcgacttgagtccacactagcattgttgaagtagggactccttggatggggccggtgttgacgctgttgtcgatgaagcttgatgtcatagtagtagaaccttgagcaccaaggccccctacctggcgcgccactgtcgacgggggttacccgtagaccggatatagagggtattgggatacgctggtatgaggatctacgtagtacgacatcaagaaaacaggagacaaatattatactggttcaggccccttgataggtaatagccctaatccagttggtatgggattatatagtggaaaccacaaattacaaagggaataacagaactcgatgataccgacgagatcgtggtcgagttagttcgactagatcacccggcgacttggctcctgcaggctccgacttcttaggctatggtggttgtcttggctatcagattcgatgccttaggtcctcccggggggtcccttttatatcgcaggtctctctaagtaggactcggagacatcagaccctgcacgatacagtgacgacctagtcctatacgggtaggaacctttccattggtggacttcgtgatgaatttccttagcgtatacagagaacgtccgtacacgcgcagatgtaccatattgccgtatagcgtacatccaatggtagagggtataccttatccgtaaccctaacactaacaatttgggaaacgttctaacgaaaaacgaggaaattgtgatttggagttgtagtttagaactcaacctaagatggtgtttggatctacctcattccatcttctactatctcattttgcagaagcatgtttttctaactgataaaaggtgtgccttttaaaaaaattatagaaagattattttacaaattttcataattttttttagctaagactttcttgggctctagcatgcagcacatgtgtacagcaatcgccgctttcagggcacaagctagagagccgagggtgtgttacaagcggcataaagttttggtgtatcacctcaggtattatatagatctaggaaggtagccggggatgtattgtacacagggttaaacttttcggtttagacgatttgatcggcatcaccgaaataccaaaatttcagtctgaaatttccaaaaatttgaacaaaatttagttgaatttaaacaaatattaccaaaattcatgaaaaattaaaaaaatgaaaaatttcggccgaaataatagcctaaaatattgggtccaccgacagtggcggatctaggatttagaatatgggtggtccgacctaattttttttttctaaacatactaaatctaacgatggtaatatataccatgcaagtatagataatagaatagaccaaaagtgtatcatgctatattaataaagcatcttaaaacatataaaattagtaattacctaaaattttgacttaaagaagcttacatggctataaaagttttaaaagaattgccatactaatttttcttcttattaggtctacgccttctgttggaattaatggatgggccttagcccactcgaagattaattctttggaaaatcacaaaagcccacctcatgggatggcatgcatgtggagtttagtaccaccttgcttattctaagagagggggacctccttaaaagggaggatgccctcctagccacttgaagcatgtgtggtggagagaagagggggaacacacgcgcgcgctcgctcgcctcgcctcgcagggcaggcggcgcgtgtgcacgacgtacgcgtcgaatggtccgccaaaaattggttcctcaccttgcgcagatgcagcctccttttgcagttttgttttgctgcaaattcggattcgtttttgttttcgaaacgttccgaaaaatccggtgcgtgaaaacggcgtggagtccggataagttacacgtgacttatccggtttggttacgcacagtagagatcgtgcgggcgccctgatcaagcgacccttctctatataaaccgaccagccgtcttcacgcaacacacaaaaaaatcaatctagggtttgcctccaactctgtgctgcgccatcgctcatagattactccatcccgctcgccggcgtgcaccggcgatcgggagagcaggtctccggaacctctgccttcgacgtcctgcaccgggagaaggcggcaataaggtttttgggaagcgctgagcgcgactgctccctgttcgtccgcgacggctcgtcttactcttcgctcgcgtgctgcgcgccttcatagacgcctgcaatcgcgaaaagttcctgccgagcagccggtctttctaccacctcggtgcgtgttcaatatgttgcgcatatttgatctgttcatgttttactgcttagtttacatgtgtagatctaatgatgcgttaatgctagtatacatctgcaatgccatgatttatttatggaatatattaaatcattatatgcctttaatctcaacaatccaaaaaccttattataggcactgtgattttactatggctggttttgccgatacattgaggccggataaattcaccggtgtgcactttaagagatggcagatcagggtcactctgtggctgacagctatgaaatgcttctaggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcaatttcatgactacaagatggctgacaaccgttctgtagtcgaacaggctcatgagatacaaaccatagctaaggaactcgaactccttaagtgtgtcttacccgacaaatttgtggccgggtgcattattgcgaaatttcctccatcttggagaagtttcaatactgcactcaaacacaagagacaggaatactctgttgaagagttgatagcgtctcttgatgttgaggagaaagctcgggaaaaagatgctgcgtctaagggcgatgatgggcagtccagtgccaatgttgtgcacaaggcccagaacaagagcaaggggaaatacaaagctcagcagaccaccaacttcaagaagcagaagaacaacaacaacaatcctaatcaggatgagaggacttgctttgtgtgtggccaacctggtcatctggctaggaagtgtccacagcgtaaggggatgaaggcacctgcagggcagacttctaagtctgctaatgtgaccattggcaacactggagatggaaacgggtatagtaatttacctactgttttttcagttaatcagtctaataattggtgggttgatactggggccaatgtacatgtttgtgctgacatctcattgttttcttcttatcaggtcgcacggggttccaccgtcctaatggggaatgggtcgcatgcttctgttcatggtgttggcacggtagatctgaagtttacttcgcgaaagatcgtgcagctgaagaacgtgtagcatgtcccttctatcgacaggaatcttgttagtggctcccgtctgactagagacggatttaagttagtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtctggcactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggagagaaacttggcacatctagaactcctacattcagatctttgtgaaatgaatggggtgttgacgaagggtggaaaacgatatttcatgacgttgattgatgatgctactagattttgctatgtgtacttgttgaaaacgaaagacgaggctctagactattttaaaatttataaggcagaagttgaaaatcaacttgacagaaacataaaaagacttaggtctgatcgtggtggagagtttttcttatacgagtttgacttattctgtgaggaatatggcattatacatgagaggacgcctccctattctcccgagtctaatgggattgccgaaaggaagaaccgcacactgactgacttggtgaatgccatgttggacaccgcgggactacctaaggcatggtggggggaggtattgttgacctcaaatcatgtgttaaacagaattcctaacagaaataaggacaaaacaccatatgagatatggattgggagaaaacatcactttcttacttgcgcacatgggggtgcttggcgaaagtcaatgtaccaataacgaagaagcgcaaacttggacctaagactgtggactgtgtctttctgggatatgctcaccacagcattgcctataaatttttaatagttaaatccgaggtacctgacatgcatgttggtacaattatggagtctcgtgatgttaccttctttgagagctttttcccaatgaaggatacacatagtaattctagtcaaccttctgaaataattcccagttcanttcaccacncnaacccnccnaaaggnnnaanaanccaanaannaanntnntngnnananntnantnanncnancnantngnnnananncnantngnntncnanncntnngnnnagnngnnaagnngnnnantngnnanttanngnnttgnannangnncnntncnntcnntttcgnanagngnaagnntaaananngacaatagganncgactaagtcttttggtgatgatttcactgtgtacctcgtggacgacactcctaagtcaatttcagaagcatatgcatctcctgatgcagactactggaaggaggctgtccgtagtgaaatggattccattatcgctaacggaacttgggaggtgacagagcgaccctatgggtgtaaacctgtggggtgcaagtgggtgttcaaaaagaagctgaggcctgacagtaccattgaaaagtacaaggctcggcttgttgctaagggctatactcaaaaagaaggtgaagatttctttgacacttactcacctgttgccagattgaccacaatttgtgtgctactttccctagcagcctcacatggtattctcgttcatcaaatggacgttaagacagcttttcttaatggagagctggatgaggagatctatatggatcaacctgatgggtttgtagttgaaggtcaagaagccaaggtgtgcaaattgttgaagtctttgtatagtctgaaacaagctcctaagcaatggcatgagaaatttgatagaacattgacatctgcatgcttcgcagtcaatgagacagataaatgtgtatactatcgccatggtgggggtgagggagttattttgtgcttgtatgttgatgacatactgatatttaggacaaatcttgaggtgataaatgaggttaaatcattcttgtctcaaaaatttgatatgaaggatttgggagtagctgatgttatcctaaacatcaagctaattagaggtaagaatgggattacactcttgcagtcccattatgtggagaagatcttgaatcactttggctacattgatagtaagccttctccaacgccttatgatcctaacttattgcttcgcaagaacaagagaattgctaggaatcaactggaatactcccaaatcattggctcgctgatgtacctggctagtgcaactaggcctgatatctcctttgctgtgagcaagttgagccggtttacctctaatccaggagatgatcactggcgtgcgcttgagcgagtaatgcgctatctgaaaggtactatggaattggggcttcactattctgggtaccctgcggtactggaaggatatagtgattctaactggatctctgatgtggacgagatcaaagccactagtgggtatgtcttcacactaggtggtagtgctgtttcgtggaggtcttgcaaacagaccattttgacaaggtcaaccatggaagcagagttaacggcactggatactgctactgttgaggcagaatggctgcgtgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctgtcaggaagttgagaaactccggagttataacgttggattacatccaaacaactagaaacctggcagatcctttcacgaagggactatcacgaaatgtgatagacaatgcatcgaaggaaatgggtttgagacccatgtgagttatactatggtagtaacccagtctatgtgatcggagatcccgtgaattagatcctgggaagaacaaaccattagtaaactagaggagagtaccgatatataccctctctaagtaaagatgcatgtactcttgtgagctgcaaggcaggttgactataccttaatgagttctgttggctttaattagcgaagatgctgtcctacagagcattcttgatagaactcacctttggtgagcttgactgttggtcgcagtctatgaagattttgggtgattcttctataaagcttactaaagacctaggagtatgacttatacgctccactcgaggggtagtctacagacggtctagtaccagataagattttgagtgaaacttgcttgcacaagacttgtaattcaaggcgtagtccattgttcaagttgtgagtaagtgtagcttggagttctagatggatgttcaaccttaatcggtctccatcgaaccgctggtatataaacagtacattggaaaaggcaaatctcagtgggattttgagatttggtgggggattgttggaattaatggataggccttaacccactcgaagattaattctttggaaaatcacaaaagcccacctcatgggatggcatgcatgtggagtttagtaccaccttgcttattctaggagagggggacctccttaaaagggaggatgccctcctagccacttgaatcatgtgtggtggagagaagagggggaacacacgcgcgtgctcgctcgcctcgcctcgcagggcaggcggcgcgcgtgcacgacatacgcatcgaatggtccgccaaaaattggttcctcaccttgcgcagatgcagcctccttttgcagttttgttttgctgcaaattcggattcgtttttgttttggaaacgttccgaaaaatctggtgcgtgaaaacggcgtggagtccggataagttatgcgcgacttatccggtttggttacgcgcagtggagatcgtgcgggcgccctaatcaagcgacccttctctatataaaccgacccgccgtcttcacgcaacacacgaaaaaatcaatatagggtttgcctcctactctgtgctgcgccgtcgcttgtagattactccatcccgctcgccggcgtgcaccggcgatcgggagagcaggtctccggaacctctgccttcgacgtcctgcaccgggagaaggcggcaataaagtttttgggaagcgcttagcgcgactgctccctatttgtccgcgacggctcgtcttcctcttcgctcgcgtgctgcgtgccttcgtagacgcctgcaatcgcgaaaagttcctgccgagtagccggtctttctaccacctcggtacgtgttcaatatgttgcgcatatttgatctgttcatattttactgcttagtttacatgtgtagatctaatgatacgttaatgctagtatacatctgcaatgccatgatttatttatggaatatattaaatcattatatgcctataatctcaacacttctaatggccatgaaagtgttcgttatatcttcttcctccacttttaagaaaacatcccgcttaatgaatgtgactatacaatcatccaaaagctcatcacccatcttatttctcaaccatcattaataaatgcatcagttctactataataatttaataaatatcacaatgcacatgagtaaagagttcaaaatttcgaaactgaaaattgaaaaaaagtaaaaagtaaaaaacctttttttttggcctggtgcaggactgcggtcactgcgggcgggcgttggcggcacacgcggcaggtctgcagcagtgcgctagtgcggcactgcggctgcggcggcagccggccaaggcggcggactgctgcaggctacggcgccagtgcggcagtgggctgctgcggcgaccaagccggccaaggcgcgcacgcgtggcccggcggcgctcgctctcacgatctgatcagatcgctgctcgcgttggcgtcgcgactcgcgagggcgaggaggggagagacagagagtcctgcgatggcgcgacgcttcggtttctgaattccaattgattagatacaccgtacacgcgcgtgaggggtggggcctgtgggcggcgggcgctggctcgatgtgcctcgctataaaaatttaatctaataatttaaaatatcgggttcaccaatttaactgaaaatcgaaggttagatttgatatagccacgtggtggtctaggagcatttgtagaagtattagatttgatagagccacgtggtggtctaggagcgtttgtagaagtcccacgtgatggtttgagagcatttttagaaagtttaatggacttttagtaaataatagatttaaaatatcgggttcaccaatttaagtcaaaatcgaaggttagatttaatagagccacgtggtggtctaggagcgtttgtagaagtcccacgtggtgatttgagagcgttttgtaggaagtttaatgaacttttagtatataatagatagatagatttagtatataatattcaggcactagtaaaacaaattaattgcagaatccgtcactaaaccgtgagatgaatttattaagcataattaatccatcattaataaatgtttactgtagtaccacgttagcaccactttgtcaaatcatgaagtaattaggtttaaaagatccgtctcataaattagtcgtaatatgtacaattagttatttttttaagcatatatttaatatgtttaaacgttcgatgcgatgagaaatttcggttgggatctaccctcaggcaagcaacggcataaataaggcgacacatcccaagaagaccaccaggggaagcaaaggagggttcatggttgcgggtcagaaactcagaatagaagaagattgttccgtggaaaaaagaaaatagaagaagaaaggtatggaggatctagtactagtagtgaaatcaagaacgtcactccctatcgctttctcttctccccgaaggaaggaaagaaacaatccaatcatattatagctagtatccaatattcttgttgtctttcaccttttggtctaggttgtctagtgcttgctattcttctactagtagtattataactgggttgttcattatttgaagattttcttttcattggggggaccgggctagaacgatttttcaccatctttatctggtcggtttcatgataaaactgtgaaaagttgtgtcttcttccaaagctgtgtgggtatggaagggtttgtacgaggagagcgcatggagggtttgggggaaagaagaaaagattcacgccttcttttgccgcggcgatggggttttgggccgtgggcggatgcggccgagagagagagacctcccgcgcggcggccgagagcagccgaggcaggggggacggccggcggcggcgaccacgaagccgtcggtttgttttgttactactccatttctgttccccctccctgatcaagtaaactagtttgtaggatcgcatcaactcggatgaggaatttttgccgattagatttagttttcaagctggaaatatggtgattcacgggcctttttcttgtggtggttgtcgttgttgttcatgccatttttctgaagtgaaagatgaacaaaaatttccactgaaaagtaatattttgacactgcaggtttgttgaaaaacgatgggcacatcgtgcgaaagatgcagacggcgcgatgagcaggactacaggaatttggatgatcccaaaaacacttcttgctaactatgatgggtgattttcaacatgagatggtaagccaaatatttttttttatgaaatgcaatgctgcttcttttcttttcccttgccgtttgtattttttttttgtttctttgcttcttacaagttctgtttggtacaagcatgatcttccttgcaaatttcaataattcggtgactagattgtaccctcttaaaagaaacaagtattgatgcccggatttaagccaataatatgataccacattaggtttgttggttagcaccagatgtaatattttaaaaagcaagaaattaggcttttcaatttcgtcagtttgttctgtagtcacatacagaaatcagggcctaccctgagatttttgtggcccagagtggaactaaaaagagaggccccacattgaacataaacatgaaaacattaatataaatatatcaattgcaaagatcgaattatgtgcatgtactgaacgactgatatacatttaaactaacaccaaaattatgtgaacaaactgtagcaatgaaagaaatagcctgcaaacaacaaacgagttcataacactgaactgacatatatttaactacttgtcatttgggaaaaaaatcacagcggaattagcgctagtgactcatcaataacatgccgcaaaaaatcataattacttgttatcccatgcatttcaactttgatgttcatacatcacccagatctcatcagaactacacagctccacgctggtagcatcaaggtgaagcatgcgttatattgtagcattctggtttgggctatctattgccttcatagtgaggaggagaggaaaacatagtagagcagctagtatatcataaaactatattcaaactaacaccctcaaaaatatgtttctgcagatcattccaaaagaatttgtgcagcgtttaaagggtgacatccctggagaaatccaactggaaacacgtaacagaaacagtcacactgttagagttgacaagacccaagaaaaggttatctttacagagggatgggcacaattcgtcaaaacctttgatctgcagatgggtgactccatgatgttcagattcaatggaaattctcagtttgatgtcattatagttgatcaaattggccgcgagaaagcatgttctgctgttgtggatgattctcagaatcctaatgtgcaagaaaggcgtgtagatgctactgaaacattgaacagttcgcgcgctcattctcagcccatgccaatgcagtcaactactgaaactgtgaaccattcacatgctcgtccttgtcccatgcatactgctgttgattgcatgcccctttctcatgctcatcctcaacccatgccgatgcaattccctaccgaaactgtgaaccattgtcatgctcctactggtcccatggaaatgccacttgaaaacgttgccctttctcatgctcatgctaggcccttgcaaatgcagtcacaaccaacggatagattgacacaggtgcaaagaggtaactcaagtaaaggcaacatgaccacgatgagttcctcctccatgtcatctggttacaactcaattattatatgcatttcctgataaagcacatctgatgttttcttttctttgcacacaggatattctttgtcctctaaagatcaggattgcagagtaggtgttatacctgatcccatcatcgggcaaaagaccatactaagtcgagttcaggtgaatgtggtgaagcgcaagatccaaaatattggttctcaaattccaatctttgtatctgtcattggaaagaacaacgcctctggaagaatatcctctctagtgagtgccatatttctttgtcgaatgtgcatacttcttaattatgcactatttatactggtgtttgattaccgatgaaaaagtattcttcatgttgttaattataacctacttcctccgtcattctagcatttcccacattcatattgatgctaatgaatctagatagatatatatgtctagattaattagcatcaatatgaatttgggaaatgctagaatgacttacattgtgaaacggatggagtactaagctgtaagcactgaatttacatgtgatatgcttgctgcggttgcttaatatatatgatgcagtgcctaattgttttagttataatttatttgcgatgattccatcatctcatttttctttcatgtatgcaactagagtatcgccaaccgatatgttgataattaccttcaagacgagaaaactatccgtctttcgcgtcttggggacaagtggaacatcaggctttctgattcgagtggtaacagaaggatggttggtggatgccgaaagtttgcggaagacaatgatgttggagtgggtgatatctgcctgttcgagctgttgaagaatcataaatgcacaatgaaagttcatatcatcagggcaaaggatatctgttaatcgaaaagcctgttgaatctgctgatttctctgatgactgttgctggtgcttttgtgctgctgagaatggtagtctatccacagtttatgcaactactggtactaagttgttattgaactagtacattgcatgctgattagatggtgatttcccttgctaattctctttttttgggtgatacactaggggggttcccttgctaattaatgacccatgtaattactgatacttacttttggtgcaatgcttttgtagttagttatcaactgttcaggggctgtaagcaggctttccgctgtttttttctccttcggttctctcaattatatcacggttattgctctcaaatacaatccagttaaaaaaaaaggctcttgtattttgctcctctagaattctcaaaacttggaacatcagctccttatttacgcaaatatatcgacttctatattgtctggattgatcttctctggatgtatctaggtaaatttgaatgcattatttttgtcctcttttctacagggtttaatcgtatactcatgcgtattagtgttctatacttctatgcatcttgacgtttaatcttctacttcatcggtccataaatataagcattcaaagtgtacacaaatgtaagtattccaatgtactgtcctatgaatcatctattttttcaaatttctttctatctcaccagagagtccttacttacgtttgttaatggagggagtgaatattagagatgcaatgtacgagttggaggatttgttaatgattcattttacaatgctaaactttcttaaaagtctgaaaatatatcttaaaactacaaaattggacgtcattggaccgtaaactttagagcaatgtggctggcgtcgacatggccaaatttaaataatatataaaaaatggattcaggaattcgagaaaaaataaacatggttgctcatcggagtacttagaacctacaaatttgtgttcccgattcctatattttgcatttcttctaatttcttacactctgtctatccaaacaccaattttctctctgtttttctattatattgagttttcagttactatatttttcatttattctcatttcttattcctttttatgttcctcaacaccaagcatatgaattgcaagattcgactttcgagcagtgatgaaattgatcgacaaacaggatgcacaattttagtacaacaaatggttctgaaaaaatggcctacgagacgaatcaacttctctctatcccaaaaatataaaatataaagtattttaggtggatttgacctattttatcaacaaatggttatgtctagtttcattgcaccatgatatgtcaaatccactcaaaataggtcaacaaatagttatatccagattcagtgtatatgatatatcacatctactcaaaatctattatattatattttataacgtacggagtactagctaattaacatttagtattagttacagacttaattaattacaagctatagctacattaagaaattcgattagacaagtaatcatggtcatttcaatacatcctgaattcctgatgaattaaaactctacgttgaccctgtattcggcggacttgatagcgggcttcttcttgggcgagaggccgtcga

SEQ ID NO: 57660 - DNA, 3300 bp, Oryza sativa
ccggcagccgccccgagcacagcgtcgtgccgcggtacgacaccgccgcccgcgacccggcgccgtagccgatcccgaccatgtcgttggggttctccgcgcggacggacgccaccagcttggcgtacacggtgaggtcggaggagctcacgtcgaaccgcgccacggacatgtcggacacggagtaggacggggccttgggcctgcacgcgtacaggaggtacgccgacgtcgccgccaccgccacgacgaggaggaggaggaagcagcagcaccagcagaggcagccgcgcaggctgccaccgtccgtgatgcggtgccggggcatgttgcggctggcgccaggcgggaccgtggccagcgagctggagccgtactcctccgtgagcatcacgtaccgcggcggcggcggaggcttggacggccccgagcccccgtcgtacgccatgggagagagagggcctagctcgagctagctagctagagagagaaaggttgggatggaaggggactaggggagcaaaggcgccgtacgtacgtggtcgcgttcatggcgagcggctgagcgctcgctgtggacaatgtgtccaagcttgctaagcaacgctcatgtcttaatggggatggctatctttagaccgcgcgcagcgcgcttgttaggtattcatgcattatcttttctctcacacacggtttctcgttcgcttgcgctataatgttttgtgttttttctttgaaggacatgcaaatcaaaatcgactgttacgatccaactcaaatatcacagatcaacaataaacatggcaggaaactccaattccatcacaagataaagtgttcggtgacataaatttagagatggaagtataggatgggataagcaatactgcaatagattgggaaaagtaggggacaagaagtaggggaaggaaggacacaaggcatatgcatgcgggggatcctaatgggcgatcgatcgtctggagatgggggtagcaatcaatccccctccctccctccacctagtttcctttcttggcaccgcattacttttctattttaataaatttatgcacctaaagtttacacatctaaaatttagagacccaaagtttataagttaaaagtttatatatccgattcaaatttaatttgaattcaaatattttttttatatataatatttctatacatctaaagtttatacacctaacccaaagtttataagtcaaaagtttacatacctgtttcaatttaaattttaattatatctgatttgaatttgaattcaaatattttttatatataatatttctatacatctaaagtttatacacctaaagtttatagacctaaagtttataagtcaaaagtttatatacccgtttcaaatttgaatttgaattatatccgatttaaatttaaatttgaattcaaatattttctatatatattatttctatacatctaaagtttatacacctaaagtttatagatccaaagtttataagccaaaattttacataaccgattcaaattttttatataaatagtatttctatacataaatttttctaactttttgtgtttttttaaaaaaattgtagtgtactgtagtagaagagaagaaggggaggaggaagggggagaggagggaggagtgtatctgagtataggtgagaggcaggggggtgatcactggacggatgggggagcgatcacccacccattagcatttccgtatgcatgcctgttcatcgatgatcccctcagctgcagtgtatcttgtttttatactctttgctactcggttgggtctaaagctggcccactacacatctatgacattcttctcttcttggaaaaaggcttgtcctcaagcccatgtagtgcttctgcttgatccttgaggactccttcaatcctattgaaaaaattcctataaatgcctttgaatcaaatgattaaatcctatccaatcttttaaaattcctatggaatgagcaatcctatagaaattttagaggaaacttagcgagagcttaaagctcttggaaaatttcctttgagtctatctctcttatccgattcttgtgtttttttttctatggtccaaacaaacgattattcatgtgtttttcctctgttttacactatcattcatagtataatcttatttttccttttttttttcattcctacgattcaaaagacacctgttgccccaagcaaaagtctcgtgggatgacaccacacttctgccacaatttgaggagacagaattcctggatcatttgcacacatccaaagagcctgcaccaccatcgatccagccgtccataattccatattctgtctgtgttttcgtgtgccaaatttttttaagtatacgaacacatatttgaagtatgaaatgtagactaataaccaaacaaattacaaattccgcctgtaaactgcgagacgaatttattaagcctaattaatcagtcattagcaaatgtttactgtagcatcacattgttaaatcatggtgtaattaggctcaaaagattcgtctcgcaatttacagtcggactgtgcaattgttttttttgtccatatttgatgctccgtacatgtgtccaaacatttgatgcgacggaaaagttgaaaatttgaagaaaaaaaaaagttaaaatctaaacacggatctatctcatctttgtataaaccatatgtgaacatgtatgatgaaatgaaacgaaaggccaatatttgtaaattgaaatcatccagaatcctcccatttagatttcttaacaacagattgacatgtgccaaaattggtacttgcatagaattcattgggagcatagttgcatacatttaatcaatcattttagcccagcactccttgagaatccaactttgattggtttggcacattgcatagcactagtttatttgaatcatttctggcacatgactatgctattatctgcaaatggtctcttacaaattatgcatattattaatgcagccctaaaactgaatgctttgctcccatggatagcaacagtggcaccacatagaaattttaattttctctgtattagcaggcaccaacactgtttgcctatcataaaactgatgaatgtaagtattcgaagttaaacttggacccaccatggactgcattaccacttacctgcccaactgaattctaccaaatatccagtccacgtgcatatattgcttggtgaagctctgtccatggagaaggtggtggctatggtgatttctccacataaggcatgc

SEQ ID NO: 57661 - DNA, 3845 bp, Oryza sativa
tccgtaaaatctcaatgatttccttaacgaacatggatccttttcgtatacttgaggatataccgtattcgtatatctcataactcataggatagaggatataccttatccataaccctgacattagcccccgacttcaaatcaaataagtactcgttctcgcacccagacttctcaatcaacgacgtcgtattatcttggtcattctcaaaaaaaaatttgagaagacatgaaacattcaatgttaatgacagaagagcaatggtcctttaacaaatttgaatttaagtctaaacaactgccataaacaatcctaagaaaatcacggcggcattctctctccattccttggaattcgaactgtcagatagtgagcttatgaattctggttccaagaacctgtcgatgtttgatatcgcgactacggtatttgcatagtatggggatcgctggtatcagggtatatgcgagattgaagtaaaagagatggagacaaggatttttatacaggttcgggccccttatttgacaggtaatagccctacgtcatgttggccgaagccggtgttgctctttattcatcaggatcacacaagtacactatttgggataacatatttagctatcgtcgacttggcggctagataaccaactcgtagtcgacgacaggatagtcttcctcctcgaatccgcacttggcgagatcagagatagtgctagatccctcttgctggcctccgtaggaaccggatggggtatgtctatgctaatctctgatgttgatatccggcggcatgtcttggcttgtattgatctatgttgatcttgtggcttcccccctctcctcctaggggggtttgtatttatacccatagatgcccccttgtccaagtaaaactagggagaccaatatggatacaatccgagtagtccttgtcgtttccatacagaactctacttgttcttccttatccagaactccttctatatacgagatatgattccgtataagacttggtatatggtgggtatgtggtatccataaccttgacagtagtccccgacttcaatgcaaatgaacgagttaagtttctcgatcgaagactttagaacaactattgttgtgctcacttgaccgttctcggtgtgatcagaaataacgcttgattcctcttatcgacctttgtaggcgctatattaggtttgtctaggttaatctctgatgttgaccgagaagatacggagcatgcgactaagtcttccgtcttgctgtaatcgagaatttgaattgaagtcaagaaattccatctctgcggatacaccatcgcttcattccatatccttgtcaagccccatcaaccgttctcgagtaatcgagtaggcgtatagtctgcgacaaagccttgaaatctaacttgattgttgtgatgtctgatttcctgaaatcaatactcagaacatttgccgtactcgcttagtcgatcccggtgtagaaccgtagagacacggagtcttcgacaatgttgaatagaactttcctgaaatcaatactcaaaatagaatattaaatagaaatagcccccgaatgaacgctcaagggtaacatgatataatatgtatggaaaaattgaaaataattgaatctgcgtgtgacaataaaagagtactctcgctagagttgacctcagcaaacggagtttggtactcttcctagccccaaactatttttatggaaaagccattttccacaaagacagcttgaatcttataacaaaccatgctgaagctgacaaatcctagcccccagccgtgaagttggaaaaatcaatttctgattacacggcttggttaatacgcgtctattgagcactcttacatgaccaggttttacatgattgtttggctcttagaatctaacaaagccttatctgttctgggcgtccctaaccgaaatccccttaggtttctcggaggctttgtcagaacaacgtaaagggacaataggaccgccttcaagacgaggcgatataagaagaggggatcaacggataaatattgcacatataaatacttacagaaattgacatagatgctgagacggccaccacattaggcaaaggccaggtgtatagttgtactcaacaaatcgaagaattagcgggagaatcgctacaccgctggtcgaagaccagttgtagtcataactcgaccacttgaaatggaggtataagagatcactacaacctactggttcgagaaccaggagtaggagtctctcaaccgtttgaaattgaggtgcgaagaccgctatgctactggtcgaggaccagtcgtagtcataactcgacctttggaagtcgttgtacgaggactgctacgctgctggtagaagacctgtcggagtcgtacctcgaccattagaagtcgtggtgcgaggatcgctacattgctggtcgaagaccagtcgtagtcgtacctcgaccattagaagtcgtggcgtaaggatcgctacgttgctagtggagaaccagtcatagtagtacctcgaccacttgaagggagtccagagtaatagatgtatgacattctcgcgacctgcgagaactgcctcttgatgacgacgaaggagtgaggaattatcgtagtctgaggttccgctcctggacctactacctcatcctcgggccctctataagtctggggatcttgagttttttcgtcgtcgtgtgatgttgtgatgtcgttaaccttgtccgttgtcatcctaatgtcgttagtcctggacgttgtcgtcttggcgacaacggcgatctagtcggtcttggttgtcgctatcacgacaatgttgattgtcgcgttaggtgtcgtgagattgctgtaaccgactggtcgaagatcaggagtaggcgtatctcgatcacctgaagatgaatttttaggtagtgagagatcgctatgatctactggtcgaggaccaggtgtaggtgtatctcgaccacctataggcaactgataggcatacggaaacaaaccgtattcacgaaagcatctcttgttatccacgactccccttatcaatatctgccgtactcacttggtcgatcccggtgtaagaccgtagagacatggagctttcgacagtgatagatggagttcaacggtccacaagtgaatttaaattgataggcggcgggatgtcgctacaactatctggtcaataactaggagtaggcatctcttaatcacctataggggcgctagagttggttattacatgtgcatctcatgtggccagcatgactcatatacccaacttatagcatatctggatgtatgttcgcaatcatgtcgggtgatcaagccgacaacgtttgcgaggaattatccattaacaacctattcccaaatagttcagccgtagccgtcgctatttatgtgataggtcgtcggtcttcgttggtaggttgcgtgtgacaactaagcatttgtcgagagcgttctcgatgatggggtgcactcgaccataacctacttgagtgctcagttgttcctgaaaaatattttctagaaggcaagatatatagcagagaatatcgagtatgtacttaaaaaactgcatgaactttctagtattatcaggatatagcgagcagattaaatatcagacattatgtaaaccataagcaagtactaccaccgttttttaatagatgacgccgttgactttttctcacatatttgaccattcgtcttattcaaaaaatttacgtaattataatttattttgttatgagttgttttattactcatagtactttaagtgttatttatatcttatacatttg

SEQ ID NO: 57662 - DNA, 7931 bp, Oryza sativa
ggagtatgatttatatataagaaaatagagcgagccccaacattaaaccatagtcagcctaacattggaaacactcgcataacatatattgtatatataaaaacatgctctaggtaaacataataaattatggatctggcaatattgtatgatctgaaaaataggtacggtaaattgtatataaaatattgcgtacctttgtagatacatgccggatgtatctacgaaattaatatattaatttaaaataattaaactagtaattacctttgtttgtgtactgattggtctgaatgcaagcgtcatgtgtgttgatgtgtcatggagtcgacctatctctgctcctgcatcatgcttgtgtagcccaattggtttcttcggcacagcatcccgtcgtatccgagaacaagtcaaaactcaatcatgagggccatcggacttggtcggcggtggtaagtgtgcatgtataaaccagggaacaataaaaaacacatgagcagtactaaaagaacgagaccgatataactatgattacaaccagaagtagaacggttaacctgctgacggtagattaattttaagatttcggcggcggacgtatgctcgggagtggttggaacggaccgagatctcgtggccgacaatgctaaaccgatgtcctccgtgatatctcccaaagccaaagtcgagagattgttgtcgggaaatccatttcttaaacccatctcgtcaaaaccttgaagcaccaaaaatccccctacctggcgcgccactgtcgacccctacctggcgcgctactgtcgacgtttcatatcgcgactacggtatttgcatagtatgggaatcgttggtaccagggtatatgcgatattgaagtaaaagagacggagacaaggatttttatataggttcgggccccttatctgataggtaatagccctacgtcctgttggccgaagccggtgttgctctttattcatcaggatcacacaagtacaatatttgggataacatatttagttgtcgtcgacttggcggctagataaccaacttgtagtcgatgacatgatagtcttcctcctcgaatccgcactcggcgtgatcagagatagtgctagatccctcttgccggcctccgtaggaaccggatggggtatgtttaggctaatctctgatattgatatctgacggcatgtcttggcttgtattgatctatgttgattttgtggcttccccctctcctcctaggggggcttgtgtttatacccatagatgcccccttgtctaagtaaaactagggagaccaatatagatataatctgagtaatccttgtcgtttccatatagaactctacttgttcttccttatctggaactcctatatacgaggtatgattccgtataagacttggtatgtagtgggctccgctgagcttagtcgattactattgggtatgtggtatcaataaccatgacagagccatcttgagtccgtttactcaatcaacccttcgtcttcctatgcgcacatctctctaggtctttttcgccatcaagaaaccctaactctccttttcctctgccatcccctaattcgatttgatggatttggaaaaaccaccatcgacaccgtcgaggtgaagaaactgcacgtggagggatctcttcccgagtgtaacaacgtggagcgctcagaaggtggtactgaacctaaacccgctctaggacaaattgtagttttagagatttcgttcagtgtggttttctacctccttcttctgagttccttctacttcttctgaatttttacggccttcatcttctccacctgaacccaaattccatcgctttcatgagcatcttcgctcaccattgtgaggcttaccttggggtagtaccatttcttgatctgttttgctatttttatgagcttcaatggatggaatcttgcaaaatctctagatgctgcggtttccgtctccaagattggatgaaggcggaatacatccccttcaactaccattcatctcggagctcatggagatcgaagtgcttctatctccatgtagaagaactctcttatgtccttgttgtcctagacgagcaaccagaacactccacctcctggacctctaaaccttccttgaccccctccctccaagccttcgtagacaaattccatagcctctgagaacaagggtctctgagaacaagggttgttgaggtataaggtcaccgctgacttcatacgtcgtcgaatccaacctctccaagctcgtgctcaccccacgttcgattacataggagctaacgacgagacacggatattagatcggggtattcgttctcggaacccacttgctcttgattcgtgtaatgactttattattgacttatgatatatgcataaccccactgtagttctcgatgacaaaaccttgggtacgagagtgggtcatgttgtcatcagtcctccatcggactccgacaaattaccgacttccatctgtgacctctcttctgttgataaggacgccaccatcaattaagcagttccctattactccgcctttccttcatgtatttttgaatctgaagacggagtaatctaaaatcatgtaggctcttcctctgacggatgaaattggcccccttgtcgatcatcaagcctcctccaccctgaaagacaaggttgcctctgagcaaactgatgccgtgatcatgccaagcggcagtggcgccaaggtgcctaagaggaaatgggcgggtgtgtccaaacactcccctggcgtcggtacacttgttcagacaagcaactctgaggtgagttccgactacatctcttgtgaacaggctctatcaaagacgacatcgttctcactcgctttcttctccaagccgccatcggagctcccccagcaccgcggaggaaactcctgaagcggcacaaaccaaagtaagtgaagtctcaaacatcgttgtcttgtcttgcatttttttgtttctgtttctattatttctaacttgtgcttctgatagcatttctcccgcgacttccgctcaaagcgtaggtcgtgtggacaccagtttgtccccaccggccgttgtcgtgaccacgcgaactctgcccgctccttctcctccttcactgcctgccatctcgtctgtgcccggagccgacaagttggccgaggcatgctgcctactcgaaatgggcacccgcgagatgctcgccaggatcgagcgacttgggaaagtcgcttcgtcctcggatgggtgcgtcgtgcaattggagagccagctcgcggaggcacgcgaggaccttcagaagatgaaggaccttgtcgcaggccacgagcaacaacggcagggactggagacacggatggtggagacgaagggccacttggcaccaatccgtgaggggatgcagcaaatttacggtcggatggacacgctagcgcgtagtttggggatccacgatagggttcctccttactccgacgagaccacgatagtatcctcgctagccgaccttatcgagaaacttgaagaagttcccagtaaccacgctgtgggggtggccgaggacacatgtgctggtcttcgtaccgacgcatgccacgtcctcacgtgtgtatggctcacgcaccctgagatcgaccttaaggaggtcctcaaaaagggtggagccgaaccatcgtgcgaggatgtgatgtcagaggttgagtagctcgagaaaatcatgatccctttttttggttgggaccttctatacaacggtttgtcaagttaagggactccctatatctggtattgcggtttgaagacaaatttgaactcggccacaagttgaggaacctatagtgaacttgttccgctcagattaacaaatgagaatataaaaatatctcttatgttgtacatagtctcttcctcaattcttaaaactcccaattctgaatcgtctggtgtgctgcaagtagggatggcaatggagacctgataattgattcctcgtagtgaactcacatattagagaatggggatggttggtatgacataaatatcattgatatctatcctccatgaggaggaatcaaatggtcccaaacttactagcatcggcgataacggggtggagacggcgcgcggtgacccgcattcactgtagctagaccaattctagactttccagacgttttgacccttgaagcccaattaacaagtatatattaccacctaacactaatcaaccagtcaacctccacatcttccagatccagacgcagaccgctccgccacaccggccaccaggcgcgcgcgccgccgcctcctctcgcgcgggcgctgtaccgccccagccgtcgacacgggcgcggcgctccggagcctgcagccgtcgtcgcgccgccaggcgcctccaaccgtccgccggccggcgctagcgccctccgtcgccagcacgccgtccgccgccaccgattcccctgccggctgccgactacagaccatggcttcgttctcctccccggtaagctccgacagcgacgacgcaaggtgagcacatgctacaatccctagtcccttctctgctggtgtgcgtcgcggcggtgtggatctggatcacgctggccgtggagggggttctctctttgcaggaggtggcgctaaaccctatatctcactgtgcgttgtagttgctagagtgagggatggagaacggggagatcgagggggcagcggacgacggggtgccggtgcccgcgccgcccaacggcaggaggtatcgccccgtcggctccagcgatcgcgccgtcatccagatgacctccatggagcccggctcctcctcctctaccgctgtggcagccgtcagtggcatcacgccccagccaccaaggtatatggaagcttcgcttcaaattttggagatcgaattttagcaatattctcttctagggggagtagactaaaacacttgtactgcttgaattagtataccattgcttgtgcaaatccgatcgtgcattgtcttgctcgtgcgttattaagcaaaaaaaaaaaggatgtagtgtttcaccaatcaaccctatggtagttttggtgttaggaacccatgtgaagcactgtggggcacatctccaacatatgttggctatggaactatcattttagccgttgggcttatggccttctgtttttgctcctcatttccagatttagttatcaggacaaggctggaaagtcaaacgtgctttatttactttgtagcatacctccaactgtattgttactgcttctcaaattttgcactgatatactgaaatttgattctacttggtttcaattaaattttaatggaagagcctgttgctggttgctgttgagatactcaggaccaatcataagttcataacactggttgttgttgcttagtacaatgcttaaattgatgctgatgttttcagttgtagctaatattgcctcattggattagatgatattgccatgtgaaatgatacatcaggctcttatgtaatccctccatcctaaaatacatcgtactaggatgtgtcgcatcccgtcctaggtttgtttatttttggacagagggaatatgtaaccacattgctgtgatttttgattctgtatttatattgctatgctcaaataagttaatagaagtgctatactactaaaaagttcttactaacaaatatctcaaccatttgatttagttagttggaagttttaaaaagtcaaagatttaaccatagcataacaatcagcgtttgtaacaagtttgtaaaaaaaatttagcacgtgcatctttttccataagttaaatacacgtcacaatagttacttcttgaagaaagatgtgttctgttttgtcatatcaattttaatttgtgagtttcatagcgcgggaagtggtttctatatggatatgggagtaccctgcacatgtcatgtgcatcaatgaaatatatgttacttgatatatattatcttatttgcctcatgaatatgttcatattttttattgcacattaagagagatttttaggcataacttctgcataatttcctttcatgtgcacctttttaattcacatcaacaattgagaggagaatttggaggaaaatgctggccgtcctgcttcaacatgtacaagctaactcaatttttatacatgtcataggaatctaacggtggatccaagcatgcaagaagatcacactgtttcacaaggggattcaaagcttgagctttttggttttgactctcttgtaaatattttgggctcaagaggtatgatccatgctctgcctctgtttgttaagcacctaaggctgtgtttgagcggcacgcaaaactatatatgcgttaacgcataattaattaagtattagctattttttaaaaaaatagattaatatgatttttaaagcaatttttgtatatacttttttttttgtaaaaaacacaccgtttagtagtttgaaatgcgtgcgcacagaaaatgagagaggtgggttgggaaagtgacaaaagaactcaacctaaatgttttgactaatatgaagcatgcgctctacaaagaaattgttagaactattgatttttctttatgatatcagcatctgattgaaactgaacagcatgacaggagaacagattcaggccccttccagtcctagggacggtgaggatgttgcaattacgattggacgcccaaaggttattctccattttaccattttggatgaagcccagctgttaacttaagtcataggtttccattttgatagtgaatagctacatattttttgtttttaacttgtgcaacaaaccagtaacaataattcaatacatatgatttacatttttgcatctagatatggcttcagaatttaaaccaatgcacttctactggtagcgtcatctgttgtattcagagtttcattatatgtctaattacattttcttaaaagcataaacaagttgttgatttgcataattcagcttttttgaaatatcgataggcccattcccggtctttaaaatttgttcagtgttgattctgttcattgccatcatttttgttctttttattttgtatttgttcatggcatttgagtttatgacgtttgattccattacttttgttggtctggcaggaaactggacccaagtttggtaccatgatgggtgtctttgtcccatgcttgcagaatatattgggaatcatttattatatccgttttacatggtaaaatattctggatactttattttaacttcccatatttgttttgttccaaagcccttattattttttatgatttttttgttcctgtgcttgtcaatgttgtgttcccattgttcttttgacagaagcttacctgtagcatttctttcttgtactgtatggccttttcccattatagaaccaagtccaaaattagtaaagcaaaattggtaaatgtaaatattgctatccagttttgacatgttaacttattaatgtattgatcccttgattacctaccctgttattcatataggtagaagtggtatttgtgcattgttaaccctgtatcttttttatgcccttatgctgttcaatttttcaacaactgactaatattttttttcttcctgtaggattgtaggtatggcaggtgtatggagtcgcttgttttagtctcgttctgtggtgcatgcacatttttaactggatatcattaagtgccattgcaacgaatggagcaatgaaggtacgctgaatgtaagaactacatgtggaatagttaatagaataaggtttgctatgccccatgttttgcttcttagcgctgtctttgcatttctatttcactggtcgaacctgataccgggtatgcctaaaatccattaggga

SEQ ID NO: 57663 - DNA, 4640 bp, Oryza sativa
  unsure (1)..(4640): unsure at all n locations
atgtttgtgaggatggtagaaaaaatggaacagtatactcaagccttttgttaggacatgaagggtgtctatatttactttattatgcatttctgttagccaaacttagtcaaatttctcttggaggaaaggaataccaaggtgcaaaagcattgactatgtttgggagaaagtacttttaggttggctttagtgttatctttgagtatgagtaatgctcttcagaggtgcatagttggacattctcttttagttagttcagcctcctatgagtatatgaccatcattattctgtcattcacttatttctgttcttcctttttatcatgaggaatcaagctagcacggttaattgcctacatagcaatgcaggatctatttgtttttatacttacgtttttatacatagcaatgccaaacataatgaattaattagttgactgaagttgagaaaggaaaggacggctgtactgagcaatacggattattttcttaacttgtgatgctatttttttatttttatttggacttactcgccagctctgttttaaatgcagagagtgtcacagtagtcaataatacattagtaaatggcactgcaacagctagcacagcaactatatcaacacccagcttgcatgaccttcaagtatatggtgttattgtaaccatactgctgtgctttattgtgtttggcggtgtcaaaatcatcaacaaggttgcacctgccttcttaataccagtcctcttttcactgttgtgcatttatcttggtgttttcattgcaccaaggcacaatgctccaagtaagtttaccttattgtttactttatattggatcaccattattgtactgatccataaatttataatgttggtttgcctatctagagggaattactgggttgagtataaccacatttaaggacaactggggctcagaatatcaacgcacaaacaatgctggagttcctgatccaaatggctccatatattgggatttcaagtaagttttttaccttctctagaaatataaataacttgtcattttatggaaattttatgaggaaagtaagcattacccagtatatgaagcaccacaaaatttgaataatttttcacttgaccctatgagacggtatgaactatgaactttgagcaatcttggcaatgagtcctgctcgttatttgttactaatttggattcgggtaaacctttggagcccacatatcatcgactcattagtgtcccttcagcttgactagcccagctgcttcgtaatgcttgtggttggtataagggcccttaggcctgtttgaggtgtccatggaccgcagtggcatgatggcgccatggaggcagccgcaccacaagggcagagggaagagggagagactaaagactattgtttttttcttgcttaatgaatagagatacaatcccattcctatattgatgggataacttgactcttaagaaatagtatatctctaagattaaggaaacactacctccattcctaaaagagtgtcttttagcaatgaacctgagttatttcatgagaatatgttctatttcttccgttataataaacctgcactgaagtttcaaacaagtccctaaaccttggtgcaaatttagggatctacagtgcactttacttatttctttgttttcttaaatgtaaattgctaactatattgacttttcagtgctttggtaggcctctttttcccagcagtgactggaattatggctggttcgaaccgatcggcttcactgaaggacacacaacgttcaataccaattggaacattatctgcaactcttacaacaactgccatgtacctgttctctgtccttctatttggagccttggccacaagagaagagcttctaactgataggtacatacttcttaatgctgcatattataagtgctcctgctttacaattgtagataatgcatcagctcaggttatatttatctaattcatttgattgatcccatcaaggaaggaagataatttggccttacagatttatggtgcaactataactgctactcctattctactggctgttgcaggaattaagggcatgtagtttttcttttttgtgaatctcaattgtttggtacagttataagagatccttttcagagtatatgctgcatgcttgtctgaccataactatttacctgctccttttttcttccatttgaaactaacataaacaattggcagaacatgggtttatattggcaatttaataatttgtaccatggcacaacttagataagtgttgtgaatatattctttctttgtaaacaactacttcctctgttcacaatgtaagtcattctagcattncccacattcatattgatattaatgaatctagatagatatatatgtctagattcattaacatcaatatgaatatgggaaatgctagaatgacttacattgtgaaacggagggagtacattttttacacacgactgtagtgtacatgttaattttgtcctagtccataccgagctgttatgctactgatttcttctctggtcaactcataaatatacttaatacttgcaggcttcttactgctacagtggcatggcctgctccagcagtgatttatattggtattattttgtctactttaggcgcagcactgcagagtttgacaggggctccaagattactggcagcaatagcaaatgatgacattcttccagttcttaattacttcaaggtttctgaaggggctgagcctcactcagccactttattcacagctttcatttgtatctgctgtgtggttattggcaacttggatttgattacgcccaccatcacaatgtttttccttctgtgctatgctggtgtgaacctgtcatgctttctccttgacctccttgatgctcctagttggcgtcctcgttggaaatttcaccattggagtttatcacttgttggtgcattgctttgtgttggtatgactatatactattacaaattcattttgacacaatggcatgcatcatgagctgtaatgctttcttaggacattattttgattaaagacttctgacatgctcatgcattttaataccaccctcatccataatgtactgaagtattgtttaacttgtactttcgcacaaatattttaatgcaaccttattttgtctttataatactgctttccacttacttggatcgttctctcaatttttcagtgatcatgtttttgatatcctggtcttttactgttgtctcccttgcccttgcaagcctcatctattactatgtgagcttaaaaggtaaggctggagactggggagatggatttaagagtgcatactttcaattggcactacgaagtctcagatcattaggaggtataactctcttcttggaaactaaatatcatatttgaaactattaagagttaccttgtttgtaacactgaacattcttgtcacagcaaaccaagtgcatcctaagaattggtaccccattcctctgatattctgccgtccttggggtaaacttccagaaaatgtaccttgtcatccaaagcttgcagattttgccaactgtatgaagaagaaggggcgtggtatgtcaattttcgtctcgattattgacggtgattatcatgaactggccgaggatgcaaagactgcttgtcgtcagctggacacttacattgagtacaaacgctgtgagggtgttgcagagattattgtagcgccatcaatgtctgagggcttccgcagcattgttcagaccatgggtctaggtaacttgaagcccaacattattgtgatgcggtaccctgagatttggcgtcgcgagaatctgatacagataccgtcaacatttgttagcataataaatgattgcattattgctaacaaagccgttgtcattgtgaagggccttgatgagtggcctaatgagtaccagagacagtacggcactattgacctctactggattgtgagagatggaggattgatgcttcttctgtctcagctcctgctcacaaaagagacctttgaaagctgcaaaatccaagtgttctgcatagcagaggaggatactgatgctgaggagctgaaggctgacgtcaaaaagttcttgtatgatcttcgaatgcatgctgaggtcatcgtcgtgactatgaagtcatgggaacctcatatggagagcagtagcagtggtgctccacaggacgattctcaagaggcttacacaagtgcacagcgaaggatcagcacatacctctctgagatgaaggaaactgcacaaagagaaggacatccactaatggaggacggaaagcaagtagttgtgaatgaacagaagattgagaaattcctctatacaatgttcaagctgaactcgacaatacttaggtactccagaatggcagctgtggtcctcgtaagcctccctccaccaccattaaatcaccctgcgtatttctacatggagtacatggatctgcttgtagagaacgtcccacgcatgttgatagttaggggatacagaagagatgttgtcacattcttcacatgattagagatgtataccttctggcggctctactgccatatgattgt

SEQ ID NO: 57664 - DNA, 4667 bp, Oryza sativa
attcacatagcaagcttcaatacagttaattgtcacaaattttgtagccctggtgttccccatacgtgtaacaatcttagaaacgcaacgcttccttttgcactgaaacagtagcaatggtatcacattttttaaaatatatttccagttgatgtaatgagcaaactgaggtggccattaatgttggcatgttgttgattggcatgacgtttatactgatacacgtgaaaatcagctgaaattattggtaacactgtacaggactttccttgattcactactgcattattgcactctatgtagtcatcaaaatttggtagtatgttggagttgtccagggacaataaaatcagctgatgatcaccagggtacttgtgatatatattttctcactttattagtgtttttgtcttgtaaaatctgggggtcacataacttgtaaaatttcacgaaggcattagtgacaaattagtgacactgtcatagcatttttcttgcaccgttgcataacattttcctcaggatgttaatcttaagctctataactacaagttcatcttcttatcgtaccgttgcatattacggtataacagcacaggaggagctcctgtttctttcaaacagaatttgttgatttcggcaagtcaaactttggtttggcaagtctgcgggtatgatcagcatctggtcgttgcgtagacccttccatggatcttgaactttgcattcgttttatgctccagctcatcgtcttttgtgcctaagacgaaatatttaagaattaagaagctgcttccatagatgtttggtaacgaaaaagattactactgtattttgctctgtgacgactattgcttataaatgagtacgtaattagcacaaggaaaataaaagaaaaaggagagaattgttaatgaaaaagaaatggcacgcgttccacgtgcatggcgcttggcctcatcatcaaatttacacgagatgtcgtcagttaagagtacttttcattttaatttggaggtaaaatttgctacaggacactaaaaaacgtgtaattagctgtaggacaccgcaaaaactgtaattagctgtaggacaccgcaaagacatgatttagctctaggacactctaaaaacacgtaatatgcctaagggcactgaagctattattttattcttttcaaacaaaaaagagagataaaaccagattgtccttcggctctctcggcttggctccaggcgtgtgcaatgagaccacgcgcggcttactctgtttggctcctcatcggctcgatcccctctactcatctgtcgccgtgccaccgctcttatctgctcatatatgtctgaccagcagcggatgtctccatgacgatgacctcgcatcaggtgattccccaatggccaccaacgagtgaccttccatgcggctgctactcctgaagggagcaaaatggggtcatggagatgggtgcaacagtgaaccaaatgttgcccagcgcacgagcgcgccgctgcaacctgtgattccaacacgatatccttccagattgcaaaaccgcgaggcaacgtgcgggctcgagtgcaggggaagggctcgagtgcgagtgaggaggaagatgggggcactgtcgtgcgcttcacgacgccggcacgcgtaggcacggtgggcgccgccgcgccctgagtttggctataattggcttggaggaaaggcactgcgagtccgccctgcgtcaacggcacaaaggcatgctgtaaaagtaggaaacggtgtatgcggaggccgagggtggtcgccaaagcggaggcaatgactggaagacgaagggggcgaacggtgagactggcgacaagtggcggggagggaggacagggtggataaactcggtaggctcctcggaatggccattgcggggcttacgcgtcacatcgcggagggtggcggcgtgggagacggtggtgtgtgagagcggtctcgccgtggtggagtgtctccgccgattgacacggggtactcgtactttctacgccgtttctttctcaattacaccggatataataaaataatgtcttcgatgtacggtagctaattaccaggtttttacggtgtcctatagccaattcatatctttacggtgtctcacagctaactatatattttttgagtgtcctgtagcaaattttgcctaatttggatatggtggcatcgcaatcgcacttatgtgcctacctgcactgcacagcacacatattgtgatctgactggcaggtaccacactctaaaagcaagcatttgttcggatactgtatcacagaatttatagaatccgagaaaaaaatgtttaagcagtcacgaatcttatcgaattttttaatatacatggtggcatgctcccctgctactattactaatatattttcgaaaattctctaaattcggcgcctgatgcgggcgcgcatgcatcgggcgcctcgcgccgccgctgcctaggccccgcgaatgcatgggcgcctcgtgccaccgccgcccatgccccaccacgtgtccccactatgcgcgcccgttgcaatagtctaccggatataatggaaacaccctgttaaggtggatccgctttatttttttccatcaacaatgtttcagctagttgtactcgtgatctttcactatgtatagatcaaatgtttcagtggatttttgatactgttcaataatttcatcttgatggacacgtggtttgttgatattcatggggtttaagtgttgtaatgggtttaaatcgtttgttgcatacgttgaactaaattgtttcatctaacgatctgaccgtgtgtcactttttttaagaattgaaacattctttcgctatttgctgaaacattgtttttatatagggtgaaacaacgtctgattttttggaaaccgttgtttcatatattgtagcaaaatgtttcatgaggtaatttggttgtgttttagttttctaaaagattgaaacattttcgaactactttgtgaaacattttcgatctacttggtgaaacaacgtccgatttgtagccacctcgatatatttttttgggttgtttggttcaaggttatagtttatcccgttagatgcgtcacactttcgcattttattaggttagtatttggttcgttactataagtataacaagccacactttactaactccttgctccacatgtcataggttctgcttggaagagtttatgacattagcttttgctagaatctttcatttatcagaaaagttctctcaatcagtctaaaaatttatagttatctatactattataaaaattaaaaatgtttttgccggtacttttggtttgtcatccgtgtatgagttggtttttatgttcgttcgcttttggaaacataaatccgtatttgagttggtttttaagtttgttcgcttttgaaaatatagaaagaatcgtataagaaatcttttttaaaaacttgcatgctaatttaagatgatcggactcctatttgcagcacatgattttctagcaaaatatatatccaagcaaatttaacacagtgaatttcaccgtaactaaaccatatctctatctctactattataaaaattaaagatgtttttaccggtattttggtacgtcatccgtgtttaagtcggtttttaagtctgttcgcttttagaaatataaatccgtatttcagtcagattttaagttcgtttgcttttggaaatacaaaaggagtcgtaggggtgaagacagagcggattcggacggatagtggtcataccatatcctaaaccatattttctaagcggattcggagcaggtgcggatagtgtacggatgcggatgcggagcggattgttttcggatgtcggaaatggtgcggagtcggtgtggaattggttcggaaacggattaaatttatcggatgctacatgtatatgcaatcaatacaacattgagttaacaatccaaggaacaatagtacaataatcaataaatgactcatcgtaataattatatgattaagtgctaaacaacatgaatacatgatgcccataatataaaaatatagctacttgagtgtgacatgagacgataaaagcctttgactaaaatatctatgttaattgatgaattaggacattggatgtaccaatttatgttatatgcaatagatagagtggtcacatatgttgatattttcggattatccggcaaatggcctatcggataatccgaaaaaaatgttggataatccgcatccgttggatattagagataccatatccgcatccgcatccgtatccgccggatttctaaaagcctataccatatcctcgtttcggatggattcggagcggatcggatctcggatattatccgatccgttttcacccctaaggagtcgtataagaaatctctttaaaaaaaaacttgcatgctaacttgagataaaagtcagactcctaactgcatctcatgattttctaaaatagaatatccaagcaaatttccacggtgaatttcaccctagctaaaccatataacaattacaagattaaaataatcttcacccgttgcaacgcacgaatattttttctagtaaaatctaaaaaataaagaagccagggctgcaggaattcga

SEQ ID NO: 57665 - DNA, 1893 bp, Oryza sativa
ccaccactatacatgtctaccatacttacacatctacggatacatctttctacacacactcaaagagacaaactagtggcaaatcctaagatcctattaaacgtaactttgtgaaaggaatcagactttaccaccatacaactggtgttttcccaacaacacttcgttctatatctacatctacttcctctgtcccataatatagcaacctagaactggatgtgacattttataatacaacgaatctaaacatgggacggagggagtacaagatattggctctttatttctctttctcttgtactatgtagatatagaaaatttattgggaaagtaccgatagtgtggactgtggagtaggggtgcatgcattactccagtcaccaggttcaaatcttttatcctttttatttttaataaaaaaatctgcttgttgatccagaaactcattttacatatgcatgataacgccttaaccaatacatatatgcgcaatttaaataagagtacgttttattgaaacatacagatttcatacgaattaattcaatccacccaatttttctcacatccgatccaatctgttcttgcgctaatctcttcctcacgccatgcaccacaaaccctctagtcgaatcttcatacttgggaggggtctccactcctgctgttggagaaatcgctccatcgacaactccgtatctggagagggaggacttaaataatcttgagggttatcaccacctctacatctacatctaacgaactgtgggatatgcaccaaatactggtatttaataatatagacaattagacaccacgtctacactatttagatactattctaatgtcgatcaaaaattaaagtaaacactaatgcacaatattttagtatgctaatgggaattaagagataaacctcacaaaataaatctcaattactcagtaaagataatatcaactaaagcagagtgattgacaaggtacatgtaatgccttagaaaaaaaatagaataccataaaagatatattagaagtccctaagtatttggtgtttaaaattagaagaaaaacaacagatatacggtagctgggctgcttttggctagcccaaggcccaactgcccctccacatccccaaaaccctaggaggtccctccacctccccctagccatcatttgcaccatctccctcccctctggcgccaccccctccccttctccctggtttgtgctccccttgttgctgttgtggcaaggaaggagaagaagagaaagggaaagaaggaagggatgggaagaaaggtgaagaaagaagatgcgtttttatgttgccgctacttgtcgagacctaggtgaagacacttcggaatgcaactagagttcatctcatcattggtgaaggcaagtaaacatagtggtggagcgagcggcaggggtcgcggcggtggagcagcagcgaggagcggagagcaatgggaacagcgacgcgagcaacagcgggagcgacagggatgacgtagagtgagtagcagcgggtgacagtagcgagcaacggcagagcgagcagtagtgagggcggcgacggagcaagctgcggcgcgcggcggcggagcaagtagcagcaggcggcaacaacaagcagtgaggggggtggcaacgcgtggtgacgatcacgtcgactacagatctaacggtggtgcaagcaaatcctgcggcgatagtgaatccttggagatggtgggtcagaagtgcatcgatgcagcgcgagcgaatctagcagcagtggtgagctcatcgtggcgcgcggcgaggtcttggagatggccgatccgacaacggcggcaagctcgttgttgcggctatgaagtctttgggatggcggtgagctct

SEQ ID NO: 57666 - DNA, 1765 bp, Oryza sativa
caatggtattttttaaaacatgcaaagttataatggcacatatccaattaatcctattaaaatttatgatgtaattataattaaagttttaaaatttatagtaattacagtgtaaatataggcaattgtagtgtaaaaaaaatttgactatttttttaaaaaataatatcacgctataaaaatcaccatttcgaagtaggataataatataattgctcctaaaatatatgggcatcttatttttttctggtgttagggagactaaagaacggcaaacacataatcaaaagctaaaagtttgactataatctgatgaaaaaattatcgccatgttagtgatttttttaaactgaatctcctgtttggaccgtaataaaaagataaaaagcttatttttattttcaaactaaactccgtaacttcagttcattctccgcaagaacagcagaaaagaaaaaggagaaacccacaaaaactacccttcctcttatcccctccggtccagtccctccacctccaaatccaatcctccctaaaaccccagcaccgccctatccttccttccttccttccttcgtccgaccaaaacgcgctcgcctcgcgtcatcggatcaaatggtggaggcggccacgcgcggagcagagagcccttcctcctcctcctcctcctgctaatgcgccgccatggccgcccgcgcgctgggtccacctcctcctcacgccctcggcgccacgcggcaggctcctcgctgcccccacgctgccgccgcggacgcctctgcgcccccgacgcatggataccggcgtggcgccgcggcgctcggctccgcgctctccgcccgccggggaaggtctggccctcgccttttttttccctctccttgctgcgtggtatcattctggtacaccctacccttatatttttgctcaattgctcgcttgcagtttatggcgggttcgggttcttgaaatttcttatcccagattgcgtatagttgtcctgaaataatgtcctgcgaattccacttgtatttctgctggtatccttcactcgcatcagcatagctagaatgctaattaattaacccagattgcctataactgtcctgaaataacgccctgcaaattccacttgtattcctgctggcatccttcacttgaatcggagctagaatgctaattacttatttttggctgttttggttgagggaggtttgcatttttcgtggatattgattttctggttaatgttcgatcatatttctgcaggcatactttgtgttcagtacaattgatggatgctcttagaggtggcaatcttcaagtggaaccaaacatacttcattcccccaagccattgatgtctactagacgtggtaatttctttagtttagttgtccatatacacttgaaatgtatttgggattttttattttatgaatatataatgagtgtgcggttcctgcatagaacatcagttgcatttcccaggaaattttttaatcatacatttcagcaattttaacaaataaagttgtacgtcttgtttagttgcctagataattggaatgaatatcatcttttacacaagcaaaaaattcatgactgacgcagctgtttatattagaaaaatagaggtgacctctctcatttaggctctatcctgatagctgcaattgagagtatgaaaatgtattccgccaattcattatgtattcattcatctgtaacatgaaatgtaaaacactaaacagcaatacaagga

SEQ ID NO: 57667 - DNA, 1388 bp, Oryza sativa
atttcattttatgattattcaatacttatatgctcttgtatgatgggatgatttttagtttctccattatgattatttgatgtgatgtctagagttaaaatcatatgatggtgtttcatgtttccatgattccaatggaaacaaatacaattgtcatatttctcagtgtgttgcaacaacagtacaacttcaacaacctggctgttcactttgagtttcctacacagccaaatacatgttattgtcttcctttccattcttcaatggtgttgggctgtgggcatatataattatcttcagtgactagatattgttaaacctacattattctagcacgttgtattcttctgtatctaaggtgctctccgttcaacaaatgctcatatatatttgtctgcgcttagtttcctttggtcctttactccttttacatctgaccagcagttcttttttcctgatctatctttttttattctttctcacaatttctctcgtacagaaaatttagatacaatttccaatatgaaatctgctttcccttttatgcacctttttttagttttgtttagtacaaacttttaatttgatataaggatgcttcttatttccagttacagcaagaaacatgttatatgcaatcaaatataaacttttttctattttatgtaccatcatgttaacatatttcacttactgtttgtagggaaagatttattgaatgagggaatgttgtgtgccaattttctgattgtgatgaacatcattccaaacttatctttgaaaccagccttatcttaactgtttcaggtaccatatggtgtgcatttcaagtataactattttgttcgagaggagaatgacgcctcttctgatatcatatggaggccaggtcctgagtactccttgtcaatacccccagttggccggaaaaaacatgtcattgttgtgaaagatctgtggatgaaaactagtgtggcaggcattcccactccttcctggggatcatggctgatggaagctaattttcttgaagaccaatttgctaagagtggagagcatcaaaacattgtgaaagcccattctgtcattgatacggtggatcgagcctcatcagtaggtaatgttgcgctatcttgcattcacttttatagaaatagtacatgtttccttagtgttgctgaacacttaaatgtttccagttgattggcaggtgaacatattattctgaggcttgggaacggcacacctttacatgtcaagaatatatcagagaatccatctgccagtgtccatgatgattttactgtaaccgataaagcaaattcaattaaatcaagtataagtgaacatgaaaggaatcagcctgttgaggaaccatggatccttgg

SEQ ID NO: 57668 - DNA, 2709 bp, Oryza sativa
  unsure (1)..(2709): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagttatacatggccagagtggtatgtttgcatggtgttcctaagaagatagtgtcagatagaggtagccagtttacttcgaagttttggcagaagttacagttagagatgggtacccgtttgaatttcagtaccgcttatcaccctcaaacagatggacagacggaaagagtaaaccaaattttagaagatatgttgagagcctgtgttctagattttggtggaagttgggataagaatttgccgtacgcggaattctcatataacaatagttatcaagctagtttgcaaatggctccgtatgaagcattatatgggcgaaagtgccgtacgccgctcctttgggatcaaaccggtgaacgtcaagtttttgggacagacatattgcgagaggcggaagaaaaagtgaagattatccaagaaaggttgcgcgttgctcagtcacgacagaagagctatgccgacaatcgtcgcagggatttggcttttgaagaaggagattatgtataccttcgggttacgtcgttacgaggtgttcatcgtttccaaaccaaagggaaattggcaccgcgttttgtgggaccttttaagattctgagtcgaagaggtgaagtagcttatcagttagagttgcctccgtcaatggcaggaatacatgacgtgttccacgtatctcagttgaagaagtgtttacgtgtacctacggaggaagcagatcctgatcgtatagagcttcaggaagatttaacttatgttgagaagccagtcagtattttggaagtaagcgagaggaataccaggaatcgcgttatacggttctgcaaggttcagtggagcaatcattcagaagaagaagccacttgggagcgagaagatgaattgaaatcagctcatcctcatctgttcgccagttcttctgaatctcgaggacgacattccgtttaagggggtaggtttgtcacactctaaaaaaaatcgattaaattaaaaatgcatgttttaaatcattttttagaaattattttaaaagcctacaagctaaaccctaattttctaggaaaattttcaacataaaaatgagctagataaaattttattaaatactatacttgctcctctattttctagatttttctgggaattatttgagcaagggaagtatttttaataaatgaaacatcatttcacaaattatttttattgaaaaagttctaaaaacctcttctttaggttattgggccgattttggcccaatactccctcctctcccgcgggcgagccggcccaacccactcagccgccgcccctcctcctccagccgccgacatgtggggcccacatgtcggactcgtcttcaacctccggccggccgccctaaccgagtccgagccgcctccttctcctctcaaatccgctccaatccgaccccgattcctccgggtttttgaggggttttgatcctctcgttctcctctatctttcccctcaagaaacggagcaattcgttgagtattttatccgaatcgagttcgttttgattttatccctaaaaccgagtttggatttttcccgactcgattcctctcgtttggagttcgatctcttcaatccaatgctatataaaggaccacctcgtcgccctctttcgtttgccccctctcccgtcctctcccgtgcaccgtagcctcgtcgccgcgtgcacttaggtcgccgccgccgccggccgtcttcagccgcgccgcgccgccgcctccgccgtcgccgccgcttgccgtcgccgccgttaggtgcgccgtggtgagaggaacctcggccacccgtccttctttgccgccggtcgccgtagctcgccgtcgccgcgcaagccgaaccgccgccaccgccttctcgtcgccggccgtcgtcgtgcgtcgtttgtcgttgtggtgagtaccgttgggttcgcctcgtcgtcctctacgtgtacatgccctccaaatccgcggccgaccatccaatctccggcgagttggctaaccctagccggccggccattgctgacgtcagcatgacgtcatcatcttcttttttctttcttttttccaattttctaatagattaaaacttcggaaaatcataactaaataaccgtagatccgttttaggtggttcaagttgctaaattcttctaaaatcgagatctacatgttaaaaatatccacatgtactgtttatgcttgtttttgtactgttttgttgattttgtttatttgctttagtttccgacgttccggaggagagcgtttcctttgaggaaggttccgaagcgtttgcggaagcccaaggcaagtcacacagatcccaaacaaccctttgagcatgttgaacccgtttaaagctattattttattacaaatatgcattgttttcgaatgtcatcgggtggtgaacctttcccagttaattattggccgaagatgactttattttcctatgggttataatttgatagcatgaaccttatgtattggattggttcagctaaatgctctatgtaagtttgcttagccatgcttagaaacattagctaactaaagggtttaattataaactatgttattattatta

SEQ ID NO: 57669 - DNA, 4804 bp, Oryza sativa
ttatgatctaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgatcagagtttaaactattcgaatagccgtacccgcgattatgggtgagttgagcaatgtttttcgtgattagtctcacactactcattaatgttaataatgtgataattaatttgactcctggtttggaatggataattcctggtttggaggtttaatttgttcaactggggttggttgttcaaatgaggttgggcctatgcaacatgggtatgttgtatggtgtttatttaatattgattaattattcaactgtttttactattctcttaaatatttattaaatgctgtttctgcaaatgagctatattatgccatcctttgttatcccgtgcacttgcatatttgctgtgtgacttgttgagtatgtcatatgctcattcttgcaatattcattcaccagaagaggagtatctcagtgaaggtgatgatctggaggattaggcttgttcttggttaagatgcctgtggagtggagtcgccatagctgttccgtagtttgttatcgttttatatttccgctgcgtagaatgttattctttgagaggaactatctacctctgtaataatttttatttgcgagtattaaatagttatttatttgtactctattatcaaattgtcattgtgtgcctcggttgattcctggacgagggtttaacacacatgtaagcgtttggaattttggatagaaattccgggcgtgacacaaattcaccgtaccaaaatcccatgccgcgtcgataatattggcgctaaagcaaatacttgcctggctatgccccgcgagtgctcaagaaaattcagcaatttctatatgtgcgctacgtataaaaaaataaagtcgcaatgccaaaaaaaaggaagctatgtataaatttgctaccatatacgcagtgatattaaaaaccaacaaattagtgggcatctaaaatatgcccaaaatgaaataaacatataaacggaaatctacagaagattctacggctgcgacatctggagctttaggatatatttttctttttagccttttagcagtcatgtaattttattttctttcatgttggaatttctaatcaggggttttctctacggagatgtaattaacagaatttctatgtaaatgtatgaattttggaagtaatggactcgcaatttctgatttttatttatttgttgcatttaaattaaattgtctctaacgatttgcggataacggacctactattacgaccgtcccggttttcccgtcaccaaagatataaatgaagtgtacagcactcacacgcaacgataatgggacctatgcaaccaagaagagagctaacacaaaatggatatgaaatcaaaagctcgtgttgcaaaagtacaaggagagacgctagctgattgctcaaaatctgaattgggctaccagatttgcacaaaacaaataaagactaacttctgaaataaacaatagatgtggtgaccgcagcacttctctctttttttttgtaatccttcttgtttttttttttttttgctttctcttttttttgaactcttatacttcctttttttttgccactacgatcagcacaccggattgaacaatatgggtatgactgtaaaaatacaaccgtgcaaagcccaagagcaacttcctacagctagtctcaatgggttcaaaagtatttgcaaaggatagaataggctcactattttttttttgtattattgatatatggactagcacacaaactgaaatagactcaaacaaaactcagaacaaccactaactttgttgtgtccgaaacacgcagataatggccgaatgaatatgtcgaccagagataatgatttgtaggacaccacgtgctctttccaacaagtatttaaacactgatttccgaccctctatgcaactttgatgactattttactgaacgaaatatgcactgaaaattcagaacgcgacaagaaacaaaatctagcaaacaagataaattgatataggctcaagtgtaacacgaaggaacactaagatcagcaaccaaacaagtctaatggattaaaacctaacaaaaaaaaacactagaaccatattgcaaactatgggctattttttttagggtttttgtgtataggacagaaataaaatatgtagctagggtaaaagatcctaccgagacaaccgtgctctgataccaagatgatatggggaaaagcccgaccttctcgacgtaggatccggataaaccgtgaaacctcacgaacaggatgaacaacacgctgcccgtgcaacgcacctttcaccacgaattcgcaaaaccacacgctttgataggttgatccacttgaccacgcaaaagtggatctattgccccctcatttccctacaaggaaaagcaagaacaatctatggcaaaactcccaatccctctctctagtttggcggcggcggcacaaaacctaggagaagaacaagagcaaatttgatgcaattttcattagaataaacgtggtccccctcatgggtcgtgcacaaaggtatatatagccattacatgggttagaaactaactaagaatcaaatacaacacaatatggaaacttctctgcagcaccgtcaatttgtttcggctcttgcggtggaaccagaacaaatttgtgtcctgagccctatccaccacctggggcatgaagttagctttccaacgagtgctcacacgtccaaaacggactacgaacgagagagaaacaagcgttttagtccatgtatgtccaagctggcccaaaccgagtccgaactgaatcttttctttcttatcttgaaactgatggttttggaaggcttcaatccgtggagaaataatagatagactccttcccaacccaagatgggccataggatagtataactccatccaaccatgccgtgcaaagccgacgctcatcaccattgttgttacttgcgcgacacccggtctgcccgcacaggatgtcttcaacttgcaattgccgttggtagaaagctcggaatgacatgccgtttgattcgatggaaagtagacttgataacctttcctaatatataagccattcatgttgaaagccttctcatcaatgcggaattcgccatgaacttcatgaacataatagcatccgatcttccacatgtgcgctgctacactcgtcacctccggctggacccccatgttgtttatgccagccaatggtccaaatctcatgtctgaaagtaatcaagtgcaaaatattatgtagcatcaaattctcatatatttcacgcatagacttagagagaaacgagttcaccttatattctgatccgcaagtaaagaccaatgtacttttgataagtagatctgcatcatcaaatctcatatgccgtcgtcgccgtcttgatctacaacagccgtaggccatcgttgggggtagtagttccgttgccgccacctgcccacgtcaaacctcagttccctgctctccggttgccagtggtggctgccacccataagttcaaagggaggaggcggggatgcacgacacctcatatcccctcggttgtcccgcaccaattcctacctcccctcggctgcctcatcatcatcggccatgccgccattctcgatgtgggtttcatcgtcatcgtctttgacgccacctaaaaccgtcaggtgggaagggggagatgagggaggaagaagtaaagaaagagtaaatatgggatccactgtgtttgtaccataatttggctaagagttagtttcattatttgagcaggacaaattatttagataagttgttatgattcatggagtgatttgtttgagaactagttagatgtatatgtgcagtgactcgtgatcgtatttgcaaactattgagttgcattagtatttgatttagcatggaaatatgcatgtatactagctgcagctgagtaaactatataattgtgtactggtatattactccaagtgtaccagcattaccagctgcagatgaagatggatgcagcactatggaagccagacgtgtcacgttggagcagattggatcgcagtgttggtgcactggagtctggaggctgtggcaggcggacaattgaggcgaagacgcgttggcgtgtggatgtatgaacgatgcagtgcgtcggtctgcatctggatgttgccggacctggttcgttgcgctacatgcggccgtgtcccgtgtgaaattagaatcggtgtcagccaaaagcagataagtaaagacattctttttgcccttgacttttttgacgtaaggaggtagagctctaccttatagtcatttcgttaaaagaaatgaggtttataggttacaagttaaaggttagagttaactggaagcagaaagcagatagaagagatacaaagagaggagagaaaaaggagaaaaagaaagaaaacaaaaaagaaaaggagactagggtggcggatttacaagggagtatacatgaggcttttctctaggaaagccttgcacaccaggctattttttgtctgtttgtttcattggttctcaggctctaaagttttagggtgtctgaaatttgctgcgtgatgcattgtaggttgtcaaattgttgttgtgagatttccacagtgtgtaagcgcaagcagcaaaccaa

SEQ ID NO: 57670 - DNA, 2957 bp, Oryza sativa
gttcgtagatcggataagttatttaagagtcgataaatatttatagagaggagatcgggatacgcggtccatgagcctggtctacgcgacaaagctgccacctacctgacaggtgtatccagcgttcgtacgctaacacgtttgtagatcaatcagaaaattactgagctaaaaaaagtggtaattctagagagtactttcctccctataattttttttttcttttgtaagatgagaaatttcagaaacactttagctttttgcacgtgaattgtttatcatgctaggttttactacattcagcgtatgcgtcatgtgctgatatagcgtcctcctacttttaggaggaatctacccatgggacgtccgatgtccctaaaaaatcggatggtcaaatgttacagttgaccaacaagtgaaacattaagttatatatggtaaaacaaaaaaaaatcagcaactaaaacatttaaatattttataaaacatggcgaagatacacgttgaaacatgtcgctgtcacatatgaaacaacaagtattaactgattgaaacttatgttttcttttatcaaaatcatgcgatatcttgttctaaagatttaattacaacgaatacaacgatgtgttcagatcatagattggataagtaatttaagacaaaaatcattttgaagcttgctgaaataaagcatgtatgcatagataaggtggagagagagagaggagagagagtagtagtaggtagtttcaagaattttgtgaaacacacagaaggcgcatattgaaacatctcactatcacatatgaaacatttagctgtaacggttcgaaacacatgtttttgttttgacataatataatcatatgatatcttgttgtaaagatttaattgcaacgaatacatcggtatgatcagttcgtagatcggacaagtaatttaagagaggaaaaatatttaaagagaggagatcgggtgacgcggtccattagcctggtctatgcgacaaagctgccacctacctgacaggtgtatccagcaatcgtacactgccacgtttgtagaccaatcagaaaattgccgagcaaaaaaaaagtggtaattctggagagtactttcctccctttaactctttattttcttttgtgagataagaaatttcagaaacacttttagctttttgcacgtgaattgtttatcatgctaggttttactacattcagcgtatgcgttgtgtactgatatagcgtcgtcctacttttaggaggaatctacccatcggacgtccgatgtccctaaaaaaacagacggtcaaatgttacaattgaccaacaagtgaaacattaagttatatatggtgaaacaaaaaaaaaatagcaactgaaacatttaaatattttatgaaacatggtgaagatacacgttgaaacatgtcgcagtcacatatgaaacaacatgtattaactgactgaaacatatgctttcttttatcaaaaataatcatgcgatatcttgttctaaagatttaattacaacgaatacaacggtacgatcagatcatagattggataagtaatttaagagaaaaattattttgaagcttgctgaaataaagcatgtatgtatggatgaggtggagagagaggagagagaatagtagcaggtagtttcaagaattttgtgaaacatactgaagacacatattgaatcatatcactattacgtatgaaacatttagttttaacggtttgaaacacttgtttttcttttgacataatcagaaaattaccgagcaaaaaagaagtggtaattctaaagagtactttcgtccctttaactatttttttcttttgtgagatgagaaatttcagaaactcttttagctttttcatgtgaattgtttatcatgctatgttttactatattcagcgtatgcgtcgcgtactgatatagcgtcctcctacctggcaggagttgccatgtataacggggccgtatgccgttgtcttgtgtatatataggcgttagattagtttaggcaaagaccccgaacaaattatcaatctactacttatcttctactttttagttcttttctatttcatattttattttcatggctgagttctactttttagttcttttctatcagccctagaatttggttaatttttaccgttgttcaccagaaaacggtcatgcttctgtacgaaagcgagaaggttatccttttctaggttgcttagaaactagtcgttcgttgtcacgtaaatatgatatttaccttctttgctaatttgcttgtaaattagtcgcttaatttcgtgaaagtgaattaatctagaaatcggttctgctagccggttttgatctaacgattttggcgactctattgtttgcaccgcaaatcgttaggtgattctatgttgaccatgaaaaagtatcaacacactgttagagtggagactttaatggagaggttattggattgaaaggtaaatttgtctctgagtctctcttttggtaaactaaccaactggaatatttagagagtcggatctagagaagagatgtggacctatgaaggaacgtttggaacaatttactcagatttgatagaatatcaggcgactgatgtaattaggcccgtcacaaccgcagaactgccttgctagctacttgatccctgcccccttgttcatttcaatttcaaaaggagcttgattcagcagctgaaaaactcagaaaattataggcctgcatttggatgaagttactggttaaatatctaaattcaaaattcgagatggaatagcactatgtattcacacagattaattaattaattagccaataaaaataaaacgtactgatatatacttaattagtagaaacaggcacagtagaggtagaggtagaggtagagaattaggaagagggggtgactggttcattgg

SEQ ID NO: 57671 - DNA, 2340 bp, Oryza sativa
ctcctccagctccaactccaactccggcgacgccaccgcctccgcttgttcggtctccggagccgccgccgccggtgccggagtaggcggggttgtcgtagtcgccgtctccagcggcttgtcgtccttggagacgtcgacggagcggagcaagaacgacgacgtgctggtgagcgcggtgatgagcggcttgtgggcatggtggtggtgcatcgccggcggtggcggcggcgttcttgggttcttggagagcatcatgcagcaagggtggtggactagcctgggcgccatggctaatgccattgcgactaaatcctaataattaatttgttctctctctatagatgctatgcatgcgcgcgtgtagactgtagaggaggagaagctaaggcgaagctagaaggaatccatggaagcatgggagaggatatgctgctgctatggttaatttgtttcgtgatgacgatactactatgggagagggccgggggtgagggtgaggtgagtgtggataaggcgtgtccgcgtgtgtgcaccacagctaagctgggccaagttcctcgtttgctcctcgtcgcgagtgacgacggtgtgtcatcatgggaggcacaagaaaaacaaacgaccgggggaaaaggttcccaatacccgcttcttgaacgtactagactgatcaacaaacatggctatttcaatttcttgtttggaacaataaatattaattgataataatatatattaattatagttaataaagccaaaatatattctaatgaactataaaatagactaattatatctaatcaacactaattttaacaagttaattactaactagtaatatgcccgtactaacgttacggcgtaacttaatttataattcacttaagaaagaaatgataaagagagttatatatatggagtgatatttgcattccctttctagatcttgagcaaagctatacagatctattaagaagcattgtaagatgagatctaacataatggtagtgcttttcattccgtaacattatctcatattcaggcaactctgttgcacggtgtaaaacattatccacagagtatgaaataatcactaaaagatgggaagcaactcaaaaactcaaacataattagtgggcttggctgatggcagtttgtgtcacatcctctgaaattgtccaactcattatttttctgtcggaaaacaatgcactcatatagtataaaattcatactatccctcataacatttacaataacaatcagatgcataataaaataaaatattttcattaaaacaatatatgatggtaaataaggatgacactttgtaatccacttcttttattgcttcctctgtgttccactgtacttcttgctagattgacaatttgtacaaggacaaccttccctctgatatttggattcctatcgagaagtagctccaacctaagcaggtttggactgattcaggtatccatatcatctacacctaacatcagcatctcgcttttaccttagtttaatttcctgcacctacaatattaagatggtctcaagccgcccaaacacggacatccactgaaaggatctttaggctccctgttcttccaaactatttctatctactataaccactttttgattcataacgcaaactgaataatgtgctgcaacaagaaggaagtggcattgcaaggtcatgtactctaagacattgaataattcaaggaaagaaaaattttgcaaagatgagtattatttggggaccgacaaatatcaacagtaggagatgccttcaatgtgataagaggaaatcacatggattacaagcatatatagagcctccaatgacctgaaaactacaccttacatccaaccaaagaaaaattaatagaaccaaccaaaattccttgcttacatagaaaaaaggagcaggtgccatggtgtaccactgcaaattaataagtcatttggagaaaaaaaaagcaactcaacacattacctgttcacatcgggatgcaacccaaagttatcgtgttccttcagccatcacaagttcaaattttttccccaattgtgacttacaaaacatcaacagcctgcaacgagtcatataattaaattgaatcagttcttttctccctttctattttaaagttctttgttcaagggaattagtcatatgacctcgaaaaatgctattttcacgctccatttgtttttaatgtatggcatattggttagttcaaattgaactaacgttgatgccattactgttaattacaaagaagggtatataagatatagcagtaacgtcattacaaagaatttatt

SEQ ID NO: 57672 - DNA, 3059 bp, Oryza sativa
tgagttgaacctatcagtcgcactacgaaaatataatatatgccaccagtccacattaatatatgccatcagtccaagatgatgcaataatctgaatttttgataaacaagatgatgcaataatctgaattttcaaaaagcatttaaaaaaactgtagcgcttgattatatcatgtttacagcatagcagcagcagaaaagcatgagcatatgaataggaacatgagcacaccattctcatcatcaagtaatatatatatgtactgaaataatctggaaacactgaaaaccaataaatatgttgcacatccccactgttaatgaaccataattctgaaaaaaatgacaggttaagctaagcaatgcctcatgcatgtagatatcagaggctgagtgaaatcaacatctaatacgtgcatagataagtcacgatcattggttggtcatccaagaagtcacgattattggatagcagaccatattcttagggcattatgacttcgcttactccacatcaaagattcaattttttttcataaaattacttgcatagacagaatggataaaaccacctacgattgcacatatcaaaaattcaaaatcgatcctacagtgaaaaaaaaaaccctaaacgaatccaactttagccgcagcaggacagacgagaaaacacccaacaaattgaaaaactcccatccaatcctacaacagcccaaaaatccaggcaacgaacaaaacctaaattgcccccaatgcgaaaatgacgaccgatccgagcagtcgggtaagaggaggaggagacgaaccagtgtgtgtgtgagagagagaggcgcccctctcctcggccagtccccccatgattcaggccatggaactcgctccgatccggttgtgagtgctcggaatccgattcgccgaggcgaggttgagagaatcgaatggattttgggggaagccggaggtggaggagtgattcaggccatggaactcactccgatccggttgtgagtgctcggaatccgattcgccgaggcgaggcgaggcgagggtgagaggatcgaatggactttgggggaagccggaggtggaggagaggcggaggcgcagttgccattgcggaggaaggaagcggagtaaggggatacgattgattgcgcgatcgatctcccaccgcatgacccccaccgcgtgacctcgcgtcgcgtgagccccactgtcgttggatgtgaaacattgaatgattttcatccgttggatttgatgaatgaagtatgaaggatgtaaacatcagttggtgcattatagggtagattaataacaaaatgtattaattgttgctaatcaattactaatgatcaagagtagcaaaggtggatttcctcatctgaccaatttggccagatacactcatccaacatcttcatggactattcagtctccaggtcgtcctatccaccattgcccaccaactaaatatactcaaaaaactatatcaccatgcaccatctcctatccaatgatatatctccaaccaaagacaacctaaatttgcaaaccggtcatgcttcctttctggagcatcagggtgttttgactaaaataatttgaaaaactgcacacagataactagtgagtgttcttcaaagaaataaatatagaccaatgattataaaatgtctgctaggttgatatggatgataaaatcccagtgcatgatgataaaatgcaaggtactcgtgataaaatccaattaccatagtttgaaagctatatatcacaatatggtttgcaattatagttagaataaaggctagttcaagaagcaaataagatggttattcataaattaatcattaccaatatgattgtgattgtgcaatatgttgatcctttagttcatgccttaagcatgcttgcgtgctcgtctcgctgctccagctccattgatgtagcaacggggattcttgatctttcgatgagaggatgatagcttcgatttgagagaggggggagtcgacattggcggtccgactacaactaccataggagtgttgcgccttagtaagtacatgaacttcagattgttgttgttcttcctgtgccaagaacaatcttgaacctgatggtgagactatataaatctaaaagtgaatggagtaatttatagtttagggtatggtgaggctggacaaatctaaaagtttatgacaagatcttacgaacaagtactcaattgcccaaaaggagctcgtatgcaaatttggtagccatttgaattcaatgcaatctcaggtggccgaattggattctagagtgtggggttgatctccatccctgatgtgtacatcttccatgtgcatcccaataatgtatgtcactcctaaactaacagataaaataggggcttgtgatgaaatgaatttacatgatattttatgtgagcaatcgttttataaatagtagtcatggtcatatcatccacaactgcttgaccgtcttggcttgcggcaataggtactagctagcttgtggtagtattaactcttggctcattagacatgacatcacgtccaactactagagtaactcacatctagcagaatatttactatgcaatttggacataagtggacttgtaaagttagggtcatgggtagaaacatgcgatattttagtaggtcaatttacgcctcaaatagtgagcaaatcgtcctatctcgcggaagctggattattacaagccatatttggtcttgaggcttctctcaaactaccaataggtgaaagatgccgtggtgcttctagcttgagaataagctccacatatttttgcaatttccttcttactttaatgtggttttcatttcatgactgtccttttgcagttactacaagacgtattttgttgagcgctacaattacatccttccaatagtattctaacttcctatcattgccagatccactgagttttctaaccaagaactaaggagtatagtatgtttccatcttttagtcgagttgagttgtgtccctctccctgcctcttcgttgttgtc

SEQ ID NO: 57673 - DNA, 3083 bp, Oryza sativa
gaataggggaaatttaggaatagcgtaggaaatgcatatgcaaaacaaagtatatattggaacgcatgatagcagttgggagcagagactttcagttctacaaaggggtaaacaaaatgatcagctattcttcaatcttcattcaccatgatatactacagatcagcactaaaacattaaactggcacaatgggtgtatctgaatactggatgtaggaggggcggaacctggcagcctcccctacaatgacgatggtgatggtggacgtgggctgaccaagctctcggcgtatgcggcagcggtggagttgttgagctgctccgggcgaggagcatggtgggcgccaacgcgtctctgctgctggagctggagtccatggtggcgcgacgtttggaccaggccacactaggcgtcgtgatgataccgtgcacggcgctgctcgacgtgccgctggtgatgtgcctggtgcgcggcttcctcaaggacgccacaaggatggcgaggctggtcgacgcgtacctcgttgagtcggcgctcgaggccaggctgcggcccgctgagttcgaggagagctcacccgcgccgtgttcgtctgaacaaccataacttgctgccttggatctaggctgcaacatcacctctacagggtatatatgctgctcgttaagtaactaattttatatttttcagtgtttgataaaactgaacctacctgctgtttgggctacccagttgtataacccataattacccatacatgtgaacattttacaactatagaatatggaagttgtaggggatggaatgatgacttattgatggcagtttattggttttagtccgttagttcctttatagaaaagaaaagtgaaagaaaagtgatctttaaaaatagcgttgtagatattgttgagatcatcaaaaattgaaaaattgccatcgtggtcctgctttctttttgtcactgtcttttcaatctgttaacataatttagggtaagaattaactaaattggttcgtgtttaggtgtattaaggtagactaattgggtgattgtaatggtaaggttgagttgctaacttgatagtaccaataattgctgggtgttcattgagtgtttgtacatggacctgattggctagctcttgtgcattgttcattttctagataatatggcatgctttctgattaatggcattcctgaattctcactgtaaacatcaattcatctgaatttagttttttccgagtggtttgattgatttcaaaatgcttgggcacagctgatggcctgaaatgctatgatcttgttgaagggaagggtccaactgctgtaaagggctcaattgtgcaggtaaattaaatttggcaatttctcccacctgcacacaattttcattcttcgaatcacagtaattccttcagcggttccaggacaacctattcttggagtgaacctatttaattggtttatattaatactattatctcatataacagagggcttgtccatatttcacatatatcaagtccttgtttctagtttaattcttacggctagctgtaattagtttatcgggctgcttcaaagtgagttcatttggagtctgcttgcacatacttgactatgaatcagcaccttaaaactgattagaactgaacctgctaactaaaatagacaacatgggtgaattatgggcaagtaaaaaaaatatttcgctttggtttgcatttttaatagttgcattagtatgttgcacagtcaaatgagtcgacctgcaatttgagtagttagactgtgtgactatcttttttaaaatatcctacagttttaaattttgcaaacttgatgctgtcatcctaggatgcctcgattgggtttgctcagtacgtccaagtctgaacattttgggggttaattaatagttcatcaggaacaacaactaccacacttatttaattcgtgaacattttggaggttatacatctatacatcagatgaatttcactgccggttttccttgtttgaattaggatcatgatatttatttattagtatactgatcattttagaaattatagaagtgcagtaaataaaaatataatgaagtaatagtggtattatttgggttaatagtttggtgataaagtttcattttactaatagaagatgtatggtttttttcttcggaaattactaataaaagatggtgccacttaattaaggtatgagatccaatcaatctggtgtttaatattcaaggaagttatttgggttaattgatcattttaggaagttatttttgtgtattaggattccagtgaatagctaagttgtcttcttgttgtgttgtagtaataaggatcctgattgctatatgccaataatgtgtacatcattaagggctaaagaaataccttttgtcatcctaaatgaagtaatcgcaggttaaatatcacatcaaacaggtaattgctatttttttaaaaaaaaaaaggatctggtgcatacatgagtcttatttgtttgtgttttcagttttttttatataggttgagaagtgtgtatcctattcggtcatgtaattcctttcgttggattttgtatgtaatttctttctttggattctgtatgtaattcctgtactgtaattctttataatcatgtaattgtatttgaatccacttaaaaggctaaaactatgattgagaattgaagacggaaaaaaacagcgtgcgctaaagaaaacggcgccaaaaaatcggaagtgcccacatgcgcgatggaaaaaaaaaaaccatacgcacgaaaaaaatacaggaagcattgcgtattttttaattagatagagcgacaaatagcagttactggcaattttcctggcaccatcggcagagctaaccgaccgaccagtgcacagtgcaccaccagctcgggagatggatccgctgcttcccttttccattgctgccggcgagaacttcagactcgttgagaagggccgcacttgaaggttgcatacccgatgcacccatgacagatgatcccaaacggttgatattatattttctgatggcattt

SEQ ID NO: 57674 - DNA, 2153 bp, Oryza sativa
catcaatgccctgacaacaattcctatccctcagaaaatctagtttcctcccacctaaaatgttcgtgctacttctttgcatcccgtcatagttaacacactgtggttttgcatctaaaattttggaaaaggaaaaaaaaaatctatcaaaccattgaccaggaaggcgtctatctgacgttggatcaccacaggaaagaattaacaacagagccatatcaaattctgtacttcttgatctgggaataacaataaagcatatcgcacaaccaaatcatctctttggtagagattcacttcgctctctttgcacggctcatccacttcttgataggaaatacagagagttttgggctgcctgcttctttcggaggcgattctgatgtctcttccttccgctcatcagtttccttttcatcagaatatggtagcaattcaaatgccccacgagcaaaacctctagcgatctgcattaattatgtttttaacaagtttcaaaagcaaacgacaacacggttaaagagtcatgatgacatgcaaatgaaaaagtacaaatagcataccttcaacaaaatccacactttaagagagctgctgaggagccctagttttgttttcttgcctgatgtcaagtacgtgcacatctcatggtcaaccctaagaacaaatctgggccatgattttggtttctcagggtctgatttatgtccagaggcagcctgatccattagacaaggttaagaggaacattttgtttttaataacaaataagttaaacactgattatactatttatagcatggagttctagcttctggttgtctacatggagatatagtaacatttggaataaaagacttcataccaatatcaacaaagtcatattcggaaccaatatcagcatgaaagaatacaagcaagctgtttcagtttaacagattgttactgctgcttgaattttgtctagattatcagctgcatactggtcagtgcattcctttaaacagtactacatccctcctctatgttgttattgacaattagtgttcgagtgttaaattaatatatactaccaaagattttatatgatgaaagtattgaaccaaaatctagaactatacggtcaaatctcagaaagttcaatagcaaggatttgaggatgtcaactaaaaaataattgagagattggtaagtggtaagtttgtaggacttacaaggcgtcgacagatttcacgctctatcttcgaaaaagaagtatcaagagcttccacacggccaataccatggcaacaaggacacggctcactgatcatgaacgtaacacttggtcgaacctacaaatttcagtcaagattatagacagttaaaatatcaattaattgatgggtatctatattctcgtaaagttgaattctccatagtggacaactacacacatctgaagaagtgcccacataccctttttctagttatctccatcaaacccagctttgacaattctgaaacaccaactgttgatcggtccttttctactgctttcttcatttcttcaaaaactagttttttgtttgctggagcaaaatgctacattagaccaagaatgaaaagaagggagagagagggggaaaaggaaaacaacaatgtggaatacaaatacaacgccacaaggaaaacatcatgatcagacatagctcagtcagaatctaaaatcacaatgaaacaacaaacaatcattagtatcatctaggagtgtaacagagtatgaaggacgcacaactggtggaaatgccactgtggtagtggtacctgtcgcagtatgaattaataacagtaggaaattaaaaactcaagaaattttcaatcaaatccaagaagactcaatatataagcttaatttgatggcacataaattcaaaacaaaatattcccaatcatggaaagaatatccagataagaaacaaaatattcctattgtgaagatattataattgtatcttaagttgtgatatgctggctgaatcttacaaaggtatgatgtatgtttgagtacagaatgtagagtccagtacaagggttacataataaagtgagatttcaggtcaataaacatcaccacatgttaggtgcatgacaatatgccaaggcacaagtta

SEQ ID NO: 57675 - DNA, 1909 bp, Oryza sativa
gatttggtaaccaacatgcatcatcaatataatattagcaaatagctacatgtgtgagtagctcactcaatagagtattttgcctagcaatttaataaccaatatataatcatgaacgagaaaatgaactagtatcatgaatgtaaatgtgtttatgagcatgtgatttcccgggattaatataggctagtagaagactgatctatagctaactgagtgacgttagtagacagcagggacccaaaaataaagatcagaatggctctggctttacatctccagggaagggattgcggtcagtaggaattggattctgctggcttcctgccacaaactatgggattatggatcatactgtgaacaggggtgaggaatatagaacaggagatgagataactagcgtctattcctttcttaatccataatggatatgctgaagcccatatgaaaggacggctataactttagcctaacaaatcaaatgttcaagtgaaaagaacttaatcataaattgttgtatcagatgttaaggagctatctcactaactgcttacacctagaaagctgctacgcagcttcagaatctgtgcgtgaactgatggccccacatagcagcttgtcgttctagatactatacatgttttttttttctttttttttctggtagacttttggtgaaagacaaatagaagtactgccaagtgcatctcttaggaattaaagcatagtcagctgaaaggtaaatgagtaagacatacagtaaaacgtcaaaataaaaggtggattggattctagataagtaaagaaaaataaggtttgaaagcaaatatactactttccagtacgaaacagaacatgggacatacttgttttgcagcttctaggtttacttctagtatagccttctcctgggacgtcccctgaccaaacatactatgaccaccatttacatcaattgaaaccagagcttcggtctgctctataactaaagaaccgccattatgtagtggaaccctgcaataaaagagcactaacatatcatactacagaaattgtatcatttatacctttaacagaaatgtaagttaatagtgtgtcgttcataagctttttttttcatcgggctataaatctaggcccacgtctgacacatcatgccaggcttgctcaattttaccaggtcaggctaccatgaacaggtctaggctaagcctaatcaccattagcgcaactgccagccacaagctcatgttgaacatggcactcgttatcagtagagcagtcttatttctgacagctcccttgcttgtcaaatggtgatatgcaatttgtagtctaggaaaaaaccaggtccaggtaaaccaaaattacttatcaaagtaatctatattacaagatgtgtttttgttctatgctaaatggttgataaacattacaaagcaagcaaaagaatatgtagcaatgaagctatttaagaaacaaatgcaacaaaaaaagtataccttttgcacagaatattgtcaatctccttttctattttatattcatcaaatataggagttcttttttcgtaaagatcaactcgattgcagagctcaggtgcaacttcttggagatagtttgtgacctaaatatgcataagcaaaaaaaaaagagttataagcctgaaaaatgtaattcctaaccagaaagtccaatagcatacaacagtagacagtaggtaggccaggaacgttctatagacataaggaaaaactagtgtgcaaacaagcatgcgcaactatcattacttaatcaatcaacatacacgcctgaaaaaatattagtcattttggagacaggtttccaagtggctaactgctttgaacagcaggactaactgacatatagagattggcctttggtccat

SEQ ID NO: 57676 - DNA, 842 bp, Oryza sativa
catggtaattatttgcagaaagttatgaatcattagcaaataatgacattgaatagataggtgactgaagtacatatatataagcatacattctctgcagacagcatcatttatcaccaaaagatttacatggtgcataaactgaagtgcttgtatgtctctattcctctatatagtgatatcattaaatgtcctaagaacatcacaactactcatatttgacatcactctgggttattaaatgtcccttccgcatcgtaataagaaaatattagaactaaagaacaaacaaggtagactattgagtaacaacacataagatttctgatcaaaagtatttctgttccaatgcagttaatttataaattaccaaaggtaaacaaaagatcataaagcataaaaaattgtaatgctagaatagcatgagagatagctagtcatatttatctcacatacccaaaaccggcttcttaagcatggaaagggactcagcgttggacctttcgaacccaatccctccttgacaacttgaaccataatttttgtacccttgcgaacttgagaccacctacttccatttgtatcatcactagactctctcaaagcatgttgaatggaagataatgtcttaagatcattggatacttctgactgatcaccaggcaaaagatcctcattatattcatcttccatgtgatcatcaatttcgtcatctttttcttcatcataactagagatactttcaaattcagcactatgaatcatatttatcttagaattgggcaaaaaggccatgtgttcttcattttcagaaactacctcagctggaaatgctgatgact

SEQ ID NO: 57677 - DNA, 6720 bp, Oryza sativa
tccaacaatatcttcatggtaccatcctgcccttcagtagcagcaagatgtaatggtgtcccacagtcagataacgggtcaacataagctccttttgcaagcaatagttttaccattttacaatcacctgaataatgaaaaatccatcgagtatttaatacaaaagaggacaattgtaaattctaacaatctctttctattgcaaagttattgaaacccctttttttccagaagatgtgctacaaaaaccaataaaagaaagtatggcaaaagaccaagatctacacagatctacactttcagcaaaatgacaagccgataaacagggaaaattgaaaatgcgtaggaccaatggcatattttttatgagaatatgtattcctagaaattacaagaaaaccacctcataggaaaaaaaacataaatgtttattgtatccactgaacaaaaaagaaatttacgtaaaaataacttttagaggatgcgtacacagcagtattaggttatttaatgacaattagcagtatttagttattgtgttggaacaaagttttgcttcattattaacataaaggaagaagaatatcattatgtaacaacagaagattgcttatagtaaggaaataacaccacacactgtctattacaacagaaatacagaacttcataaaaaagtgcaacaaacatatgcataacagtgatactcgtttatagtgggggacctaatccagcagcagaatgcagaggagttaggccaccctcgcttgctttgtctttatttgcaccgtgatcaagaagatacttgaccgtgcctatgcgtccactgtgtacagcagaaaccagaggtgtcctccctgtcaagcaaacaggtgaacacctatcaaaacagtatcttcatctcaaaaatatagagccagaaagagcttttccaagagaatggcattcagaagttgctactctagagatataatgcaggtatgtgaaatttaggtgatgtgaggaataaaacagtaaattccataagacaaaattgggctaattggaatggcataaaacattgatcgcacaagacaaatttggacagatcctaatggcaagtgtaaaccttcaattaaattgtatagtcagtgcagaacttatgcagaatcaagtacatattcttggagaatgtgaatatgtgcaaataagtgaattaaaaaactaacatggatattatcttggtaatattttataattggaatggccacgatcatgaataagcagaggataataaattggggttaactggatccatgccattataaatttaccagttttaaacaatgtcattataactctgtctaattggatatgccaccacgtaccctttggatgcagtgaaattttattttagactaaattgccctttatcttctacctccgtactctccactcttcctcccatccctaagcagggatagcggcagacccacctcctccccaagccccgttgccggagccaaactcccacaccttgcgtccacccaacaaaaccaaaactcgaagcatatcggcttcatcaatcaatgatgaacccaacaaaattttctatctcaagaaatttctgcatgtcttttgtttttcccccggtttggttgatggtcaaaagcttggatttcagagtgcaaacttgctcgcatctgggcaaacattggatattttgaatgattttagcgccttgtcttgattttggtgtttgtttgcttgggcatctttggagctaaaggtttaattttgggaggatatttagcggttcgcagacatttggtgggagcggaggacatgaagttcttcagcaccgctacgtgcccgcaaagccaacctactcgcccagatcctcgagcccgacggatgagtttgtcaatgagcggcggatctgggagagagatagagataagggtagtttggtccaaaaaggaatttcagtgcaaacaaatggtaagcagttgcatatttctaattttaatatatttgcaatggaatcttccaattagatgaattgtaatggcatttttcaaaaggggcaaatttataatggcatgaatccaattaaccccaacaaatgggtatggatgctgaaccatgctttctttattataaattcacgaggtaaatcaaaatgacatccagaagctttttatggcatgcacaattctagaaggaataaaactattgattcaaaaaatattaattgagatgtatatattaaaacaaaaaatttgataatttgacacttttttcgatgcccaattactttaactgacatttgtgatgatgacatgtggggccatctgagtgaatgaaagtgggccaggatatcaaataatcgaaacccatttaaaagagtgttaaattatcatatctcttagtctatgcatgaaaaccaggacaccccacaagcccccaatgcaaagtgaaagttgcatattgtgacaaccaaaaccaccctacaccgctcactgggaacaatcagaactatgcaaactagggtttgtatccagagaagcagaccttctttgtcgaggtcatccacatcgaaccgcatcgtctcaaccaggtacctgaccacattcatgctcccgttgatggcagcgaggtgcagcacgccggcaccttccatgccttgcacgcctgcctgcctcgcctctcccacggtctcccggaggcatcccctccccgtatccagcatgttcgccaggtctggatcaaacgaaatcgaacaacaccaccacagcacccacaaagaaaacaaaaaaaaacggaagggaaagaaaagatcagcaccgggagaggagtcgaaatgacgaaatccaagccggtaggtagaatccacccctgcatactcttgaagccgcgcaggttgtcgttgtacgccgcctcgaggagcatgtgatgcgcgccggcggcggctcctgcggcgggaaggggtagaggagttagcggcgggttcgttgcgttgcggcctgaggggctagtaggattagctagcggaggggggctcttacctgggctcaaaccggaaacatgacgcggcgacgccatgggtgggggtgatgggcgaggtgctccggtggagaaaagtagagatcgctagggtttgagagttggcactgggagagaaatataggggggaagtaggagctgttgcgtggttttgaaagggaggggaggaggagaaaggggaagaattggcggaaggaaggtggaagcgtatgcgggaagctcgttggatactgcgccactgcgccgtgaaaagagcgctggttgcccagcaacaacactagaggctgacatgtgggacaagtttgcactagggcccatgtgtctttcattactattgcaagtacacgtatcacaaaatggagtatacttttttttttttactaaaccggcacaggaactgccaattatctagactaatataaaaggtacgagttgtttagtgcaattaacaccgtaattgtaattagcgtcggattaacgctcccacgccttttccccatcgcaaaatccctgcccacgtcatcaaatcccgcgccgccccttgcctctccctccaaaccgtcactgggcggcacccaggatcgcgtgccccaccctcccgacgcccctacccgccgcccccgccgccgccgccagcggcgcctcccgctcggccccgaccggcgagtcgcgtaggagggaagcgccacacttacacaacgagaggaagcgctgctccgggggcacgagaggaagcgaccacgtgccccaccctcccgacgcccctccccgccgccgcccgccaccgccgccagcggcgcctcccgctcggcctcgaccggcgaatcgcgtaggagggaagcgtcacacttacgcaacgagaggaagcgctgctccgggggcacgagaggaagcgctgctccgggggcggcgtccggcgcggcttgactcggacgcgacggcgacggcacggtctctcctccggtggccaccttctcctcggtgagttcatcccctacccctcttccctcctcttctagggttagggtttctcgcacacgtgctgctgctgcggcagtgacggcgcacgacgatggtaggcgtggcgggggacgccggagagtcacaccctctcgccatggccgttgaagctccgttgctgcggcaaggagaagcagcttcaagagttctttcttccactgtttcttgattaagctcgtcaatggaagcaggcagggccagtgttagtgtaggcatgtagctcactgaattgtatagagtaaatttttgttcagatgttcaacaaagagacaaaaggcacatgcattgtacaccagaaataatctaggcaaaggtgatcatttaatggcacagtgttctaacttctaagatattattttcagacaagttgggtttgttctgacatataatggggttttcttcttctcagcttattggttgacatgagcttatgctgaaagacaaaacagtcaaaaacactgctgaatgcagtacaaagttttaccttactgaaattaattagtttttgataaataaactgtattcagataaataaattagttcaatgtcatgggcatgggggtgcttcaattagtagctgaatagaagggacattttttggaatgtagacttcactctaaacattttttgtgacttgcagatcttttacacggagacttcaaatctactggtttcttattttttaatttttcaaattcaagccttacaattcaattgtagactaatttagtttcaaatgaacaccaatggacaatcatgattcattttagaattagaaatcttattaccactgttactagggcagctgtggcacatatcgaaagtagacattttgaaaagcagaacatgtgaagtgactgacttgttgtagagacatgcatctgcatatgatgggaagtagagatagagcttagggcttcttgtgtactgcaatcctgaatttacagcattcactgcaatcaccattgcttatcatctccctggttccatgccctctcttttttttcgtgtcttagtgttattctatttcctacatgtgaacttttcaatagtatagtattgatttcatatatgcatcgatttcatatatgcatcaatgttcttgaccatcagcaattaagttagtatatttttgttctgattcttgatcatcaatcacacacacctgtcatattttgctgaaagattcttttggttgagatgtgcaagcagcaagcagcaagcaacaacctacagatagcagtccattattttaaatgtcgtttttggtagttaaaactatgaaaaatgcacataaaaatttctcttttctacatcatagattgagatcacagccgccaatccgaaacaattggtcactgcatagaagtgttccttaaattattgcagtttcagacagaaactaaagggagctttttccctgcaggctttgggaagaaggaagtctgcaaggatactggttttgtgcggcatcggcaaatgttaatcctgaacctttgaatatgtatattgttgatgcaacctttgaatagagcaaatgttgatactgaacctttgaatatgtataagttagaaggtctgctgcttcataatagtagatcatatgtgtatttctgaatatatcttctttgtttggttttttccagtacggcactctgctactattctaggtacatgtccgcaacctgtaatattattttgcggtgtactgattgggcggttagatttcgaaagcaatctcaaattatctgtcctatccaatctattgccagattacccaggtgccatgtgcaatactattttttttttaaaaatgtggcaatcaggaagtttgagaaccagtatgtactcctaccaatgaagtttggaaagaaaatttacatagtttgtggcaaataatgttcaggtttgcagattaacatgctaccacggtcaaaactgtatgtaatacttgcaagtgtcagattttgtttgttcccctactttactaaaactgtaaattaggttaataacttgtttctgatatataacaataaaagaaaccatgatattaaaaagtatctgttaatgctattaggcatctgaatatattggcttacttctattgtttataatacaggttgacactgtcgacaaatgaagattttggtaaaatcctatcatgtttgaccatggtgtttcactgttaggtacacggtatttaggagctattcgtatagtaaatactggaatattgaagtaaattatatgttcagcttattaactgcattgcaatatctttgatctggagacggttttaattttcatttgtgtggtcgcatcctttaatttatataacttcataagaatatactccaaagtacatgctggtttatgtatttttatgccttcctattctaattgtctaatggctcttgaacaatagatgtaaactacgatgtctgaagttttccatgttttcttccttatgaaaatgagatggagctatggcaagctgctttggcaatccaagtttttcatgtggcttgagctgaagggaagatgcctcatggctgacaatctacagaaaagaggtggcctcatcaagcgaattgctccctatgcaacctgacgtttcaagatgacacccaaccttttctcaatgtgcttttcacaaac

SEQ ID NO: 57678 - DNA, 11800 bp, Oryza sativa
tttgaaaaggctatattgaagaaatttcttattttgttttggttctttctatatgcaaaaattaagggcccctttgatttggaggaaaaacataggaatttttggaggatttcaatcatataggaaattttatatgtttttctattcctataggaaatcaattcaatagttgaatagcaagcaatgttcagaaaggttgaatgtgcacttgatatgttaataaattacctttcaaagtatgtgtactttctaatttttaaatgtgattttatatttccttgatatatattatgaaaaaaatgccttgcacgtgcataattactagtctttcaattaagtaggagtaaaaacacagacaagttacagaaaaaaacaaaaaacaacttctcagcgagaagaactcgccaagcccctcaactgcgaccggtacaaccacacagcacacggagcaccacaccactctatccaaactaccaatgagaaacaacgacagaacccaacgacaaagatcgatgttgagatgctgaaaaagcggtacaaagctttgactttgacttcgcgaggcacgtgtcattgttgccgagcttgccgcccaacatccaacagctccgactccacggcggtcccgtcatcgttggcaaaggcactgccaaaacaatcaagacaacgccaaattcacatgttcaacatcagccaaagcccatgcatcggcaaccaccaacacccctagacagaaattgcaagtgttatcgttgccaagcttcatcgcacccaacaacatagcagctccgactccatccgacagaaacaaacgaagagagttggatgccaccaacaaacaagaaaggagccaagaaggcaaaggcctcgccaaacacctaggcatctagtgcttcgagccttcgagttgacacagtagtctaccaacgatgatcgatgcatgggtaaggttctccaaaacggcgccccatggacgacacgacgtgaaagcgccaccaccgcttgtccggaaaccggatcaaggttttcacctagagattggtagcgacgaaggaaaacaccataacgacgccaaaggtgccgccttcgtcagccacccaaaggctaggcaaggctttcgctagcgagttccattcagtaccaccaccagcccacaacaactgtcgccgaaccaccaccttgaccctccagacaccaagctagcccggtcgaccaccccacggctcaggtaggctcacagcaggatgtcgcaaagccaccgtgttcaccctctcccggaactccccatggccagaatagggttctagccataggaggggaggagttccacggagaggaggttactcgaccagcaaacgagaagatggaccgccgtcgccgccagccgcttccccgctcgcaccaccaatccttgagaagtcgctacctccttgcaccgccacctcacgtcgttggccaccccgtagtagaccatcgccatctccatttgcaccacacacggtaaaggacatcgaccggagagaggacgacccctcccgccatccatggccaacgacgatagggctgccgactcccacgtcgccgatttggctgctctccctgtctgccacccgagccaagccaagggaaccctagatctaggagtgtttgggaatggcaacgaagctcggggtgggagctcctccgccacgcaccctgacgcacttggtgccaagctcagggcggccgctcctcccctcgccgccatgtagccttcgcgccatcgccgccgcacggcctcgtcgtcactggccgccccttcctagcaagccacacggtttccgacggctagcactggcggcggcgaggtaaggaagaggggaggagggtggcggcactagggtttagcgcgtcgccctcgggccaccggtctgaacccgcggtccacctgggcgcccaacgcgcgcgcgccgtcctcttcgcacgtcaccacatccgccgccccttccacgctcctcgttggtgttggtggctgttaaatgccaattctataccgccaacatctacataaggatcagataataaaacatccaacatagtaataggtgtttaatctcacatattccacaagtgttggtgaatatctatatgcagatgataaatcccagtgctgggaggaaaatcagactaaagtggggagaattatatatccatgcaaggaggggttgtgaacttcatcgaaacatcggtgaatcagcccaaaactccgagaattggacagaggaggaccagaggagaaggcaggccgaaggccaggccggggggcccagcccaagttcggccgaaccccctggtgagcaccgttggatccaggttttggcgtggacggtcctgatcatctcctgatgacggttgcgggcatttccgacaattcgcatagtacaaccgtcatacctacctctatataaagacctcacttcactcacttcaacacacacttccaagcttgagctgaattataagaggctctatttcactatattgtatactagaataggaagagagtagagtagaagaagtcggaagaattccgaagctgtcggtaatcttctcctatttcttttattctgtttattactctgaattcaatataatattcttcctgagtaatttagatttatcttgtgagaattatctcttggttagttcctaaatagcatatgagattattgttcactataatcaactaaaatatagtgattgctttggtgagttagaaacactaaagtagatattaattacttagacgtggtgtttaggtaattgttatccagtaattgttgcgtatcccacagtacgtttgaggtaggtgtagaggtggtgacagccctcgagatcacttaagtcctccctgtccgggtacgaagtagagcgacatccaggaacagcgggttgccagtgcctgaagtattgtgttaggattaaagttaagctttcctaaacattgtttctcactagtaaatcctctctatcctggcctattttttgcttggtgtccttggatgaaccggaggaagctctgatcacacacgttcccttggatttgatacccttggaatactccgtaggggaagtgctacatcggtgtatccgtgcgcttgcggattttatctgtaaacgtaagaaataccaacaagcatttctggcgccgttgccggggaacggttgctgatcatttccgaacattgtttatcctcgtatcctttttcacttttttttattctaccttcacccctactatcctagagaagtattcctgttaaactcttctcgaccatggagcaacctctttttgagctgtttgctcctcggggcgaattctatgagacacctccttcatcggagcccatttatacagctggctatgaaattcgtcccgaactaattagtatggttaacaaaaatcctttttctggctttgatctagaaaatccctaccatcatctacgagactttgaacaagtctgctcatgccttaagattcgtggcatgagacaagaaactgtgcggtggaaattgttcccgttctctcttcaagagagagcaaaacaatggtacacttctaccgttggatgtgtaagcggtagctgggaaaagttgcgagacagattctgtcttgccttctttctagttactcgtattactgcccttcgagtagaaattctcagtttcaagcagatcaaaaacgaatcaatcggtgcagcctggtctagattcactaatttagtgtagtccggaccaaccctgtccttactcgagtatgtgctacttcaacatttccatacggctttggataaggagtctgcattctatctagacataaccgctggaggatcgttcatgcacaaaacgccgtcagaaggaagaacaattttggatcgtattctagaaaatacttccttcatgacgcaatccgatgaaccccagtcgaaggcatccgtgtccaagatagaggaacctctaacgatcgagccactcgatgaaccatccacttctgctagctcgattgatgagaaggttcctgagcagccgtctgtcgagaatgaagaaattcagactacagagcgtgccgcaattttgtttagggacggttttgatgaagactatggcaataccccgaactatttcagcaagaagaaaccactcgttcctttgccacctcccgatcctatggaattgggcttcctacgagaaactgtctgggagttaacatccataatgcgcgatgaatggctaagggagccagaactttcatccgaagtaattcggataaatactgctccccgaatcattccttgccatctggaagggaacgacgtcagtattctctatagtccaactgtcggggacaatctcatttccgagtcttttgcattcgcttatttaagcgataaggcagtgactccgacaaacaaattcttcaagcatccaaacggaaatatcatcgaaggatttgggattgtacaagatgttcctgtctgctttgaagacagggaggcgatcatggatttccacgtctttgaaatccaagattttgacatcctaatcaggctgcccattgagcaacttctcatcaacacacctcaattagatagcctcagaataacgctggaagggaatgaattctcaattctattctcacgggcgaggatcgccttgactgaccccctcccagaaattgagtcagcagaagaggttactgtagttcctcctcatgagtcttccaaggcccttctagaagatgaggtctcagattttatcaaggaagaagcagaccccggtgagactctcgacctaccaatcatggaaccaccacctcgacctccgcttgagcttaaacctctacctccaggcctacaatatgccttcctgcataatcacagagaggcccctgtcataatcagtgacaaactctctgaagacaagactcaatgtcttctcaccgtgttagaaaagcatcgttctgttcttggctactcgctccaagatcttatggggattaatcccgcgctttccacccatcgtattcctattgaccccgagagtactccctctagggaacctcaacgacggctcagtaatgcaatgcgagaggttgtaaagaaagaggtcttgaaactcctgcatgccgggattatttatcccgtaccatacagtgagtaggttagcccagtccaggtagtgccaaagaagggaggaatgacggtcgttgcaaatgctcaaaatgaactaattctgcaataaaccgtaaccggatggaggatgagcatcgattacaggaaacttaacaaggctacaaaaaaggatcatttcccgctacccttcattgatgaaatgttggaacggctggcaaatcattcctttttctgtttccttgatgggtattccggatatcatcaaattcctatccatccggaggaccagaggaagactacgttcacatgtccatatggcacctatgtatatcgtagaacgtctttcggactgtgcaacgctcctgcatctttccaaagatgtatgatgtctattttctcggacatggtcaaagatatcatggaagtcttcatgaatgacttctcagtatatggaaagactttcggtcattgtctgcagaatctagacaaagtcttacaacgatgccaagaaaaggacctggtgcttaattgggaaaagtgccgtttcatggtccatgaagggatagttcttgggcatcgagtgtccgatcgaggaatcgaagttgatcgtgctaaaatcgacgttattgatcagcttcctcctcctatgaacatcaaaggaatccgcagtttcttgggacatgctggcttttatagaaggttcatcaagaacttttctacaatcgccagacccctgacaaatctgctagccaaggatgcgccctttgagttcgatgacgagtgcctaaaatcttttgaaattctcaaaaaggcactcgtctctgctccaatcattcaacctcctgattggactctgcccttcgagatcatgtgtgatgcaagtgactttgctgctggtgcggtcttgggccaaaccaaagataaaaagcatcatgcaatcttctacgctaacaaaactctaaccggagcctagttgaattatgcaactactgaaaaagagctgctcgcggttgtttttgctatcgataagtttagatcttacttagtgggagccaaggtgataatttttactgatcatgctgctttgaaatacctgctcactaagaaagatgctaaacctcgcctcttaagatggattttgctgctccaagaatttgacttagaaattaaagataaaaagggagtatgtttagttccgcacccaggccaagatctggcaaattggtttcttctggcccacaatgtaggaagactcaaaagaattcgtcagaagatgcataagctgccagaggcaaggaggaatcactgctcgcgatgcaatgcccctcacatacaatttgcaagtcgagatattcgatgtttggggtatagacttcatgggacctttccctaagtcttgcaactgcgagtacattctggtggcagtcgactatgtctccaagtgggttgaggctatgccgtgcagtgctgcggatgcgaggcatgccaagaagatgttcacagaaatcatcttcccaagatttggtacccccaggatggtcataagtgacggaggttctcatttcattgacaaaaccttccgagacctcctacgagaaatgggagccaaacacaatgtggccacaccttaccatccacagaccagtggtcaagcagaaacatcaaacaaacatatcaaaaacattatgcagaagacggtcaacaaaatgggaataggatggaaggatatattgccggacgcactgtgggcataccggacagcgtacaagacaccgttggtatttcttaacgacattgctagaaatataattcccagcaatggcgcagaaatacttctggtatattatggttacagagttcatccgcaagcgcacggatataccattgtagcatttcacccgagagtattccaagggtatcgtatttattttatcccgtaggaagatcatgtagagagaacttaactaattacttatatattacttgtgataatcatattctaagtaggggttaagataagtccaagggtagagtgacaaacaagcattaactactcattctcataataattaatctaagctaggtggaaagaaaagagaaagagaatctattcctatacctctaatataaatagtatacatacattctagttaactggtatactagctaataccctctatctgatgccctcctggtacttcgagaagccacccctgactgccgagttccttacgatagcccgtcatgaccatccaaccggggctaaatatggaggaataccctccctaggaaattaacttaggattatttataggtgcggaggaatacccgtactgagctgtcaccatcagcggcccacctctcatccggaatatataatcctaaataatgatatcccgtaatctagacaccatgtctaaactaccagatactactctaatatcatcgtcatgacatagagtaattgcataagcaaacactatacccgcaccaaagcatctcccagataagctagcaatatactcactataacatgaacataatgtaaagtaggtactcatatactcggaaagtattccaataccagaaatgtacaaagaagagtattctaataaaagtacaaggcttacaaaagaggaaaggaaagctactagagccatacccgaactcttccgaagactttcggactcctgattcctattctaattctattccaccagctagatactactaactaaacttgagaggaatgagagagctcttgcttgatgtgtgtgttgaagtgaagagagtgagcttcttaaataggtaggtaatgacggttatggtggttggaaagttcggtaattgtcacaccctaaaaatcctaaatatataaattgttgcttaaatggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatgaaattgcatttaatgaataatttaaattgaaaaaggtttttaaaagtctcttttggctttgggccgaaagacggcccaaaaacctctctccctctctccctcggcccagtcggcccagtccagcagcagccgccgctcgcgcgcgcgtccgcccgctgacaggtggggcccacctgtcggagtcatcgtcttcctcgcgtcggccgccgcccgaaaccctagcgccgcgccgccgtcgccgtccgctgctcctccgccgcttctttggtcaccggtgagttcgccgcaacgttctctacgtcctggtgccctccgttcgtgccgaagcgccgtcgttcgccggcgagcttgcgcgcccgagccgccgagccgccgccggagatgacgtcaccgctgacgtcatcagggtctgtctgctgtgagccgccgtggaccgctcgatctcggccgtccgttttggatggatcgatctcggccgttcgttcccgtgaaccgctgccgtgcgcccggtccaccgcaaaccctagccgctgacgcaataaaccctttttccttttcaaaaataattcattattgcgtcataattcaattaaaatccatataagtgttttaaatcgatttaatctttgaaaattcataactaattcatcttagctcggatttagttggttcaagtctctaaatttttctaaaattgagatctacatgttaaaaatatccacatgtattgttcaagcttgtttatgtgctgtttgggtgtttttgctcttttctgtttagattccgacgtttccggagagtccgttttcgcaggagaagaatttgaagagttccaaggccagcaaggcaagtcacacagatcccaaacaatcctttgagcatgttgatcccgtttaaagctattgtttctattcaactatcgcatttattttcgaatgtcattgggtggaattaacctattgtttgttatagcccttttgttcttgaatactttattccttgataccttgggttattataacttgactagttgggctatatatattggttcgactacatattagatgtgattgcttagccatgcttagaaacattagcacactattgggataacttatgactcactattatttaatgatggcttaatgatagttcacgatggtcaatcgtgattggttaattaattacttgccaattaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataaacccacgggggtcgctggggagtccatgccttgtttataagggggtgattatgatccaggaaaggtgctctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcatgataacagatgctataactggtaataatttgtttagctcctggtttggaatggtatattcctggtttggagatagatctgtacagccgggtatggttgttcagaaaggttgggcctatacaacagggtatgttgtatagcgttgaattaatattgtttaattattacttaactgttttattaaattctgaaatgtttattaaaggctgtttatgcaaatggaaccctattatgccatcctttgttatcctgtgcacttgcatatttgctgcgtgacttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttatctttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttagtatcagagcccccttgaccctaggttatgccaaatggttatccatagaagccctctaaaaatattggaaaagtagaattgttctcctccccttctcttttaattaaaccaaactaatggcacatgcatttcataatctcttttagtggttctcattcaaaatttattccagtgttattagtaccgtacatctattactgtactaatggctcatctaccagcaaaagttttacaatattgttttatttagtcttgctgcaatgaaataaatttagcatgttgattttataactttattccttttgaaaccggttgttcaaaagtacaaaatttgtgacctcgtttccagctgtttcaacttatcttgcaagcttggtttattttatttacttaccttttactttgattttctaactttattcaaattaatccaaaaacttgtgctattaattggataaatgtcttaactccctcctttcacttgtctttagatgccgcgctataagcctgagtacttgtttggtgttgagggatttgtccaagagttgcgtacgatgtcctttgtcataggatttgggactgcctctttttatgcccagattcctcatgatcgtcctgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctacagtgatcagttggccgacactgagtatcgctaccatcctcgccaaccacagggaagtgaccgtggcagttaccttgacactgaaggaattgagaatgatgctaccacaaggcatttggttgagatgctgtgggctatggatgaaacccgtgcggagactgtgttagcggctcaagatcatgaagatcggaatcgtggtaagatttgcaagctagaggacaaggtggatcgtttggagaaggaactagccgcattgaagggagaagcaccaccgcagaaggccaggattcgtcttaccgcaaggaagagagctctatttgtccctcgttaccaattggcgccaaaggtccgtgtggtggaaaaagaagttaccccagccctagcggatcctccggtcgtcaatataagtgatgatgaaggagaagaatcgaagcgcacccattccaagatcgagtggggagcaactcaagatgatggagacgagccgaacgagccttcaatcaactccgatgctcggaagaat

SEQ ID NO: 57679 - DNA, 2195 bp, Oryza sativa
aatgggagaaatgctatgcaagttgcattgcaggcgccaatagcctgtgtgtttcacaggggactccaggtatgcgaaatgcaaaacacaaaggcgtgtttcgctcgtagaaatcatggtggctgtacctggctagtcagccccagactgacctgcgctatcccggagattttcacgatgatataagcaaattgatttttggaaggagccagaagctcctgaagggtatatcataaaatcccattcaatactctctggtagtaatcatactgccgagtacgccatgcatccatgctgctactgataagtgaaagcaccagagacacgcattgctgcaaccataccaagatagcattagaactgtaaaaccccctctgcaaatgatgagttacaagacagttgactaacctcttcagtaagactcaagtgaaacctcttcctcaagttctgaatagtgcgaggaccacctttaaagcaagggaagccggaatcctgatacatggaaagttcggcattatacacatgaaagatgattactgtattgatggacttacattgccatgccaatcacagaaaggagaaaaataagattaggtacatagacgtaacccccacccccccaaaaaaaaaagaaagaaaaggacatattaaaatgatgtgtgtgagcaacatgaaactcggagtatgcaaatgaaacgttttatacattgatataccatatggcaaatgagttttgacctaactgaaactcgttagaatggctcttccgcacattcaagatagtctgacacacatggatgataaatatgaattctgagttatgctatgcaatgttctatacccttgatatatttatgttgagtttttttttaactcagatcaaacccattagaataactattctgcacccaaatccattagttgcaacacgtcatgcaataacccacatgccaacatcatgcaaaaccaccgcctttgcattaacaggttatatcaagtatgcggtaaaatattctgcagacatgcagtagcaagtttccatttcaagtattgcatgtatttctggtaccactggtgtacaatagctatgctaaatttgtatagttcgattcagggtgtgcgtccgaaaatatttttcagaaatagggtgttcgcttcaagagaacaccttatattaggatgggttagtctattttgggaaaaagcacatgattttggtggaatggcccgaccaacatttttttcagctttgttctagtaagttattttataagagatgaggtggtgatggaacaaccagtttcattcaaaccatacagtggggtacattcggatttaggataagatggtgcattacttcaatcgctacttgtgtgaagcatgcaagcatagacaagtgttatataagacgaacactatctgataggctcatctaatacatctagacaaacatctaaaattttagatagaaagttacctgcaacatttctactagtagtataatacgctctgcatgcttccggcaagtaaggaacccttgaatgcatagaacctgaagcgtacaaatttacatggctaaataagaccattgaacttggagatgtcacaataaccaagagagtaattcactactagtccaaataccttgaagtagtcaaagaactcactgggtgttccctctgcatcagaatccatcacctaccatggtccccacaacaaaatttattataattcaacattttaatctaccataaagtttaagttacaagctaccatcttacttcaagaagctcccttgtcagtttaaatggtgcactttcaaaattaacccctccaggagagttggaaagcataaagccaaaatcaatatgaattatatgcccttcctcatctatcaagagatttccattgtgacgatccttgacctgcaatattttaacaaaataaaattcagcgattatttaggcccaatcatgatgacaaaaaagagtatagcactcacaatcgcaaagttaatttatttctatataataaatgaaatatttgatgaaaaataagaacagcatcaaacagcctttttaaattttggaagtgctacaagtatagttgtgtattgcaagttacagaagttcaattgaaactttaaagtaatcttatgaaaatgttgcagcacaataattgcactgcaaattcca

SEQ ID NO: 57680 - DNA, 2065 bp, Oryza sativa
gtctatatttaatactctaaattagtgtctaaagacagggactaaagttaagtccctggatttaaacaccacctaagtaaagctggtccagattaaccggaatgtgaagcacccggaagtgacctgcaaagaagcgatcaatttccaagaagctgcctgcagcttcacgcgcggtcccttctaccaaccacccaaagcgaagataacaactatttcttctctctatccgataaaaaactactccctccgtcccataatataagagattttgagtttttctcacaatgtttgaccacttgtcttattcaaatttttttaaaattattaattattttatttgtgacttactttattatctacaataatttaagcataacttttcgttttttatatttacaaaaaaaaattaaataagacgagtggtcaaacgttgcaaacaaaaactcaaaatcccttatattgtgggacggagggagtaatatagtattggatatatgttgacatatcgcagtactacgaatctgaatgtctactaggttgagtttttttggaggattaattaattattatattttaagatgaaggtaacaataataatagtacaatagtcagaaattgccgtgctgggtgaccaagaaagtccaacaaaacaaataaaataaaataaactgagaatgtgaggattgaataaacaggcgaacgttcaactcgaggcgaggatagcagcacaatgggacggatctagcgcttggtgagtggcgcgcagtgggaaaggatcggaggagtgaggggtaggatgttggtgacggcgacgatagatgtcggagaatgaactcctccatcaaagaatcgtgaggcccccctttgtgagttcggccggaggcagcgggtgagattcgagggcttggtgagcgaagctgtgtgatcttgagggggtttaatcccccaaagacgatgagacaaaaggggtttatacaggttcgggccgctgagaagcgtaataccctactcctgtgtttgggattatggttgagtgttacaagggttcctaaactccggagagcactctcgctcttcttctcctagagttcaggttttctgtcagttgtcctctttcccggcgggtaaggtcatccttttatatatcaaggggttaccacataggcccaaaaacataacttagtggagaaggattacaatctttgcattaaatgcatgtcttgtctcttaatttgggaagcaagcgcacgtcatcttgatgatgaggcctgtcaaatcttgccgcctgacacggggagtgcccctgtcagtcaccatttaatgggtgaagacttctgggctcctattacaccggaaaacgggagccttgctttgaccagagcaggaggaccgactccttctgagataagaggatgaggacctctcaccatcattatttgatgagacatgtcagactgcacgttgcctgacacacgagcagcgcacaggcgcactaccccagtcctatcggtcattcgaccggtcacagaccggttgagtgcattgcacaccgcattaatgtggcgtggcgtgactactcgggccgccataaatgcgggtaggtgggcacctgaggcggacacttaacccaacgtacatggtgaccaggagagggggtcgggggagcccgaccccaagtcacgggagcgggcggccgccgcccgacctcgggcccgatcccccctcgggggagggccacgtggcgcctggggcagccttctccctctagtctcggccagggagtggccgccgccccacctcgggcctgactcccctcgggggagggccacgtggcatcggggggcagcctcctccatccagtctctgggaaggagtggccgccaccctacctcgggcctgactccccccctcgggggagggccacgtggcatcaggggcagcctcctccgactagtctttgggaaagagtggccgccaccccacctcgggcctgactccccttgggggagtgccacgaggcattgggggacagcctcctccgactaatctttgggaaagagtgacc

SEQ ID NO: 57681 - DNA, 3771 bp, Oryza sativa
  unsure (1)..(3771): unsure at all n locations
ccatctccaaaataacatagggacccacatgtcagcctctgctagccccttcttcttccttctatttcttcctctcttcctcttctcttttcctgttagggcagtggacgagccggcgacgggaggcggtagcaaggaagcgggacggcgtagcggcagctgccggcggtaggaatgacccaacagaaggcagtggcgccaaggacggcgtcgatagggaagacggcggacacggagcggtgaatcaacgcaggtggcagacgtgggacggcgagcgacgatggtaggagagaggctggcggcgccgaacgcaaggccaaatccgcacaggggcggaagcaccgaaggcctctagacgacagcggctagcgacgacgacctcggcgaagacggtagcggatggcaacctcgatagcagcaacggatggagacggctcagacgacggctggtgacagcggtgtcaggcgatggcgacctcggtagcagcattggatggcgatggcgacctcgacgatgaaggtagtggtggcgctcatgtatttgggtttggcaacctggtttggccagccggatgacttggccatccggttggcaaggctactggagggcattttttctatcaaactagccaaattttagcttggatagtccattggagagtctgttagagatgctctaagtggtgatctgcatatgatgcaggaataagttcactttactttcctcaacttaaagtccggtttgaatttcatacttcatccacaattccagatataatatgttgctcaacttacaataccaatatatactttatgtcccaagacaatatactctcaggttttggctgacatggcggatgagtcaacgtgggacccacatgtcaatggctcaaacattttcccctctctccctctcttcccatctctctccaggcctccatgctccacggatatgttgcgtttgagataatatggacttctcttgaaaattgtattaattaagtataatctgtctggttatacctggtgtaataatttacacaaattacaatattgctatttgtatttttaagattgaatcgcacaaacttgcatcacggtagatcctattgagtttcttttatgagtttttttatagtccatcagatttttggtacctcccggtacctgcaatcagagccatccatcgagccagatccaacggattaaaatcctcgttactgcgcggtacccaagtcccctcgatggtacctcctcctccgcccgtagagaaaattgtgattttgctatcgcaaaagaatggtttcgctggaatactatcccttcaaagtgattcattaaaatgctatcctaaactaggggtgttcactgaaatgctattttggatctttttgttagtactaatgtttttactctcttttattttttctccggaccaaaatgccctcgcctctatgtcctcctttcgcccaggataatggcaggttgacacatgctttgattgctctagcaaaatatattgctatatatttgtgaaacctatgcacgcctcatgctccgccgcgtgatatgtatatactaattgatcattaacactaatacaaagctccagtacactggtttgaaagtcaaacaacacctctttggttttgacacatgttgtgctagagcaatatattttgctttcacatttgtacaataaaaatggtgtgtagtccagttcagccacaagcgcgcatacacatcaagatataatggagaagctagcttaacccataaattttgggcatgaaaaaattgtaaaaacaaaataaaacaaatttggacagcatgtagacataatattgaatagcatgtggttcacaaaatacctcacataacaatggttcacaacataacagtggtcacaatataacagtggttcacatgcaccatggttcacaacatgatagtggttcacatgcaccatggttcacaaaagacctcaaatatcagtgcctcacatgcaccaccaacaaaggtggttcacatacaccaacatggttcacatacaccaccatggttcacaaaatacctcttataacagtgcctcacatgcacagcacacaatcaagtaggcttcattttcttgggtgtgagcttctttgtacatgtcctctttgatggagccggctgtgagcttgattcagcaatattcaacctccttttacatgtcacttgtgaagcaagtgccggttgtgagcttgtccctccttgttccattaacattgcaagccggctacaaggaaattgttgttgttaagcaaaaatacatctaggttaatgtaattgtagttggttgtactaactgtcttgtcacaactgttgggctttcttgaataatggtttctacagtaggcctagttggggtatgtggtataggagcaggagcagcatgagcagcaggagcatcaggagcatcaggagtaggggcataaaccacatcaggaccattaggagcaggggcataaaccacatctatctaaccccttacttccagcaaatcaatcgtgcaatcatgtcactgaaaaaaaaatagagaagtgcatacctcccaacaatctgtagccaggtggagtcatccatggagtcaaaccctaaccacacgttgagggagtggagggcgggaagagctgaccgaggggcagcggctgatgggggtggcggcggtggcggcggatgggggtggcggtggcggcggaggcggatgggggcgggggaggcggataggggcggcggcgctgactgggggaggacgaggtgagggagtggcaggggcgggggccggcgccggcgccggagatgaagccgatgcggaggcacgctgctgtcgcctctgccgatgccgctcccagcttctccatcagtcaacaccggtgctggacggctggagagatcgattcgaactggtgataaggacacaagggtattttggtcagaacaaaacttaaaatagagtaaaatcatttctagcaaacaaaaagatccaaaatagcatttcagtgaacaccccttagtttaggatagcattttaatgaatcactttgaagggatagtattccagcgaaaccattcttttgcgatagcaaaatcacaattttctcccgcccgcacgccctaaacaagtggaggggtaaaactgggttttcgcatggtccgttctcgctgagtccacaccgctcatctggtcctccccgacgcccgcaagccgattctcccgatctcctccccttgaggcacctcctctgcatccgtcctccatggtggaggcgtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57682 - DNA, 775 bp, Oryza sativa
catacagaagttgccagattccattggtcacttgaagcaattgagatatcttaaagctcttgggatcaaggataaaatgatccctaattgtataactaagctctcaaaattaattttcctcagcatttctgggtcttcggcaatcttgacactgccaaagtcaattggagaaatggagagtctgatgtacattgacttgtcaggttgttctggattgaaagaactgccagagtcatttggcaaactaaaaaaattgattcatctggatttatcaaattgttctaatgttactggtgtatcagaatccttggagagtctcatcaatctcaaatatttgaatttatcatactgccggaatattggacaactacctgaagttatgggtaacctctcgaaactggtatatttgaacttatcaagttgctcctatatgaaagggaggttagaaacagaagttttgggtaccctcaccaaacttgaatacttgaatctgtctacagaacacttttatacggaaaggctagctcaaggtttgaacagcttaatcaatctcaagtatttgaacttgtcaggctcgctgaattacttgggttcttcaatagatatcagtttcctcggttgtctgaacaacctagagcatttggtcttgtcgaagaacatatatcttaatggcgtcgtcttacctgactgttttgatacactcaaaaagctacatacacttgacctctcggattgcccacttttgagtagtttaccagcaagtataggtaaagct

SEQ ID NO: 57683 - DNA, 6647 bp, Oryza sativa
tagcttttaaattactaaggacacatatataatttttttactcataaattatttttttagctgttaataaaccattttacgatttgtcatctgtaggccaaacaattacacttcggatgacatatcatttttttagtgcaatgaatatctatgtttttcctttgcaattatgatatgtattttttaagaaagaaatatatattacacatgcctatatgactcctactaggaaaatcaatatcctaggatgggcacaatcagtcatgctaaatttgaccgacgaaatctaaaaacacgtcggtgggggcatatgaaaacatgttttcccctgaaatagatggcacaagtatgccccttttcattaagaggaagtatcaaatcgtacatgcatgtgagcccatcacaaatatttttattacagggtgtgaagccaaatggcatgggaagcaagctattaccaccccggcagcccggagctttcactgtagctcgtctgacaaattcgagtgtcttggcctatagccatgctctgctgctccacatcaagtaggtaattgttgttgctgcagagctctcttgaatgagacatgcaattagcctttaatagtcttaaaaaaaatattgagatgtgtaatcttgtctgaggcatttaactcaattttgaaggattcttcgcttgcgatccttccaaatgtaccatcaattgtaaaattatcactccttacattgaactcttctatcttttcatggcacctgtactaatcttggactgagatgtagtatgttggatgtagtgtattacttagtcccctcccctccaagagaaaattgataaggaccaaacggtccaagcatcgatacaatcttccatcaaattggagtgattccaattgtcaaaatcgcacatacatagcatgtgtcagggagtgcactcaagtgagtgggtgcgagtgtgtaactgtgtatgtgtcttccgtgtaaattactcatagatacccctccgtttcaaaaaaatttaaacctatgtccagattcaaaactaggtttgattttttttttgacagagtagtagttcatataacatggtagcatatggcttatttttaggattttatccttgcaaaagagtatacgatccatgcgaaagaacttgcatttatgtcccgtcttcgcttgacaaagatggttggcaacaacagtgtgttaggacatgtggatgatttcgtacaaaaactatacatacatttagataggatccattattctaaaaaatgtcctaaaatagcttctggtttttatctctaatcagatttttttttgttgtgaatagattcatctctccaacaaataactaagactaccaccgataataaaaagtagctccacctcatcaggtaactattgtcgccgatttttcaagaaaaatccaaaattttgggattctgttggccatggtctcgaagtatttttattttcaaaagaaacttagcgacacagctacaaatcgggtgcaaaaaatcgggcgcctcctacagcactactctttaccctgtatgcatgttagacaacatttatctcttttcctatgtacataactaacttttcacaaacttcaaaaaatttcttatgcctaaattacttatctaatccatgaaccaattacactattatatttgtcgcaattaaatctctataataagatcccactcaaatatattttgatgaaaaaaaatgtctgttgtttcatcccttagaaaaaaaatgtttcatgatttgatcaaatgttttattttactgtataaaatatttcagagagatgccacatttaaagtatactgactgtaacaccggcaatgattgtacgaaacattgagtctcaacaggtaaaacataaaaaaataatacgaaagatacaatatatttgcaaaaacttgatatcgttgaataatttttttgtcacgtacaaacattaaattgtaattgttgaaatattattaaatatctactaaaaacatcatatgcaatatttgcaaattaactagtgaaacatcatatagatattagttgaaacatttaaataaagcagcaggtgcaacatttaaagaaatccattaaaaatctaaatatttttttattagaatataaccatgtgtggtcttattctgaacatttaattgcaactaatttaatggtgcaatcagatcatgaatcgaatgaatagtttaaaagaaaaaaatcatttaatgtttaatagtaagtttgttatggatatgttagaagagagagaatagtaggaaaagtatgtttccgaaagtcaagacgactacaaatcaggtgtccgattttttctaaaaatttggcgttgtttcacccgttgcatgaaaatgttttattactaaaaaaggtgaaacacattcaaatcacaaaatgaaatatttttctacaatgtatgaaacaacggtttcaaatatattgaaccatgaaacacatttgagtacgtcaaaaaaaaattaaacaccatagaaaaccccacaacaacatttcaatctaattaataaaacatcaaggtacatgagttgaaacatcaaaaatattcgaaagaaaaacctagatctacctcttcctccgctacagtggttagccaccacatcgaccgatgttgaacttggtgcaatgagctcggccacaaccacgtggccaccttcatcgacaccgcgcggagctcggcctcatccacatggccaccatcgtcgacactgcgccgagcttggccacatcgacatggctaccgccgcgctgagctcctcgtgggctttgacgcagagtagttgatcgccatgtggagatgatgcaaatagagaggagaaaaagtgtggagagagaagaaaggggagagagagagagagtaagggatgagggaacggataagaaactagtgaggagaaaggctagatacttaatctccctatcggtcgtccggataggatcgtttccaaaagtacatgcatggaaatagcaaaaaaaaaatgtatacaactaagcaggcaacgttgaggaaaaaagcgcctcataatatagacttatgccatgtttgattcagcttaggattatgataatctggattattaggagtaaactgaaacaaacagatagcttattatgataaattattataatctataagccggattactataatctggtaatccactctaaaggtgctttttctagattattgggtgactaacagctaataatccaaaactcaaacagctaacagcttattttatgtcggcttattataatccaatttatagtaatctggctcaataatccagattataataatcttatgctgaaacaaacagggccttagaccaaatgcctaaagggcgccccaagcatcctcggaaactttgtcagcctcatatacacatcactttcttgcatgcgtctcctaattagtttcagtacaacgttatatttgtcagtatatatgcttttttttatgaaaaatatagcggtataaatatagacagtcccctcacttatcctccaacactatactcgatctatacatgctattcctctaattttaacctgagcacaattaatcaacgacacaagattgattaattactaattagtcacactcgaaaaagaacaatgtcagggtcaattccctctggcacagtgacagtcgcctgccacgtgtccggcagcgaccgcgcgatcctcctcgcgctctccaagtagccctcgaacttgtcggcgctgacgtcaccgccaaccttgcccgccgccgttgtcttcctcgccgtctggaactcgccgccgtcggagtcgctgctggtggcggagctgctgccaaggtggcagtggagcagctcgcgcgccatgagctggcgcttgagcgcggcgcggcggaaggaccagtcgccggtggcccagtcgaaggcgtagagcgggaggaagcggtggccgtgcgcgcgacgaagtcgatggcggcgaggacgtagcggagctcgtcgccggagaggtagtaggcgaagctcaccctcgtccaccccggcttcacgccgtggtaccccctgacgatggcggcgcggatgcggagcgagagctcgtcgccgacgccgagcagcgcgtgcccgtacggccccgcgcacgcgcacccgcccctcgcctgcacgccgaacaggtcgttcagtagcttcgccacgaaccgcccgtgcagcggcagccgccggtcgtcgccgtcgccggggaagacgaggaaggagaagatggggaggcgcggggcggcgacgttgccgagcacctccacgttggggttgcccagcagccacgccatggcggcgtcggcgtgggcgcgctcccggagcgcgacggcgccgccgcggccgacgcgcgccttgacccagaacgcgagcgcggcgcggaccttgccgacgatgggcggcgtgccggcgtcctcccgctcctcgacgccggcgaggtacaccgtgtcgcgctcgctggcgccgttcacgtaggcgacagtgccgccgccgcacgtcgtcggcggctgcgacgacagccggtacagcgagcggctcatcaggaggatccccggcgtgcccggcccgccgacgaacttgtgcgggctcaggaacacggcgtcgtagccgtccacctctccgggcctcatgtcgatctccacgtagggcccactgctcagtgagacacacacgtcagcttcagacacacacatgtacaccccatgcatgcatggttagttagctagctaggacatgcatatgcatttactcatgaatgataaactaattaatcaaccatacgtatcttttttcatatataaacagattaatactcaatccgtttcgtattataagttgctttgatttttttctattataaactttgctaagtttgatctagtatatagaaaagttcagcagcattttaaacaccaaaaaaacttcattaaatttaacattgaatatattttgataatatgtttgttttgtgtcgaaatggctactatgttttcctataaaattggttaaacttaaagaaatttgaatagtaaaagtcaaaataacttatgatatgaaacggtgagtattcatcaattattaacatcctttattttttcagaaaaaaagttcaattatatgtttgcattaaaatttctggttatgcaatgatatcagtatgaacaggagtacagagcagagagataataataaagcaatcacattgtttctgaatggcacatgaaaagaaaataatttcagtgtcttcacaagctagctagcttgtgattcagaagttcagatgggttaagacttggaacttggaaggtcaatggctttcactatcaagatgagctactaacaagactcttcgttctaattaattaatgtaaaactagaaaaaaaatggatcaaggaattggttcgagattgcttctgtcatcatcagagaagaaaacatctacaaggactgaataaatctccacatatagtttaattaatgtgtgtactaacacacacattctttatcattcttgcatgttatgtattgctttggtataccatttgctaatcttaattatcaggtcaaaatgacgatgtcatccaatgcaacatgcatgcagcagctggcaggtggattgaaatgcaaaaaatagccagattggaagtcaatacagtggaacaaatcaggaaaaattacctgtttctgaagaggaaatctaagtaatcaagaaacgcgctatctaactcccctctctagttaggttaagtttttgaataaatatgctgctaaaattaaccatcaatttgaccaagaaaaaacaccacatgtatattgatttcatcagcagattggattgtatgtacagtccgtactaattaagaaatgcgtcaactgtcaaactggtggatagcataggatcattatcgaagaaaatgagagttccttgcaccacttggaaaccctagcttccaattcatggacttccgatacttgtagatcattgtattcatacttcatcaaaaacccattataaaatcatgaaaaaaatgaaaatgtgatccatacacatttcatcaaatggcaataatcaacaattaatccaattaatccattagttaaatactccatccattttatattataaatcatttgacttttttcctagtcaagtttgactaagtttatataaaagtttagcaacatctaaaataccaaactaatttcataaaatctaacatatgtttttttaaaatactaatatgtttttataaaaatttagtcaaacttgactaggaaaaaaaaacaaacgacttataatatgaaacatatggagtatttatttaattaagtaatgcatcgggcagtgtgattattagctgtgtctgtgtgcatgtgccacgtgtacctggcggcgaagtcgaagcaggcgaaggcgccgtgctggtggaggaggcgggcgacggcgcgggtgtcggtgagcacgccggtgacgttgctgcaggcggagaaggaccccagcatggggcggtcggcgtgctcgggggcgcgcagcgcgcggcggagcgcggcgaggtcgaggagcccgtcgtcgccggcgccgacct

SEQ ID NO: 57684 - DNA, 11683 bp, Oryza sativa
  unsure (1)..(11683): unsure at all n locations
ggccccggcggcgccgccacgcccatcgcctcctgcagccgcttcaccgccgccgtcgcccccgacccgcagaacagcagcgcgacgtcgccgcccgcggcgccgccggcccccacgcaccgcttgatgtagctcgccgccttcctcgccatcctcgtcgtcctgctccccacgtagctgtcctccgtgtgcgtgttccctacaagcatcgcatcgatcacctcgccatcgccatgaacgtcgtgatcgagctcgcatatcgcatgagatgagaagcgaatggtagatggtactgaccgtagaaggggaggacatggtggaggacgtactcctcgacgtagcggaggccgcggccggaggcggtgtggtcggcgtagacgaggggcggcggccgaacggcgtgtcgaactcggcgccggcgccgacgagctgggacctgacccactccaccttctcctccgcctccgcgctccgctccgacttggctcggagcaggctcagcagcgtcgccgtcgacgtggccttggcggcggcggtggtcacgccggcctcgccgccgccgccgccgtccctggctgctccaagcgatggcatgcttagctttcttgcttgcttcaaatgcttacaaaatgctgtcaattgcgtctctctagtctctatatataggagatgtattctaatagctcgagtggacgtccacccgtttattgcatgtcaactaaatggctacgaaaaattttcaaaaaaattggcaagatagatcaatatgtaacactccacaaacatgcaagttaaaattcaacttctacaagttgtaacaaaaataacaaatttaactataaatatacatatagtaatttgagttttgtttgttatttttgttacaatttgtaccagttgaattttaacttgcatgtttgtggattgatacattacatattgatctatcttattcatattttttttttaatttttttcataactatttagttgacatgcaatanacgggtggacatccactcgagctgttaaaatagtttccctctatatataggagtatatgcacacaatgttatctactaatttagtaatttatgaatatcttttttggagactttgtgagcttgtatatcaagttactccaacatatatctcctgtttcatgtattgatcgaaatgaagatatgctcaaaattcaaagataatttattgagggatgttaatagaataatctatcatggtttcatgagatgacttatgggccggggattgcatggtaatgtgatttgcatgccatgtgtgttgccaaattgcagtcgtctatcgattgttagttctgccgatttgttgaattaactatagaccttgttgcatcagcttggcgaattttgtaaagtttttaagcgaaccaagtcgtaggtagttgtttgcatacttccatttggttggttttcagtgtagccgcatcgccatgaaatttcgtcaagtgattaattaccgacagtgccgccggctgtcaattcatccgtggataaatgtcgtcaaacaaatctaatttgtgttggaaagcaacaaaattggtgaatttctgggggctttatgcggcgaccgggatatgaattttaatctgagtagattggtcagatttgaggagacctaagcacaacacggcttgtaattttgtaagttatacccgctttgaaatttgctcatgcatttcagaaaatatatgaaaccagaaaagaaaagaaaagggcaatgcacaacaatctttattagcgggctctttccgttgtcacataagtaaatttggtgacgtaaacgagagagagatgagaaaaacaaaacatcgttgctatgcatgacatatggttagagtcgactcttagcatttattaaaagaatatttgttatatgggttggagaaaagggaaaaaaattagtaacaaatttttttggtgtattaatagttaaagatagtgttgtctcaattgttttagctaagagcctatcttcaccttaatttgtaactgccctaaggcaataggaggattatataagaacccaatgctaataacttgccgcaaccaattgagattgggccaatctattttgtccatagccagcgttgtttaggatcatggacgtcgtagaggcaggggagaaaatggtaaggaaatttccggttgtcatttttgatttgcaccgactgtttctgtttcagttggtattagtaattgttagtgtcggaaatggaaacgttaatgtcttccgaaaatggtagcggaaatgagatgatggtttttccgaccgttttatcagtaaccgtaattatccaataatttccatcaaaattccgaaatttccccaacagaccagccagcccaacccatcggaagcctatgaatgaaggaaacctggtaaatttgtagcccattaagaggaggaagtggccaagggaaacactgtaaccttaggacgtaccatatagtctttgctgaactttgattttctcaacttattgatgctgaagttagttgaattttgtttatattgttcaccaaacttattatcatatcattaataatcatataacggtgttatgtggagtataatgatgtaagaataaagttataaaatcatcttcatgcatagttaaatgtctgactatgccacgctccgatgtttccgacatgaatatttgacttccgagttccaaccaatatcagtagattccgttccaatgatcccgtttcctatataccaatattaccgatatcgttcagttctaccatttcgattcctttttgagaaaaaaatgaaaataaaaaatggtagaggatttctccgactgttttcatccctacgtagatgtccaaatcagggttttaaattttgaaattgctatgtctgccgggggcaccgaaattaccgaaatttcagaaatataggaaattttgaatttttttggctgaaattgtttgaaattttgactgatactgaatgaatttgaataaaatatggccaaattcacaaaaaaaaatgcaaaaaaccgaaaaattcgggcgagatatgagcttgccggtggtggggaggggggaaaaatttcgaaaaatttgaaacgaaatttcaaaccctggtccaaataaaacatccatcaatttttttaacatgtcaaaagagtcaaatcgtttcaggtatattcattccgctaacaaggagcaaccaggcaagagtgacaaagaaacattcaaagttagattcaagataacttcactcagagggcggatctacctattaggcagggtgagtcgatcgaacaagctacgagcctacgacccttgtcgcccccacatcctcaagaccctctacccccttatagtagttattggttatcaaaataaggtataataaggtgtaaacatccaacagattattccgactcttcacaaagcacgcacatcgcaaacaatgattgagacagttatgcgattgaactataaatatgatatgtgttgtgttcaattctttttatcatgtgagcatatccgttctctgccccatctatatttgtctgcattgtataaaaaacataaaggattaacgtccaattaaccagatcatcaagcatgcatcgtcatgaatatatataggcattgatattggaaaccaattaacactcacgatacgcaacggataaaaaggctttggcgctctcaccaacctggtacacgtcgaaaaaaaaggcgctgatcgatcagcttgatgcaccaatcgcaccaacagattggcgtcaaacagaaattaccgagggcccttcattatattaacattcaacactcccagttcataacaaataagcatacttggtggagccagaagatatatgcaaagttagaatgcaactgtcatacatcagactttctgcataagatatctaggaaagttaagtaaacaatttatttcttacttagcaactgccaaagttccagtgaaatgtttagtgagggcagaacatgcaaataacaaacttcaggggaaaaaaaaattataattgtaagttcatattgcgagtttagtttactgctgttacagatacaaaaccggttacagctagcaggagcaggaaaggcttctatgatctacaaacattcttaagaatttctgagtttgaaacaggaaaccagggttgccggatcaaggaatcgaatcacttccatctccaacaccacccctgaatcaacatcttgaatcccttgatgttaagcaaactgcaattcgatgcaagtagagactctgccggcaatagggttggtggtgcttgctattctgccaacctgtttatgaatctcatgtcaattctccactttctttcatatctgggcattcatgcaacacagcatcgcaacatcctctgagagaaattgcaacctactggaatctgtagctctctttagtgttgcatgtggttcctctaatgaatggctactctgaagaatgctctcatgaaacatctgaagtgtgtcatctgatgaaacttcttgcgcagagttcttcaggtcttggagttgtccaatttttctttcaagctgtctaggagaggcgttgggacttgagatcagaattgtgtaaggaaaaaaaaatattcttgcacatgagtaagaaaaatgactcaatagtaccatgcccaaggaatatatgtatttggcaggtgagtatcaattgcaccatcactaacatgaaaaaaaaaagtaatgtcctgaatggctttgttagcgtcaaattctgcagttccaatttgtgtttctcccagatttctgcaaagcaaagaaataagatttaaaaagtacacaaaaatgtctacttcgattggttaaacattccatctaactgtacaagtatcataaaaggcaacctaacaaaattaacatggctaaagtaaaagacatttgaagtacttcaaagaggtcaattaaattgcagatgcattaattagacaggactcagtacctagctaggaaaataaacaaaatcaaacatttactaatttggttccatatcaacttgagccaatcttgttgcttataagataacatgattgggactttttacttatctttatctttttttttcaaaataatgccagttcagtttcagaatttctcatagaaaccattgcataaaaaatgtacatgaaactacgattaatcatggtaataattcaaccgtacttcaatttagacggcactataatgtatgaggaagatctccataggtcatttattagtttacaaaacagtgcatggatttccagcttcaattttccacctgtgtgctgacaaaatgcaggaaaaatctctatataaaatgtggagtaataggatcatgctgatgacttaacaattttagtaccaatttctgctttgtaagcactgagctcagctcatccgtgttgttactgattacattagtatttgtttatatgctatcgatggctgtttgcacgtgtgccacttatacttttttagtcttagaagttgttcgcatatattagtcttgtctaaaaaatatatcagattgactcaggaggttcaaggttttatttcaaaaattggttgagtaattttatatctctgcctaagatgtgacatagtttttggtataagatttacccttttatgcagatcagttgaaggcagcaagacagtgagttcatggacataaattggaattcgaatttgtgcgcataaattctgaattctaatgaaccaaagtaatgagactacttatcttcattttatccctccacatgactataagaactgaggaaatatctttttttcaataacttgctcttcttattctttaaagatagcgttctaagtgaggaagcccgcctatggagtttggtgggagctaagggactctccctgtttgtggaccccagctagggccttttcttttgttctttttggtgtgttaccgcccatgcagtgacttgttttgtggtggcgtgaattcttgtacttcttgctgttttttggcgtgtttgtacgcttttcttctattaatgcaatgatacgcagctctcttgcatattcgagaaaacaaacataacgttcgaaatgcataacattaaaagttcagtttacacaaggaaggagactaaggaattgattattcctttataaatttggtatagcgtttacctcaaggcaggagcagaagatgctggtgcctctttatcctttttctactacttgattctgtcctggataaatgattgcaaagaggcatggtcttacgtattgcacattgcaacttgtatatgcagccggactgtcaagtgtcaactgtgtgagagctcaaccaaatctcttgtgttctgtcttgtagaaaaaaaatgaatgtgctgtgctactgtcactgttctgcaagctgttgtacttcaatccaacgttagatagacatcggcctgagttgtgtagcaatggtagctgaatcaagtgaagtctgaactgctgtgcaattctggtgctctctagtttacagatccacatgtgtccaccaatagtaagagctataattttttgaaagggaaactattgagatcctccaaatggccgtttttatctccaaggtttcggatgaacaaaaaaagcagccaggaatttctacctacaccctggcaatggcaaaagcacaatgaatcagctccatcaaccgaaatcgctgattttgagctagtcaagaccaaaatacagattcctacatgcaattagcagaaacatatttgcacatcatctgcatttgaaaactcgaggaatatggagtttatgaagtactggtgagtagaggctttaaaaactttaaaagtataatcagtctatacttgattccttgccctcctattccaggtatcccttgaatcttcagccaaagctagtagcaagtataaaagaaccagcataaatctgatgcagtgatgctatccaattcacctcttctatgctctccttctattcagtagtatgtaaaacatacaagcatacacttgactgttttgaacttaaaacaaatcaatatagatgcctcaatttgtgggggaaaaaacataataacctgggaggtaaaacaaaatgaatgaaatgagagcagacagccatgctattaaattcaatgtagatggctgaatttgtggactgtatttccttcattttggttcatgacggcaaatatttcatatttcaattaatatggtttcaagtagaacgcaaactgcaccaatgtgttaattattgcctagttttagacttaccattggcagaatcagtgtggggcatcaaaatgtagacttaaccgtggaattacagcctgaaaattgaattgaacatgctggcaatgaactaaccttgataatgtatcacaaactgaattatttgaataaattccacagttctccgccaaccagtttaggcaaatgcgtatgtatacatagacttcaaccttatacaacaaaatacgaaacaagaatttttgctacgaatcacaataattcataccattagttagttcgtagatggaattgagcttatatggtgaagaagtaagatttgggagggtgtagagacctgaagcgcatggagtcgtgggggcgagcgcctgccttggatcttggccacggcggcgcccttgagctcacaggggctgcgaccctcgatcccagggcggaggcggacgcggacggggggaagcgccgtcggggcgggcgcgccctgaccttatcgatggtgacctccacgacggcgttggttttgctcctcccctaaccccccgcgcgcgcgccgcaaccggggtactcgcccggggaaggcggcggagagggcggccgccgctggaagagccccattgccgtgacgaggaggaggggatggcggcggacagggcggtgtgccggcgggtggccgcccgtgtgggcattcggtttcgtttattcgtttttgttttttttttaagaaattcgggtgtgtcgtttattcgtttattagaactcactcaagacggagggaataactgaagactgaggccttctttagtttccaaaaaaaaaaaaaatcacccaccacatcaaatgtttcggcacatgtacagagtattaaatgtggaaaaaaaaccagttatatagtttgcgtgtaaatgcaagacgaatcttttaagcctaattgcaccataatttgacaatatggtgttataataaacattttctactgagtcttaataaattcgttttacaattttcaggtggaatttataatttgttttgttattaaacaacatttaatacttcaaatatgtgtccatatatccgatgtgacacccagaacaaaaaattttgctaactaaaccgggcctgaaccgataagtacaatagttggctatactacgggtttcgataagtactctatacagtttttaaatctaatagaaaaaatacccgtgcgttgcaacttgtaaaaatatttttggatcgctatacattttactctttggttttggactaaaatctcattccttacttactttccagtcccatcctagcccgctaccttcttttgcttggcatgtctctctttgacgcaaccattaagtggagctgtatgtccagctcgcaaaccggcggcatgctggctagaggcagagcctaaaggagcacacgctactgaaaagggtgaggtgcagtaatcggaataggacagcactagcgagatgcgacgacgcggtcgtcaggactgaagaatgcgcgtgcatcgcaaatagggattagcgcgcaagcggcgggactggaggcggcggctgcatcggtcggcaggtttgctcttgttaattgttggacattgatggctataagggctgttgggctttccgtcatatttggctaaccgatgggtataaccgaataaaatttggttagttgagtatgaagaggtctcggttccaattagttcagtatcggtctttttttttgacccctgcatgtgggaggtgagagagaagacaggataaattttactctaaccttgagtggctgatatatgcctcctcttactcaaagataagaggagcttgttctcggtggtggcggatagggattgagcactttgaaaaaaaacccctcaaaatttgtactttctccattacatataagtcgttttgacttttttttatagtcaaacgtatttaagtttgatttgactaagatataggaaaatatatttgcatttttaacataaaataaatacactatgaaaatacgattcaatgttagatttaataaaactaatttggcattataaatatcgctaattttttctataaacttggtcaactttaaaagtttgactagaaaaaaaaaatcaaagctatttataataggaaacggagggagtatattacactgaggtccaccgcagctatctctcgccataaatacatgatccaatgactgcgagcgagggggcgaaccctaaaatcggcggcaccacgtggtagggtttttcgccctagaacgagccttggattcgtggattatgagatggcacaagaaaaaagtcgacaacagtggcagagctggcgatgttatcgagcctgtgcagctaatagtgtttttcgatgatcaactaattttagaacgtaggtggttattcttattggaggtggggcccaagcgatggctcgacctaccttggagatgcctccaccgccattgatcaaggggaaacaagatgcctaaataggatgtcatgcatgtttagatagtgaggtggaggatagaaaggaggatatacgagatttctaccaagcaaagcaataagattatttttatttttcctggtagaattgctaccgacatgtggatccactaagttttaataccacataagcaccatgtagctgccacaacttatgatgaagaccatgttagcgtgtcgtatacgcacaacatctagcgaaatcaccaataataccgttctgaaagtcgttttacaccagttttaaatagttgaagaaatcaatataccgattttttgattgaggaatatagatcagatttgacatatatgaaacaaattgggccttttccgagtctgtttgtactcaaatccattttgcaggcccaaacggtataatctcagcatgcttaactgggcctcgttgactccaataatgggcctaatggttgttttggtccagtttttaaagtctgttcacttttgcgaaattaatttagttttgtaactggagatgaactattttaattaagtttaaagttggccaaatattggattttaaagttaaagccggttattctgaaaggataattctttagatacctcaaatgtacttttgcgagattttttaatattactagctaaaggcccgtacgtttcaacgaatattataagagataaaagtaaaatcaaaagcaaacattataagtttatagcatagttagttgattaggcatataatgatatattaaaagcaaaagcattcatgtttgtgaccttataaccccacatatcagcttgtaacatcggaggcagaactggaatatcatcattagtattatttaaagtagtataaatttgtggttggagttggagggtagtcgaaattgataatttctcctagagttgtaagcggttatttgtattatgtttttgtttttttaataaagatgattgttgttgttttcacttaaaatctgaattcatgcaagttccctctcgtgacaacaacaacatcacggtcgcttttacgagctgagctatcatctgttccaatcacagtgatactgatacacactgtactgacactgacagtatgaaatcgagctagagctttagctccctttcgatgacagcgccctggcaacagattaccatcagtgtatactcgcaaagtcacaatcacaatcagttgctgtttgtcttagctagctagcttctcacttaattaattaactaacagccgccttctcggctggagttcttctagatatacttacatgcatttatacgtcgtctagttagtatatacaccctaaccaaggacctaattaaaccatcattcattagttgtacaaatcagatcacatatcacaatcgcataccgtgttgtgacagaaagctatacatatactccctcgtttctaaatatttgacgccgttgacttttttaaatatatttggtcattcgtcttattaaaaaattaagtaattattaatttttttcttatcatttgattcattgttaaatatactttcatgtatacatatagttttacatattacacaaatttttttgaataagacgaacggtcaaatatgtgttaaaaagtcaacggtattaaacatagaaatagaaacagagggagcaagatgtaacgacatgatccatttttggtgatggctttcggcatggtgatcaatttagtcctccgtttatttgagcctattttcttgctagggcttttagtagggagtatattcattaatggtgcacacaagtttccactggtggagaaagcgtttgtagtcccggttcgtaatccccctttagtcccggttttcaaaccgggactaccaatccgggactaaagatcgctatctttagtcccggg

SEQ ID NO: 57685 - DNA, 4665 bp, Oryza sativa
tcatatacgttgacggtgcaggcctccaggtcaaagagtaaaaggacccagtggaatctgcaatgtgcgtgggatgcattacatatgaaacacttagcatgttcgtacgggaatgaaatttgttataggaagacactaaaaactctgtgttgtacggcaatagtatgaacgtcttgtaatgctgtgccttcagcagatggacgagattgtcctctgtggcttgcggatactggtcgagcattgcgacgtttactttccgagggtcgatgaatccagtatcaaaaaccccccgccgtcgggccctttgaatctccattctacaacgataaaaggaagtatatattatatatagtctacttatatataaggacctaattaattaaaggaaacgtaataagaaatctaactgaacgatacttacaaaatccagcaactcataatagagacgtcgagggcgtccagctggtatagttcgtagatacccttgaaattgatccagagaatgtcatctccttgcaagaagtccgtgtccctgatcctcgctccgatcatctctctactggtggcgctcatctccatgtatagttgatggaacttgtacatttgtgtgggtagggactacagctgctcaggcttgacaagcggtttaccgagttcgtacatgtatttcacttccgccttttcgattggtgcgcctcgtagcaattgacccgtagttagcccggtgtcattaataaattcttgtattccaaaatcttcaccggtcactaacggctcgatctcttggtttggttgctctccaagctgagggactggtttggactttccagaagatgctttcttaagtgttcgctcatagtccgatagctttatggcctccttggcaggtgcagacatacccctgaagaatttcctggcactcgggtctataggaatcttcttttctggacttcgaggcttcaattgtctcctgacttctgatgccacataagcgtcaagctcctcttgcgtgcaatcgtaccccaggtccttgttttttgcggcgtcaacttttgccttcttcgttgcccttgtgggggcaggcggtggagcttggggggcccttgacttggaaggtgccggacgaggagcttgcggaggagtctgtgtaggagcctgaggaggagtcggtgaaggagcctgaggaggagtcggtgaaggagcctgaggtggagacggtgctggagcatgaggaggagacggtgcaggagcctgaggaggagatggcggagccggaggagatggtgcatgagacgccgcttgtcgcccagggaggatgatgtaccgcttgcgccatagtataatggcgtggcttgtgtctcgtagatgcgtctcaccgtctcctccaaggtaatccaactcgaggtcctcgtatgtgccttccaccaactcaatttcgaccttggagtatcctgctagaatcggcctgcagtggtaagtacctgaagggtccgttggtatggccatgcccgacgccaccttcacgtggtgagaggttatttattagtaatcaacatttataagcagcaacttgcggaatggacaaatctaaaatctataaactacgagcttacctttattgataagttcttgaagggaatatgcagctcacatggtgtccgctgagtgatgtcatcaacggggcaggtggtttcgtcctgggtttgcatagcgtccatgctctgtgatcctacctgccccgttgaggcgcagctgctacgattgcctgaagggctcaccattgcaggtggaatggtcggctggggatcatgggaccgatgtgcggccatgcgttcatcaacctttcttgccacctctcttgcatgctgagctcgtagctcgataccctgtactcaagatctgcaatcttcgcctcggtatctctcttgctcctcattcgactcctatacgtgtggatgtcctccttgaatccaatcttccaaggaatcacccctttccctcgtgttcgtcctggatgctctagagtctgcagggcgagtgacagctcgtccttctctctgtcgggtcggaacgtgccctgagaagaggcttccactgtgtccattagtcgacgcgcagcctcgcgtatctgatcgctgaagaccagggagccatcaactgggttgagcgttccaccgtgagcatagtaccagaacttcgatcgatccggccatttagcggtggccggttcgatacccctctcaagcaagcttgtttccatctcctcccactttggcatcgcgacgctatagccgcctgaccccaagtggtgatgatacttcttcttggtggcattttttttgtttctttccatcatcgcctgcccttgttgacctgtcttatatgcaacgaactcgtcccagtgatcccttagctttgggaatgtgtcgaagttcggtgtctgcccctttaggatatatttctggtatagatctcccttgaagctctgaaactgttctaccattttctttagagtccaccttttcactgtgtcctctatacccgcgggaagggtgaatgtctcgagcattgtggtccacaacatctctttctctgaatctaggacaaagctctcatgatctctgcgtgcccttgttctgcgctagtacaccgtactgacaggcacgttatcccgcacaacccaaccgctgtgtcgtacgtagttcttggctgcttccgccggggcactaggtcggccgtcttcgtccacttccgttatgatgtgctgaccctctagcttctttgcggcacctcgttgcccgcgtgccctcttctgtccagcaaagggttgacttccactagcctcctcctcctggttcccctccacatccctctccacgttcccctcctggttcccctctgcatccctctccacgttcccttcctcgttcaagtactggtttggatcctcgttcccctcttcttcgttccagtactggctgcttccctccgcgattgtatcgtacaatatctgttcctcatcacgatcagccatctgttcatacaagacatagttggtaagtctataggtcatttttgctttaacaatcttatatgctaacaatcatatatgctaagtctaacttgcgtatattagaaccctacacaatcttatatgctaagtcttattacaaatctaataatcttatattaaaactctaataatcttatattaaaactcaaataatattgtattagaactctaatagtcaactatgctaagtctaagtgtcgtatattaggaccctagacaataattatatactaagtcttattacacaaatctaataatcttatattaaaactataataatcttatattaaaactcaaataatattgtattaaaactctaatagtcaactatgctaagtctaagtgtcgtatattaggaccctagacaataattatatactaagtctaattacaaatctaataatcttatattaaaactctaataatattgtattaaaactctaatagtcaactatgctaagtctaagtatcgtatattaggaccctagacaataattatatactaagtctaattacaaatctaataatcttatattaaaactctaataatcttgtattagaactatgctaactcaaacaatcttatatgctaagtcttattacaaatctaataatcttatactatgctaagtctaagtgtcgtatattaggaccctatgtaatcatatatgctaagtcgtctaagtgtcgtacattacaaacctagataatcatatatgctaagtctaagtgtcatatattaaatctaatagtcttaattgcattaaaaatctaacaatcatatatttacatcacttgcctgcgcgaattccttcgagggttagctaccactccggcttgagggccgacgacgacaacgtcttttccgcaacatacaaaaagatgtattaggataaacgcaaagtaacatatattgtatttcacgtttgcgttctcgttaagttcacgtttcgttcacctacgttcgttcgttcacgtgcgttcacgttaatgtacgttaagttcatgttcgtgttcttgttaacttcacttttcgttcacgcacgttcgttcgtttacgtacgttcacatacaacgttaagttcatgttcgttcacgttcacgttaggttcacgttcgttcacgttcacgtacgttcgttcgttcacgtacgtttcgttcgttcacgttctttcacgttctcgttcacgttcgttcgttcgttcacgttcacgtacgtttcgtccgttcacgatcgttcttcgttcgttcacgtggcggcagcggagcggcggcgtggcgccgcggctgtggcttggcgcggcggcggcgtggcgccggcggcggcgtggcggcgcggcatcggcgtggcgcggcggcggaccccgaacacgactccgccgcgccgacgatgccgaacccgaccttgatgcggccgccaccggcgacgacattggcggcggcgtctctcaccccagagatgcggcggcggaggaggcggcggaggcggcgacgacgacgcgcgcgagacaacggctagatacgacggcggcgtcggcgcggggatgtcctaggcagtggcggcgaaggagaagccgagagagattgatcgg

SEQ ID NO: 57686 - DNA, 2862 bp, Oryza sativa
ccgggactaaagatattttctcgctatttccaaattctttttaaacccggttagggttaagaaccgggactactgataagcgcacttaatattaatttccattacatatgtgattctaaaatagagtgtgatgcattaggattatttaaagtcgagcaattaatggcaattacttcgaaacattattgttgtctgtagtgaattaagtggataaaacgtaataagcaaatatatgatttacaattaataagcattctaatgatcatatatacttacatatgaataatattaaattgttaaaaattgtaattaacatatgtatatacatacgacatgtatgatttaaaattaataaaaattataataatcatatataattagcatatgaatgatattagattgttaaaaattgtaattaacatatgtatatacatacgacatgcatgatttaaaattaataaaaattctaataatcatatataattagcatatgaacgatattaaattaattgttaaaaactctaattaacatatgtaaatgccacatgcatgatttaaaacttttaaaaattctaattatcgcatataactagcatatgcatgatttaaaattgttaaaaactctaagtatcatatgtaaatgccacatgcatgatttaaaacttttaaaaattctaattatcgcatataactagcaattacatgatttaaaattgttaaaacctctaataattgtacgtaattaacatatgccatacaaaaattgatttatatggataatcaatacatccaaaatagtttacatcgtgtacacaataattacgtcaatacatcagcggtgacggttgaccgcacgtactttctcctcactattgttccctccttgtgatcgctacgtgagtaaggggtgtcttcatttgataggaggatgctaaggtcaatcgtcaccgtgaaagggggttgcccatccaattgatcgtaatcctcgtcagtcttgtcctcaactccgatgatttttcttttgccttggagaaccacgtaacgcttcggctcgtcaggccctttgcccttctttcctttgctagacatgtccttcacgtaaaagacttgcgttacatcattggcaaggacaaaaggttcgtccgagtatccaaccttgttaaggtcaaccgttgtcatcccactgtcatcaatcattacgcctccaccagtcaacctaacccattggcaccggaatagagggaccttgagaggaccatagtcaagttcccatatgtcctcgatggcaccgtaatacgtgccagttgttccatcgtgtcccatggcatcgatacgaacaacgctgttttggttcgtgctcttcgtgtcttgggctctcgtgtagaatgtgtacccattgatctcatatccctggaatgtggcgatcgacccagatggtcccctcgccaggaaggccagttgttggttgatcgtctcgttacccatgagatgttgttgtagccacgcggggaaagtatcaatgtgatgccgtgtaatccacgcatcggactaaccgatgtttctggcgtgaactagagccaagtgctcctcgatgtaaggagctaccaatgaagattgttgcagaaccgtgaaatgggctttacagaataaattgttgtctaccgtcattattgctttccttccgagagttccctttccccgtagtctcccttcatggcgtgattcaggtaccccgattgggcgaaggtcttcaataaattctacgcaaaattcgatgacctcctctgttccataccctttggcgatgcttgcctctggacgagcacggttacgaacgtacttcttcagaacgcccatgtacctctcgaaaggaaacatgttgtgtaggtatacaggcccgagaatactgatctctttgacaaggtgacaaagcagatgtgtcattatattgaaaaatgaaggtggaaatatcaactcaaaactgacaagacattgtaccacatcattctgaagggcttctaatctatccggatcgatgaccttctgtgaaattgcgttcatgaaagcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatactctccaagcattcaaacatactttcattctctgccttgctaagagtgtagctagctggactcaagtaatggcttcctttctcctttcgttccgggtcaaggtcgctgcgttgttccatatacttcagatcattacgtgcttccagtgtatctttcgactttccatatacacctaggaagccaagaaggtttacgcaaaggttcttagtgaggtgcatcacgtcgattgcgtggcggacgtccaagaattcccaatagggtaactcccaaaatatagagttctttttccacatcgccgcgtgaccatcttcgctctctataggctggcttccaggctcctttccgaacactactttaagatctttaaccataacaaacaccgttttcccgctgtgatgtttaggcttcgtacggtggtccgccttatgttcaaagtgcttgcctttcttccgtaccgggtggtttgcagcaaggaatcgacgatgacccatatacacaaccttcctacagtgcttaagatacgtactttctgtttcatccatacaatgagtgcaagccttgtaccccttgttggactgaccagaaaggttgctaagtgcaggtcaatcgttgatggttac

SEQ ID NO: 57687 - DNA, 15267 bp, Oryza sativa
cttaatgaatgaacacaaatatgatgatcatttagaaataacctcaaaaaactacatgtagatcaatttggaatggaggtagtaatgaatttacagttgagactttacacaacacgcatatcaaggaaataatgttagtgggtgtttgggagtgagaaacttcctctctccgaaaaataagtccctcctatacggactaaaatttttgtgagagggaactttagtccctccttcccaaaccccaccttagttgatctggacagtgtgtgcacgtggtacatttctcttttattcccaaacaccgccttggttgatgtggacagtgtgtgcacgtgatacatttctgttttagtacgatattggtaggctaattcctttgcaaaaccaaaagcattttttttcagttccacctgagttttgaagccgaaaaatgttctaacttataaactaaaaggccagcttattaacatcataattgaaaaggctaataaaccaaaacaaactggcccttagtgatcagtgtaatggtggcctagctaattttatttagtactaatttctcaaatgtcgcaactaaatggcagcagcaaaatgtaggtacggctctcttcaagtgattgtgtgctttaattgctacaaggattgtaatctgtccgtgctgtcggcactgcagttaatcattgccgttagtggcttcacaaaagataagccaatatattaagttagcaaccgtagcaagacacgtacaataaaaaggaaacatttttgggaccaaatgtacttcgcgatgacaattatattagtggtgttattagcatccaatgagtgaccaacattactgattgagtgtgttgcaattaaattcataaatagccgcgtaagcagctacagttgtttgcttaaatgagcccaaatgtacttttgtcattgctaattccctctctattgacatttgtacaacttttcatggaaaacattctatgatttaacaccagctgattttagcttgtgatgattttatttgtatgtttcagaaacataaaagtacagcagagcaaaatgaaacagaatgaccaaggtcatcggccaaatgtctggtttaattttagtataaaccggtcagtactcatcactttttgggtaagggtctcaacattttaaccttggtcataaccagaatcagtaaccttttctccgccaaaaaaatagtactactccattattttttttcttttatttcacgctgacccattaatcatgcatgcctagtttccaaccaattaactctacgacgtagagtgattaataagagtcgaacacgataaaatttagctagttctctcaacctctcaaccttttggttatgacactaatacgacatgttaaggttatgatttacatactgagacttaggccatgttattaatttttgaattattcatcgcattattaaaatggattgtgtgtgcatgctttgaaatatatgttttttcttttcaaataaatttctcctgcctgtttgttaatattattttgtaacaaaatttattcattcttataatcaactagataatccactacaataatctaaaataaatgaaacggggccttaaaaatcttaatttgttgagggaaagttgccattattaataaccaggcccgtacattcacctccataaatcatagtactatttatgtcctcaacatatacaaacatcgtgaaattactttgttgtactaagaataagtgcattgtacaaaaagaaaaccgtgacaaaacatgaagcaacaaaggaattcaagcaccagatctagagagctggaaaagatgaattgaagatcgatctagctaggctgtgatatgtatgggacaggttgacagaatcacatgtagaagctaggtctctttctcacaacaacagtgatctttgcattgtccatgaacagctaagcacaaatcaatgcagcctcactttgtagttgcaagccactacaaggtactctgttcttgctcctcaataaaaacagagcccaactaacactgcctacttccctgccaactactcacaaatgtggcattcagataaaggcaatcctgaaataggcttgaacagagcagaatacatttgtgttttacagagacatttaacaattaatcaaagcaagggatatagtgcaaagttagtacaaattagagtgaggaagagtgaaaatcttgcatggaaaaacagagtaacaaacctaacaaatcagttgacttgtaattcagtgaaaaatttacactacctggtaattgcattgcatatatcaaagatgatagaacaatccatgtactaggccggccctaacaatataactgcactttaaagctcgtaacaagaagcaaatggtagcttttaatttacaatccaaccaaagaaaaaaaattaagctaggggacagatcgttacagaggtttggcaccacttagaatcaatgaattcaacacttctttacagtttcactcggcaacaaatcaacaaaataccccaaacccaagaacaaaaatgactatatctcacttgtacatatatgtatatatataaacatgtagaccaaatttatcttataacccctctctctgtatatattccatcttctgagaccccagaaaagaagaaaactgcacagatcctcaattaatttaatatttttggacctttatgcaaaatttctctcttcttctgtcccagcaagatgcacatgaacttgatcaattccttttaatttccagtaatttaattatgatctacacaattttgttgatttcaagaagaaattaaaattatgccaaccatggatgattaattttcatctcattctaccagctaatagctctagcttaattttttttcaaactcagttgaacttggagcagactttcctgacctcgccggcggcgccggtgagcacgccgacgctccccatcttgaccatggcgtcggcgaagtcctggcggaagtaggggccgaagaaggcgctgagcatgctggagtaggtgtcgacgacgccgacggtggccgtggcgttgtagagcgcggcgtcggaggcgatgacggcgaagccgttgcggatgttgcggaggatggaggtgtcgaactcggcctcgctgccgcggtcgagcggcagccgcgtgttgaagtcgccgggggcgcaccgggactggagctccgagaggaacgcctccgggatcgacgggtccgcgccgcggccgccgccggcgagcgggaagttgtacagcctgtcctgcaggaagaagcacgccgtcgtccccaccgtgtgcgccgctgcaaacaaaaaacaagagttcgtcgccgtcgccggccatggttaggttagtgtgctcgaccgcctcgacgccatggttggcaatgcaaggagtcaagaagaagatgaggcttacagctgaggaggacgaggtccttgtcgtcgaggccattggcggcgaacttggagcggaggacgtcgatggagtccttgacgtcggggagcacgtcggcgtcgcggaggctcgacgtccgcccgtcgcgccgccccgtcggcacgtcgaacgacggcccacccgtctgcaaacaacaacaacggatcatatcaatccatgtcaccgagctaggcagtacagtgcacagcgacggagcctgaaagattttttgagcccgaacaaaattcaaatataacaagtacttgttatagaaatttcatcatcaatttactcataaatattaaaatttaaaggagttttcgccggcgcggtgggtggacgtacgaaggcgatggcgtcgcgggaggcgaggacgacgatgtcggcgcaggagacgacgccggggcactccgactccagctgctgcttgatgctgtccaccacgtcaagcccacgcagcccctggtgcttgttgttgttcacctccgcgttattccccactcccttgatcagcaccgacccatcacacccctaattaaccaaaaatattataatagaaaattaattaaacttaattaaaattctaacaaaatatatatcacaattgaaaaaattataatttattgtaatatttttatgtatatgtaccttggcgaagcagtcgtggaactggagacgaacaagggcggggaggatggtgctgtcggcgtcggcgaactgccggacggcggaggcgacggtggattcagctgtagggcatgacttggagtagaaccccaccttcagctgcgcattgctgacggcggcgccggcgacgagcaccgccgccaccagcaacatcgccggaccaccaccgccaccaccactcctacccatctcaacccaacaagaagagatttcagagagatatctagctagctaagatagctagaatggagaaagaagaaggtgaggaggtaggaggtcggaggtccagctgggaactgcgttgaagagcttttatagggttttctcctccatgggtgggggtgtagtacatgcaatggatggatggatcatggacaggaattatgtttgcactttctcgcaaatggcgccaagctgtaacacatgtggttgcgcgttacacgatttgacttgagtgaagtcccatcgtttcgctacagttgattacaagccgtaacacttattagtgaaaaaaaatatttaattatggataaaacttttgtagcattaggcacgctcttagaaatttaaaagctaatacattagaaaataaattacgatggaaataaaatcagaaccaactctaaaattaagatttaaaattcaaattttggctacggataataagctaaagagcaattgatggagtactaggtccgacctaggaaattaaagtagctacaaagtacacttgttttttttttttgacatatgctgctgatttgtttttttttttccctataacatgaaaataaatcgtgtatatatgctgacactgaatctactgctactagctagatactccagttttctgaattcaaatcctgcaggttaccttcatgaatgctatacacatgcatatactatatactagtaatagatatagtacagtactatgcccaatttcagagccagaaatttccagtggaccatggttaattggcccaagcatgtacgcatgtgcacaggtcaccggagttatgtaggacggttgatcgatgaagctttttcccgggcagcagattgccactgcaaaacggcagtcagcacggagaaaagtagctggtttgttcatgcatatgcatatgctggtcctaactgtggttggcaccaatggctggctgagaaagagcaaagtaaattcgctcatggagtcaggataactaattaaaccaaaagtatttttgctattgggtcacatgagtatgtcggacatggattcatatatgcatgtttagggcttgattgatttggagaagttagtgagaattgatggcatatgcaggcaacaggtaggctgactgcctgaagaatggaagtatctgcagctgcatttctgaacttggagattttctgttcagaggagagaagaaacttactgtacatggctaggaaacttcttgtcatcagggcagtcatagagttgcttagctggtgtttgagcctgattgcctgacatccatgcacatgcatgcttgttttttttcagcttcttttttctttctaggtttgattttgacctgacattcttcatcagagtcgtcaattgcatactaaattaatatgttttcttttttttgagaattaattaatatgtttttctggttcagttaaatatactcatgtgattgaaatctcagaggtgtcattttcacgaatgatccaccatataccattaatttggtgtcattttctcagagtcggggtctcagtttgacctaggcttcaaatccaggtcaaaccctgtactagctcctatgtacacttgtcaatagtcactagctaggaacatggtgtcacacaaacattccgttagtttgcgagaaaatagtgttcacgcaaatattctccgctttcaattttcataactctcaattgctggcggcccgcgaattctcccccttccccctctcggccagcttattagcgcaagcggacgcaccttcaacccgccactgatttcaaattgcaaacatcattaaaaaaacttttctgcagttctagacaaaaactactgataatgcacttgctatggatgatcacttcatgattcatcgttcgcctaatatttttaaaaatgtaagccctcttagaacttctagttttatctcttcttccatgcatgtttggccttatgaaataaatgtcaccactctcacaactaaatgacttttttttagtctagtataaataaaggatatgaaagctctatcggtttgttttcttaattcattggagagtctaaaacgaattatatttgaaaccatagtaatacccactagtgaaaaaaaagtttttccaggcagccaaatggctctacgcaacgcaagcaaagactctgccatcaactaaaggcatgcgaaaaacggtgtttaaaccacattcgtggccaaggcatgcaacccctcgcccacgactatccagacgggcgttcgtgtccgaaatacagcccgtctgcacggtgatgtgggtatcgttgtgaaaaatcgttttttaagtagtgactgattaagactaaaattttatttggatcataaatcaagttgcgattaagcaagtgattaacattatttatgtccaatgaattgagaacacaagcaagcaacatattgcgtcatcaatagccaaataattatatatacacattaaagagagaagctccaaagctgactgtgcacatatcaaattatatataaaccccaagccggccaatttagctgtgccgattgtgactaggcatccacagacaagtatttattgtgcacattatattggctatcaatatatagcatgaccatgagttgggccaagcttgcaaactagagctagcttagcataagtgcacacggctgattgataactcaacggttgctcctagctacttccaccggttgaacggctttcccatttattgcccacgttgcatgtctccttccaaatgtgtgtgttaatttggaagattgccaatgtggttttatgcacgttcacacttcaatttctcgcgatttcaatttttagaggtgatccagctaagctatgcatgtttggaaaggccattgcaaccgaaataatgtgtagaggttttttttttctctggtagaggagataaaggtatctttctctatgatcaaaaagacttatttattttgatgtacaatgcactaaatgatattctatttcgcaacatttacacgttaattgttctctactgccgtagaaaataataatatcaagaagttaccttagccatcttaacttggcatcacagcttgtttaagcatatgtgtctttagttattctttttttaaaaaaacaatttaacctcaaaagttgaagatatatatagataggtcgaaacgaaaaggtatacacaccatgaattagaaagcgcaaaaaataaacgcaattacaaataattcactctatttttaaaacatgacaaaaccatcctggtacgttttgcagcgtgtctatgaaacatataactttgtagatgaatataaaaatgtttctagaaatagtgatagaaagagagttctgtacactatatactactagctctgtattaaatagattcaccgttgattttatttgtttttttcacaactttaaccacttttttaattagaataactttaatacataaaaaagactgtaatattttaaaaatacttataaagaaaaatcaatcaatatgaattttatgtaaaaatacttataaaactaaatattttgatagcatatattattatatggagtatttaaatacagaaggagtacttagtttgcttggtaaaaaaagagagtaaattttacaaaactacagatactttgactaaattatcacaaaactacagatttaacatgatgtatcacaagactacagatttaacactaattttataacaaaactacagatttaaggtaaaatatcgcaaaactacgatttagtaacaaagttatcacaagcatacatgtttaacttcaatttaatcacaaaacctggatatctataactcaaacattacattactgcaaaggatctaaatcctaaaatctgtagttttgtgataattttattctaaaatatgtagttttgtgatagttagttttaaacctgtagttttgtgataaatttattgctaaatctatagttctatgatatacgaccttaaatctatagttgtgtgataatttggtcaaagtatacgtagtttcgtgaaatttacttaaaaaaaaaagcatcttctactgattatgcatggactgaggaggtaattacagtgttatggtgcattaaaagctgcacctaagtctccgtgacggcagtttcattaattaactgtcaaacggttattcaccgacaatatttcagtacctaaagtaacctaactgcctcggtggtgggtccttaagccaagcgaatctgtgaactcggagatgtgttattttctcctcatttctaactttgaattatttttcacgcgcacgatttctaaacagttaatcactatattttttttaaaaaaaatgatagcaaagtgattgtaaaaatcatattaatccatttttaaaatttttaagccaatacataattaattatacgcaggaagggtttccaactcaaaagaacatagtcagaggttgttcaaattgacgccgcgtagctagcccatccgacggacccacttacacataccactccgcttacactttcgtccttacttcgtgtaaaagggttaatccgagagtgatatagttgttccgcttacattttcgtctttactttatgtaaaagggttaatccgaaagtgatatggtggttcccaactcaaaagaacatagttagaggttgttcaaattgatgccgcgtagctagcctatccgataggcgggccacttacatataccactccgcttacactttcgtccttacttcgtgtaaaagggttaatccgtgagtgatatggttagagggacaagcccttataagctggttccactctcactaaactagcaatgtggtactaaacatgcgcacacaacttacatggcccacacatgcctaatcttaattgggtcaggatgtcacaccaaccataccattttttttttggcaaagttgccaaaggtgtgcatacatttagttttttttttgccaaacttcgacaaatacgtaagaaattctaccaaaattttagtaatattgtcaatttatcaaaattttagtaatacataagcattactaaggtttattttggctacgatccgaacagccccttacaaaccgcgagaattttttaccatatttacccgtgagaatgtaagtgctagtatagcacaaggccacaagccgtccgatgggataactgatcggctcatattcaatttcccaacctaattaattagttaatgtttggtagatgattgatcatatgtacattgttcagttattgctgacgatttgcagttttgcactgtgtatataccgtactccctccgtttcacaatataagactttctaatattgcacacattcatttagatgttaataaatctaaatgaatgtgggcaatgctaaaaagtcttacattataaaacggatgaagtactagctagtaggtaatttgacacctaaatttttacttcacatcggtgatatatatatcgatcaagtacattaacttggtcgtcggtcctgcaatgcacatgctcttgcacggttgcacctagtcggccatcgatcaggccataaacccataactgcatgcgtgctagcttgtccatgcatatatctgtacagatgtactaaagtttttagttataatcatgctgtcatgttgccggttactttaattacttggattagtaggcctgcatatcttctgttcctttttaattatcagaatggcagaatgcacgctggcccgttggcctttaggtttttaagggccgagcctatttgatttataacattgaacgaattattattatcgtgaattaattatttaattatagagataaattaaatattaaaaagataaagttgagaactaacttaaaacaaagtgatgaaagggaatgaagggtagaatggtaaattctctgcttccttaattttcacaagtgctccctctatctaaaaatcaaagacctatttcgtttttttgcaaaagtctaagacctattagtaatctatatgtgttgaattaaattgttaaccgaaacccaagaagccatcttattgcatgcaagtgtatagttcatttgttttgtcacatagtggatgagttaaattacttattggtcttggtgacaaaagaaacatgtcttgttttggatggagggagtatatctgaaatatcgtaagtttaaaaaaaagatggagttattacaacttaatattataaaagaaggcattcaaagaacatcgttatacatttttcttctgaaaagaaaaaaaaatctatcatgcatacaaattaaatatgctgtttcgactttggtcgggtttgatcatgaatcacctgggacgtgacagcatgcaacgataaacaaagaaaaaaaacaacccacatatacactccaagccgtgtttagttgtaaaacttttcttcaaattccaacttttccatcacatcaaaactttcctacacacacaaacttccaacttttccgtcacatcgttccaatttcaaccaaacttccaattttagtgtgaactaaacacagcctccgaattaataaatgcatctcaaaatgaaagcaaaggttagcctgagcgatctaagagtgttcatgtgggacctatattaatcgagatgaaagtgagcattcactgctacagaaatcataatatgtaccggttaggaaccctacataggtgctagatttcccaaccgacctcatagacggtatttgataaggaggactcaaatgtagcagtttaggaactcacacctttaggtatacggtttgaaaaaaaaaagctaactcaactcgaattgagttgagccgatgcttcaaagctaccaaaaataaataaaagaaaacctaataacaaaaaaagagacaagttcacattagagaatcaacaatttcatagatcacataatcaaatattcatcgacaaattcacatcacaaaaattcaaaaaccaaatcaaagaatgcaccaatcacaatggagaactccacctaccaccatcgctcactggagagaggaaggggaagccaccgccactgcacaggggagaatgggaggttatgtggagacgagggagaagccatcgaggggaggcgctgttgaggggaggtgagggaggtgatgttgaggtggacgtcgcctcctcccgctcgctctgccaccgcctcatcgagcccctttcgagccgcgacgctaaatgtgggatgtgggggagagatcgagaaggagagagaaccagctaggtggagaggaggcggccttcggcgcttttggtgctggggagaggcggccggccgccgctcaccggcggactcagagaggagagggcgatgccaatacccccagcggccagcggctagccgctagctcaacacggcaacaacgctgtgcgtgtgcgaccctccccaacaggcggcagcggcagcacgcccttcccctccggttgccctctccaccgtcctgtcccctcctttcccctctcttccggcggtgcagaggtacggcggcgcggcggggcagcgcgcgcggcggcgtggcggccacgcacaggcgcggcaacgccacgccgcagaggcgtggcggcggcgcaccgacgcagcacacaagctgagagcgtctctaagacacacatcgagagaaggattcacaaactctgagaggtatttcttgatctttatttctgtgttcttttatccctaatttccaatctgatgctatccctaattagaacatgatttgaggtgaattgttgtggatcagtggttgaacttgtggtgaattgttttggatcagcggttgaacacttgaacttgaatgattgatgtatcaatatttgtggaatgatggatcatgaaaatatttctgtttttgctgaattttgatgatgttattcagtattcaagtaaagtatcatgttatttttgggctgaatcgatggagttgctactcactgcggggccccgcaggggtcgggggcgggggatgatttccacccgcatgtccactcggggccggggcgggtggagggttcgggggtcgggggcggggctattccagcccgccccgccccgttgccatccctactaataagtcgctctgttttgtatgcgtaggagattagctcccaacacagatagtacactactatagtgtatatagacttgcattggctcgcgactgacatgcagatccacataagttgggccggaataatgggaatcccaactccgtgcgggcccatgttagctgggccgacaggggaacctgacctcggcgctgacccatgtgaattgggccgtaatgcgcgggccaatgtaagttgggctggaatgaaaatcccgcttcatgttaattgggccaaacgggaatcccgcatatgttagttgggccggaacgggatacaaacggatcgaacggcctatgactgcgtgggctgttagagagaccgacgtgtattaggcccaagtattgtgggcccataagaatgttacagagcaagagcatttgggcctgtctttttttcatcttcatattttgtacctgagcatttacgttagtttcatcttcatgtagtttgaaaagatgagatttttacaatggaatcaaattcgtatatatatccattcgttcgcaaaatacctcaagacttaatttataagcttgcaatgtgtgttgtttgtgattacacagctaaaaagaaagagagaagaacaaacaaagaaacggccaaagaaaaggcctgaatcaacaagaagttcctaaaatcaaattaaaaccgaatttctatgcactgaattcatctgaaccaataattcagagcaagccagggcgggagtggaaggggaactggtacatcaagattggagctgatgatgatgatgatccactcttcttcttcctcatctcgaccttctccacaccagcatgatgatcaccatctgatcctcctccaatcttcttctccttctcaccaacttcagcagcatctgcatccttcgacttcgagcagtacagattcttctgctgctgattctgatctacaggttgctgctgctgctgcttcgccggcgacaccttcttcttccccatcatcccagcacccaagcagctcaaacccatcacttactactccaattgatcctcctctcaatcgtatgtatgtacgtgttcgttgttgctcacttgcttgcttgctagttttgctatgatcagattgatctggggcgagctggttttatagctggaggttaggaggaggaagacgacgactgaactgctcaggtggtttcctttcgttgactcagctagctagctgctgctgctgctgccttggtcaccaaggttcttcgtctctactacgcttgcaggctactcatcttctgaattccgagtgagtaaatttcgtggtcaaattggatacaattcgaaagagaaaaggggaagaagcatcgcgtcgcgcgtgtgcaactggacgaaagtggtgatggtgactgaaagtgacaccggggtaattaacacgaggttatcttcaaataccacggattttcccttctttttcttagaagcaccattgttctcatccctccttttcccagaaaaactgctccctcccccctttaaaaaaaatcactcataaaaaacgcatgaaaaacaggtatatatatctctggatccgttgtaatgcacaggcacgtaactagtcagatgtcactgttgttcgtcctcatcttaacagattggtccctgactatagatgtttctaatcaataaatatataaatctcacggtttttgcagttgtggaatttgtacatcttgatccttctagtatttcttaatatcatagacctaataaacctcacagttttgcagttctggaacttttacactgagatccttctggtactcttattatataaataaacattttccattatacagatggatctttttagtgtatttcgtgccacactcagcaaatttctcaacgtcgtcacttgtcagctgcccaaaaaaaaaaagttgaatttacttaatttttaatatctttttgttatagtttgtttttcagtgttgcacatatataaaatatttatctattattttttgtcgcaaataaacgttaattacggtttaatcaccctttgtcagctgccaaaaaaattgaattttgaaacttattttttaatatccttttattatagtttgtttttcggtgttgcacatatataaaatttttatctattattttttttttgtcgcaaattacggtttataatcacccgtaggtgaaatggaggtgcgaaacggtaggagcgaaagcatctggtgctgaggatgttatgcacttgtacttcaatgctttcgttgatgtcgatgagctaaagtttttattagcttaataaaggtccattttagaaataagtttacggacgagtctctgtttgttgaataaaatatgggatggaaccagctgtaaaagttgctgcagtttttctctgaggttgtaggtttggtgtttctcaagctccagttactggcatgcgggccccgctcctgaacgatctatggggccaacaatatcagataatcagaacagcccttaaaccacaactcgagcgcacaaatctctgatgacaaatatcccacatttacatgaacatgtaccaaattcaagccaccatggaattcaaaaacagcacgtttggtggctctgaagtcataagacttaaaaaagttctgaaaagtgaagagggtgacgaactgaaactcgtataaatatatgataatattacgccaaaagatcactgattcttaacaaactctttgcagctacagacactggaattataccgtactattactgattgacaaagc

SEQ ID NO: 57688 - DNA, 6034 bp, Oryza sativa
gattcagaacatataatatatttagcatcttgtcgaattaactgtattaagtggacaatatgctgttttcagatcttacatcatgaacacattcaaatgcttggatcatggcgttgatgttgccagtgcattcaacgctgcggtcaactccgccattggtcatctcagcaagtacctaaattaccataacacactgtatcagtacaatcaagtgatacagattttccttttcctgatgtaagggaacatacatacctgctgaactggcttgtcatggtcctttgggttcacaaattcagtgcaaccaaatttcctagctgaagatatacaaaatatataagatgactttaaaagaccatcaaacaaactgatgatctggtaaatcaagaggattttaccttcttcaaatctgttggcgttcaggtcaatgccaatgatccttgacgctcctgcaatccttgcaccttctgcggcctaatcagacaatatgtagagtaattagatggatctctcattgtaattgagaacattcaaggtgagttcagacactcacagcaaggcctacagctcctagaccaaatatcgccaccgtcgaaccctttggtggctttgccacattgattgtagcaccaagacctacaaaaggaaattgcgactcagcatctcaacttacattctatcaagtaagaagaatgcaagaaacaaaaaaaattctgcttaccagtagaaataccacagctaagaacgcaaactttatcaagtggagctgccgggttgatcttcgcaacgcaaccaacatgcatgacagtgtactcgctgaaggtcgaagtcccgacgaaatggtaaatgggcttcccgttgatggaaaagcgtgatttgccatcaccaatcatcacacccctgtcagtgttgatcctgagcagatcacacatgttgctctctgctgacttgcagtgggcacactccttgcactccccagtgaacacagggagaacatggtcaccaggggcaagatcagtcacaccctctccaacactctccacaatactgcagaaatgaataaatttcagcagatatgaacaataggaatcttttactcaatggaagtgttaaaaaaaataatccacgctgtatttcagaaaatagaaagggtaccatgaatatgttaggtagcataaaggtcaagcaatgcctaatttatatgccctttgtcaactggaaaatacaaacttattgaagagaagtcttctaaagggtcaatcaacgcctatcacaaataaatctgccaacttcaaaaataaactaccaactactaactgaaagaaaaagtttcttccttgtaataagttataaattgataaatctatcaagatccaactgaagacccacaaaaaaagcacacatttataatgtttgacacaggcaacagcatgtgcccatatgattctttcccatgttgtccagattacctcagccaaatgttctactaatgccaagccaataaacaatgaaccccccccctaaactgcaattagaggaagattcaaccacaaagcatagttttaagtacttaacaacatgccacatcagcaaccagagcagtagagtaaaccaagaagtaacaacgagccaattaattaacaacacaacacaccagcaaccagagcagcagagtaaccaagtagtactaacaaagaatcaattaattaacaacaggccacactagcaaccacaacagtggagtaaccaggtagtaacaacaaatcaattaactaacagcatgccacatcacacatcagcaacaaaagcatgcatcagagcaaccaagtattaacaagaaacaaaatcaaggaagaagatgcataaaagcacataccctccagcttcatggccgaagatccgagggaacacgggagtctgtccctaagagattcagaagccacacaagaggcgcaagtcaaccacacattggagcagctatggatggataggaactgaagaagaggaggtgagtagataccttggcctcccagaagtagacgtcggtgtggcagagcgaggtgaagaggatcttgacgcgcacctccatggcctgcggcggcgccacctccacctcctcgatcaccagcggcttcgcggcctcccatgccaccgccgctgcacagatccagcaaaatcacccaccaatccaccaaaaaaacataatcctgaatgacatttttcactaaaaaaaaagatatgcttttctccacagcttctgcaagatcggtaatgttcacccaagaaaactctaaaaagaacacaatccaagaatttcatctacagcgccgctccagtaataaaatgcctaaaagttcgcccaatccaaagcaaaatcgaaccaagaagaaacagggaagggaggaaaagcactgacctttgcacttgatcaccttccctgcggtcgccattactctcctccccacaaaatcccgcacaaaccaccaaaccaaaccaaaccaaaatccctcctccaaagaatctcactcactcactcaaatcacacagatcaaatcaaaaccggtgaggaggctagatgaaccatccccgtctatatatagctcctcctcctcgaaggaagaaaggagaggatggaggatggagggtgaggtttcgccacttccttcttcttgtcttcttgggtagcaaaccacggacggagtggggcggcgtggcacacaaaccgggcctcctccccctccacctggaagcggaattgcagccgctgttttcgcctcccccgacgccgatggtgagtggccgtcggatgcgcgacggccggcgagatctgcggctgggagctgtcggcgctgggttgcaccacgcgtggattattaggaaagtaaattgattttagttagggcgtggttagggccagtccataacattatacatgatttttataaactctaaattatcaagacactactctttcaatttaaacccaactattccatatttcaatttaatgctatttatctcacatgatgttttggatgttgtgtaaaaaccggttttcttctctttcctcatttatttacttgtcacatcattttttagatgacgacttatttaatgatatgtacattatcctagtcattgggtttagaatacacttaccactacctccgtccagaaagaagaaagaacgtagctttgtactgtttatatgccacgtcttattattcgtttaaaatttcatttatatttcaattattattagatgataaaatatgtagtattttgtgtgtaactaattccttacatctatctatctatctattatattattaaaacagctttgaaaggaggcaccacgttcgctgtgggggctagaaattctcacattaatcggagaaaaagaaaaaaaaagaaaaggagagtccaagtataaatacaatataaaaatagctaaaattcggaattaaaaataagcaatattgaaaaaaatttccatataagtacccaatacgagaataatcaaaattcgaaataaaaactattatattattaaaacaactttgaaaggaggcatcacgttcgctgtgggggctagaaattctcacattaatcggagaaaaagaaaaaaagaaaaggagagtccaagtataaatacaatataaaaatagctaaaattcggaattaaaaataagcaatattgaaagaagtttccatataagtacccaatacgagaataatcaaaattcgaaataaaaataaaaaaatccaaaattataaaaataaaaggataatcaagtaggaatacaatttaaaaatagctgaaattcggaattaaaaataagaaatattaaaagaagagtccatataagaacccaatacgagattaatcaaaattcaaaataaaaataaagtgacatctaaaattagaaaagaaaatgagagttttaagtagaaatacaatttaaaaatagctgaaattcggaattaaaaataagcaatattgaaagaagtttccatacaagaacccaatacgagattaatcaaaagtcgaaataaaaataaaataaatctaaaattagaaaaataaaatgatagtccaagtaggaatgcaattttaaaatagcagaaattcggaattaaaaataaaaaatattaaaagaagagtccatatagaacccaatatgagattaattaaaattcgaaatataaataaaaataaagtccgaaattagaaaaaaaaagaagagttcaagtaggaatacaatttaaaattagctaaaattcggaattgaaaataagcaatattgaaagaagaattcatataagaatccaatacgagattaattaaaattcagaataaaaaataaaataatattcaaaattagaaaaaactaaaagagagttcaagtagaaataaaattttgaaacaactgaaattgaaaataaaaatattaaaagaacacaatacggtattaattaaaatttggaaaaaatgaaattataaaaagaaaaataagatttcaattaggaatataatttataaataactcaaatttgtgataaaaataacgactattgagagaaaataccatctagaatacatgaccagataaattaagtcacatgcttataaaggagtagagtggcggcggttgatacgacatataaaaactgttaataaaacaccaaataaaatcctaatgacaattaaaaggagggacgacaggcatgccgtaaaacaaaaaagcaagggagttgccatgacttctataaagttaaaaaaaaccattgataatcaatgacaataaaaagaagaaggagcgggcggggtgtataggagtatagttgacgggtcttctagaaaataaaaaatgaatttcaacgatagttatgttcgatttttagaatcacaatgacaataaagagtaggcggcaaacgggctatagaggagcatagtgatatcgtttgacgggacttctaaaaattaaaaaaatggaacccaacaaaacaataaactctaaaagctacatggtctaatttttaaaggttcgaaacttctaaaaagtaaaaaaagaagggagagagtgggcgagccgtagaggagtacaatggcaaagccgctgacggtttggcgaaacttcttgaaaagtaggaagtaaaaataaacccaaacaataattatgttcgaattttaaatctcaatgacaataaagagaagagacggtggacgggccgtagaagagtacaatggcaacgtttgacgagacatatagaaattataaaaaccgaaacccaacgtgactataaactttaaaaactataagatctaatttttaaaagttacaagaagaatgaatagaaatagcggtagatcaagcaagtaaataaagaaggagatggcataaggggtagtagctggtgtgacttttaaatactatataattaaaaacacagggatgataatgtcacgcccagaaatttagcccaaatttccagactattttgtgtattaaatccctgtccaggaccagccagggtacacaaaacgacaagtaatatacagttccaaacgtaaataaagcgtaaaatacttacagaaaaggcacttagtcctcacaccgaaacaaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgcattgggtcgatttattaagatgggactaatcacggtgaatct

SEQ ID NO: 57689 - DNA, 12009 bp, Oryza sativa
ggccttgggtccacctgtcggcgagggcagaaggaagaaggctgggggttatgtggacttggagaagggggagccgagctgggccgacccacgcgaagaaaggagggaaggagggaagggagaatgggccgagcccaaagacaaagaggggaagtttattttgttttctttttatttaaattagtttaatgaactttgtgactttaaaactatttctcgagctccgaaaattcacggaaaattccggagagtacattagggcacaaagaatattacaaaatattcccggccattgatttttaagggaaaattttaattctcccattatttcacttgattaaattgatttaacttttatttaatttctagaaaatgcattatttaatgatttttaatcccgaacgaaaatcggggcgttacaaatctaccccccttacaggaatctcgtcccgagattctgggatggctagaaagaaagccggtgctggtcagcggtctgactgatctgcacattgaactgccacattctgcttcgaactgattgattgactggttgatcaaacctgcacgattgcactggctggattcgacctttctgttcctttgctttgccaaaactggaccgactggttctgcttgaactgacctaggccagaactgcggatactcctgaaacttacttatcttggactgaactgttgaggttggcaattttggtaacctgagaattcaccacgctggctataagaggatgaaaatggaatctggcatttataaatcatttaccctatgtccgcttcgactggtcccaattcaaataacaagtaattccaggaaaacctgcttgacctgtcttttgtctgaactgcaaccgtctgcttgacctgtctaagctaagcggttgaactggcctcatgggtgtaccttagaattcaatcggttgctcggggatcggcttaattcttctgataccttgcaacatacttcttcaagtgctaccctgattgcggcactggttgaaccttcaactaaaacagcgacgaagtgaggcaaaactcttccccgagacctaccccccttacagggagtagtcttacttccgcatggctgggatcagttgaactgttgtccttcaaatatagccaacacttctctgatttacaaagagccctgactttgaaaactgaaaacttcatcggtccatcaaattgaagcaatggcgatgcactttcaccccgacaagatttggaacttaacccttagttgatgataggaaattccacataaaagaaattctcatttagctcctgatcttactaactcttaactgactttcccatcagtactaactgctggcatgactgtccttcttctgacctgacttcggtgtcgtccacctaaatgggttgtgtagttgatatctcaaaactaaactgaccgactcgcattggaattgacacaacttgaggaactggggtgctgcgaatagagctgttgtcttgatgacgctaacgccttgccgttgaacaaccttgcaagaactgaccttgtaaaccataaccactataggtagcacttgttattcctgggattggtggtggcttagctgtgctgatttgctgaggacttagtggcgtactatctgaggttgtgggtgcttcctctttgaaaacaaactagctttggctctgatcctaattccagcttgcatctgagcttgtacttgttgttggagacattgtcgttgcatctgctgctttggactctgcggttgcggtatcaacatctgacacatccatcattagatcttggctagccaggatctgaccagagcgaggtgctccgactcagctggtagcttgttgtcttgaactgatccactgactctgactgcaacacactactgctagagttgcttccgctacattcgaccttgcatcgagctttgcatctcctgcatcaatacacccatcttctgatcttggacaccaaaagttgatcatgagcagggttcatctggcgttggggcaccttgcagctttcaactaaaccattgatctgtggctttaattgatcttatctctgacactgaccatctgctgctaggacggaagagaggtggaagagaggggtcgctaaagataaggtactaaaccacttgcctactgatctgttgtgagtacacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaacttcacttgatcttcgcagaacgacgactctgaactgatcttctcgctccttgcacgaagcttgaggctcgaattgacttgacttccgaacagacatgaagctgacagctggtcctctaggtgtgacaactacaagaattggagagactgggaggagaattttgaaaaaccgtttgacaaagaaatgccgaagggcgagaggagacaatttgcaaatagggttttcagaaaacttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaaaaggcacttagtcctcacaccgaaacaaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgcattgggtcgatttattaagatgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaattgccatgggtgcgaccagcaaaaccatgcacccacagcccaccattcagttgcattttagttggataattacgaccatgaagcatggccagatgtctcgagcacgcagctcaacaagatactagaatgtctaatactgcaattatcccatcaactgagctagtggtaattaagcatggctaagcatatagttctagctaggtcacataagtaacatgagctagtcgattcattacccaaggttgccaaagaatagatatcaagtaaacatggcacaagcgagcagataggtaaaccctgatcccgtgtaattagcaaaacatgcatatttatttgcaaacggtaaaacatttgtaaattaggatcaacatgctcaaagggaatgtgtgacttgccttgcttcttcactttgatcttccgaactcttttcctcgcgaccgcggacttccgaaacgacggaaactacacgctggcacgcaaaacgaggaaaaactctaataaagaccaagaaaacagtacataaaaactaaacaaacatgtagagctcaattttagatgaattttgcaagttgaatggctcaattcggagttcgaatgaattagatatgaattttagaagttttgagccatttaaatgaatttctagaattaaactcgatttattgcgcaattattaattatttttacaaaggaaaaggatctcgctgacgtcagcaaggggcggccggcaagcgggccccactggcagcggctctataggggaaaggagagggaggggtggtccaccggctggtgggccccaccgggcagtggctcaaggggaggcgagggaggcgccggccgggctcggctcggcctcaaagccgaccggcggccatggcgaccggcggcggcacgcgcggtcaccggcggtgaccggcagcgcgggagacggcggcggccggcgcgaaagcggcggcggcggccgaagacgacggcgcacgcgcggaggacggcggcgctcatgggagagagaggaaaggaaggaggagaggggattcctcaccggcgaacacggcggccggcgcgaagggagaaaacggcggcgacgaccggtgatgccgaggcgcgaacgggcggcggcggcaccctaggagagagcatagaggggttagggaagggaaggcgaccatggcggcttgaattgccggccggagacggaggggagagagggtctcaccggcgcgcgaggagaaaaaaaggctccggcggtgattcgcggcaatgaagcggcggccgaggtgcgggcgggctcggtgagcgcgacggcggcgatggtgcggcgcggcggcgcgacgcggccgactgaaggcggtgtgtggcggtagtggctcggcctcgcgatgggaaggtggttccggcggtggaggagggagatggagtgggggccggggtagagcaaggcgtggcgatgctagcggcggcggcggcgcgacgcggcggtggctagggcggagaggagcgacggccggagctcaccggaaagcggcggcgcccgggctcgcggtgcggacgcgatttgtggcacgggagagctcggggaaattggggaaaagagagaagggagctcgtggatgctttttatagaccgagggagcgacggcgaagccggggagcggcggatttcgaggggaagtggggcggcgtcgtgggggagagagagacgcgggaggcggcgacgtggccggattttgcggggagagtgggggaacggcgcggacgtgagcggcgaggtcccacggacgagcgcgcgcgcggggtggaggaggtgggcggaatcggcggcgacgtggggagaccgtggcggcggtttcggctgagggagccggaggttagggatggccctgacaggtggggcccacctgtcggcggctcgggggaaaggagagaggaggagacggttgggggggcgatgacaggtggggcctcgggtccacctgtcggcgaggggaggagggaggaggctgggggttatgtggacttggaggagggggagccgagctgggccgacccacgcgaagaaaggagggaaggagggaagggagaatgggccgagcccaaagacaaagaggggaagtttattttgttttctttttatttaaattagtttaatgaactttgtgactttaaaactatttctcgagctccgaaaattcacggaaaattccggagagtacattagggcacaaagaatattacaaaatattcccggccattgatttttaagggaaaattttaattctcccattatttcacttgattaaattgatttaacttttatttaatttctagaaaatgcattatttaatgatttttaatcccgaacgaaaatcggggcgttacagataaggtttggtctttcgaagtcttaagacaatgagatagctatttaataaattttaagtaaaatcatagtaaaaagtatatgttttgtttaggtgctagccacgcaattgcgcgggccacttagctagtttcttaaataatacggatggttaaacattgcacgaagaaattacagctgcatttaaattaggacgaaggtactaggccgcgttcgatagcgtgagattgaggggattgggtgaaagcagcactgtagtccaccgaataatttactccatcgtgaaatgcagtccagactgtccagtgacaggtgttagacagcagtagacggcgccgtttgctactgcacagatgccattcatttgggcttaggtagctgtagcgtctatttttttctacttgcaagatgatagatattttttgctgtctcaaatagtagttacagcgttctattaaaagtagtgacgacaaatgcagaaaaaaaaatattgcaattcgacatatgggaaaaaaattgttggaaaaataaaatatactccatccgttttttaatagatgacgccgttgactttttctcatatgtttgaccattcgtcttatttaaaaaatttacataattataatttattttgtgatgagttgttatatcactcataatactttaagtgtgatttatatcttatacatttgcataaaatttttgaataagatgaatagttaaacatgtgagaaaaagtcaacggcgtcatctattaaaaaacggaggtagtagcaatttgagcaacgtaatgaaaaaaattattgaatacgagttggcacagtccaaagacttgaatgcagtacataatacatatatccatcacgaaatggatttcttattaaatcgtacatctaataaaaagctcgtacactgtacaggagatagttcatgtacttctacaggttctccaccgaattggcaatggcatcacggtatgcgttcatcgcttgtgcgctattgccggcgtaatacatattggagaaggggggtgccattggtgctataggattaccattatacagagggttattggcctggaagtcattttgcttgctgtcgattcggaagttgtgcaaacaaaacgctgccaatattatgttgctctggacattcttgtatgggttgtacggtatgccttttaagattttccactgttttttcacaattccaaattgcctctcaattatattacgcagcttggcatgtatgtagttgaacttctcttcccttccttctggcggtggagcgcgtggccccttgaattgatccttgtggtaccgtacacgtgggtacggtgccaggaagcccatcctactcggatatccggagtcaacaagaagatattttcctacaaaataataagttatacatgaaaactatcagtgcacaattaatgaagtgctatatggtgtacaaatgtagtacttacgaaaaggtagtcttggaaactcctctggatatgagtcaatagcttcgtttaggactcgattgtcatgcactgatcctggccatccggcatcggcaaatataactctaccatcgaatccaacaattgttaggacattttttgttgtctcgtcatggcgattcatgtgttctatggcactatccacaccaacagtgaccggaatgtgtgtgccgtcaatagcacctacagcaaactggaatggtccaaaacgactatcttgtagtaggcgacgagggatgtccgtaaaattcagatcaattggcttgagtattttcgaccctaacataaccattcggctaagaacccttcgaaaatagatagacaccgtcgagttcgaccggacccaacgattgttcgactcccttgcagaattatttcctgccattgtgaacaagaagattcctagtgcctccaaagaacttacatcattactcccatgcaggttgtaaggggcattttccataatttccatgtagagtgtatatctgatattccgttaaacggaaaatcgcacggcactgtgcaggattcgccattgtctctagcatccaagttattccaaattgggttgggacacgacgaggagctcttggaggagcagctaaaatctcttgcatcattgcaataatagcgtcatcctcatcgctcgtgtattgcccttcagtaccatccgaactccacgatgaaccgtcgctcattgtgtgattccttcgaaacaagaaaaatatatagcttacattaaccattacaacattatttgtaaaaaaatgcacgcatggtgttcaataaaaaaattaactgcataaaaaatttcacagtgacataccacaagtaccagttcagactacaagcattagaaatgagtaaagcagatgctaaaatcctactgcaaacagtatggtgagcattattttttatgcctctcatatgaatctcctcctctcagtgagctccaggcaactgaccaagcaagagcaactcaatagaacccattaccatctacgctaccaggacccccacctccaccagggccacccccctaccaacctccaaaccctgtatgacctcctgaacaagttggcgggggtactcctccaccataaccctgctggccagttggcgggggtgctcctacaccataacgctgctgcccagttcctccttcgtatccaggctgtccacctccttggccaccagctccttttccgccaaattgcttttgccatgtctgtactatgtaatgggaccgtgactcgggtgtagggcagtaatcaatgaaccattgacgccaataagcacgctcaaatacatccagtgccataaagaataaatcactccctgggttatgtccatcagctaccaccaactggatgcaagctgctgcacttctagccctgtcctcttccaccttccgggaacggctctccatcgactgcactcgcaaatcagctagccggtgcagggcatcaccggctgagtcacttcgactcttctttgaagccgatccactcgaagtgccagcttcatctgctggcctcttgcctttttctgcacttgaaactcctggagtcgcaatgttttgttgttgagctagcagctgtgagatattgatgttgggccttggagttggctgctgaggaggtgctggtgctgcgcctgcaacagcagagtggttccctaccactgtgcgccccgaaaaaatagcacagtgaaggtcgatgtgcttgagaggggaatctttgaagacacgagctccgtcctttttctgcgaaaatggttgagtaataaaataaatttacattgaaatgaacataagtagtttcttaaatcgattttcatttttgcattttgttgacgctttttgaactaaaaaaaagacagcagcatacaagtacataactaatgtacgcagcaacatagctattattggtggcaccatgttttaacatctgcagactgcaggtaacattttacctagattttacggtctaactaattcaagaaaatggaggaagtactatatgatattgatatgcattgacaataatagcagatgatgagcagactaaaaatcaaaaaactttatgccatgtaagcaatgtgacatgtcacatagaggttgatgtcatgtcaaactatggcatcaacaatagcataggaataccaaatatctcaagatatggctcagttttgttgaaaagacctacaagagaataataaaaatagtaccaaccatgcatttgctgcttcctaatcaatttattggaaggtagtgaatgcagcagagaaattgtacccccattcattatagcaaaaaaattacattctgattttgtatcctagaaacacaaggttttacaaaggtacataacactttctatgaacaatatgtatgattatacctaaaaatagataactgtggagatttcatgaactaaacaaatgtcatgggtccttgtgttaatgcaaatcagtatggaaatcactatcttcctagttcgaccgaacacaacataagggtaggtgacatacctggtccttgtcttcccaccaatcgtcgtcagcaacaatggcttgagttatcgggtcacggccaatgccggtagcctttgattccagccacgtccaaagcatccaccttttacgacattgacgccatatgtacttcacctgatccttggtgaggtttcttccgattctctccttcatcttctgtatgaggttcttgtagccttgcggctttggacaagtggatgttatggtcattgcggacaactcctccaagcatgcctcaagaaatatgccaatttcatcgtcgctccatcggattttaccctccgccatctaccacccaatgttaacaaagcacaaatgcaatggatcaaaaacaaattacaatgggcattaccttttgtggcgagatgggccggatcaggtccaaatcgagggaccgaacaaccgtcgccggcgacacacgacggacgaaagagcgaacgccttctggggaggtcgcacaaacggctgttaggaagcgggcggccacattgatgtcattgtcacaaggaggggcagagctggcgtcagatttgccagaggcgctcgaccccgtccccgaatccagattgatgacagtccgtgaggagccggtgcggcgaacgccaaaggcacagcctgccccttggctgcagtcgacggatggatgtcctcccctctctttcgctttgttcccctggtgcccattgtccacccggagaaggaggcctcaaataggaggccggaggcgagaagatagcttccaactctgccgaatcttgacgacactgtgacacccgagagcgctccaccgagtacagccgcatgcggccaaagctgcagtgcctgatgagcagctaggtgacgcagacaacaccggcagcgctccccgacttccgcctggcttgatggcagctccgccagagaatcccctttctccggcctcgattcgccttttcagcagctcccgtgacgagtggtcgatttctccgcgtgcctaacagccccaggctgaccacgacgaccaccggacgacgctcagcagtagggcacaacgattccagccacggcaaccgcgcgtggagccgtcgacgaccgagaaaatttggcgaaggaagaaggggatcgatgggagagagagagagcgagcacggctgcttgcgctggtggtgggttggggacggatgggccgacgaatcgatccatccaaatgccgtctgtgccgtttgtacaggtgccacgtttagtcaccaacgccatttaatatgcagtaaattattcagacatgtacagtgctgaacagtgcacaattcaccaaatcccctcgatctctcgctatcgaacgcggcctaagactaccaggaagagtgtgatgactgatgagaaggcaggacagctcatggggtcaactggtgattgctgtgatgcggcgcatgtgtgatgagtggcgaaaagaaaaagggatttggtgtgccaggctgccagcgtgtgtgcttgtgtgtgaagaagatgacgattttggtcgttcggttttgaataacgaaggcactaatatcactgtatcagtggtttgacaaatagaagtagattcgctagatgaatggtgaagaaatgatgatctacatgccgtcttttttcaccgttaattcatcgacgtcacgattttgtgcgatcgtggtctcgttcacggtgtcttaagatttaggctctttcgtgatgcaggagttttacctaatttcctaggagttcgtttagcgttccatccgttgttaagtataaatatttttaggttatttaataaatactaagattagatcaaaatgtttttaagtccttttaggttgtcaattatttatactattcgctctcgaagcatctgatttggtttcgaaatattaaaatgatgagaattagtataaaaatgcttatattatgttactccctccgttttttaatagatgac

SEQ ID NO: 57690 - DNA, 3276 bp, Oryza sativa
gtcatctattaaaaaacagaggtagtataaaatttaaatcctataaatacttacattttgaaataaattaagtatttagttagagaggtaagacacgcatacatacaccaccacttggaacgcacacatagcacactcaaatggtttactcagagttgcggctgcgctacatccaataggaacattgccacaagcataggcggatctaggagtggtccagtggtctcgatatgtgcctaagagcaggtccaatagcatgctataagccagttataaacatattttaaagagataaaggaaaagagagaagagcggcgggctaggactataagacgtactgtgcgtataacatgtaggaccaggtattaatagtatagtaagcaactattatatgaattggctattatgctggctatggatgatttgaagctagtagttggctatactattaaacttgctctactagcttcaattcatctatagctaatctaatagctcattcatacaatagttacatactacacttttaagagcaggtacaatagcaggctataagccagctataaacatattttaagaagataaatgaggtgagaaaagagcagctggctataaagatttgtagccagctgtagcacggactccaagacgcagtgtgtgcatgataggtgggaccatgtattaatagtgtagtatgtaactattgtatgaacaagctactagattggctataaatgaattagagttagtagttggctgaactattaaacttgctctaatacatggtcccacttaacatacacacagcgcgtcttaaagtccgtgctacagctggctacaaatctatagtccactgctcttctctctttttatttatctccttaaaatatgtttgcagctagcttatagcctgctattgtaccttctcaaatagcgccaaagcacgctaactagggctgtgtttagatccaaaatttggatccaaacttcagtccttttccatcacatcaacctgtcatacacacataacttttcagtcacatcatctccaatttcaaccaaaatccaaactttggatccaactaaacacacagcctaggtatgtgccacgcaaacatgcagcacataaatgggaacgaaatactctgtccatgactataaacttaaaatcagctctgattgattgagctacacaatcgataagccgtagaagaaaaaagtgaagcaaaaacaatttgttgtaaaattttatatgtatatcattctgatatagaaaatagacaagaaaaatagataatcaactataaaacaagtttaaaagtctaaattttgttggaagcataagccaacaagcttgatgactttgttggcttatttgttttttaaataaaatctctacttatacttttacgtatttatactaaaattttaaataatatgaacaatcaaacattataaaaaaatcaacattaactcatattttagaacggatggagtaccatactagtccaggctgtgttcggcagggagggttaggaattctccctccaaacacgcaaaacaaagtggttaattagcatgtaattaatttagtataagctattttttaaaaaaaatggattaatatgattttttaaagaaacattcgtatagaattttttttttaaaaaaacgttcagtttagcaactagcagtttattaggaaacgtggagttgggaactgaagctccagggagactctacaaccaacccatatacgaatactacaaacaagattgggacagggcacctggccaaagctgctggagtgtggagcacgcgcatgcatgccgagtggcgtcctttttccccaaccccaaccacgcgctcttgctgccgcctgccgccgcgcgcccacagcttcttccgctcatccaccagtagcgatcaccgcatcagaacaaaaccgaggaagatccaaagattcagacggaacggagttacggaccccgcgatctgattccaacgcttcagaaacccgcttgctgctcggtcaacatccagcggcagcagggcagcaccaaagaaaacatcacgatcgaaagaacaagaaaaccatcacaatcctggccaaggctcgcaggcgcgacgaaaaccgattgaaattcgcagctttcgacctacggttttttttttttgctatttcaattatcagatatttacatagatttttttgacttccatcttactctctccttgcacatgttacttttgtcatcaagactaatgaaattaaatcatcttacatgcaacaaagattaagaagtgaatgcaaccaataagtatttagatgactccttaggttttattcaaacatttaatttatctcttcgtttatgttatgaaatatttgggtgatctcatccatctatatggatagagcagcaataaatctaggacaggtcgtgccccacacctcttctcgcctcacggcgattctaacaacggacgcgatggttcccaaaccatcgcgtcttctattaccgcctctctccccctatatattgtaaccattgttatcaataaaggatcgctcattcattctctacattcttgtgtgcaattctctctctcactcaatctctctcgctcaatcaattctattcacaacacgttatcagcactttcgctctcgcgaaggagatcgcgaagtgaaaggaagaaacatcgcttttgatctaacagaaaagcgaacagaagaatcaacaaagaaggtacgatgcctacctttcattggatcatggatgtcgttctcggcctccctcgccatcagcgcgcacgcaggcttcaccatcttcttcgtcgatcgatgaggagggcgcgccggggatcccgcggaggcagggctagggttggtggccgccgccattaccctcgtcgtgtgcctgcaactccggttgtggcccccccgcccgtccctgtcgcacctcctcctccgcctttggttgaggaagcacctcgtcggatccttgtgcaaggggtacagtacggtgcccaccatggatgggagatggcggtggaggcgaatggcggcggcggagaaggtggaggtggcggtgcaattggtggcgctccacggcggcggttggcgacgtcggcgcccccacagcgacgcccccacggcgacgccccacggcttccccatggcggcgtcggcggtttccccacggcggtgtcggcggcggcgaactggcggcggtcggcggcggttggcggcgaaatggcggcggtgagcag

SEQ ID NO: 57691 - DNA, 3771 bp, Oryza sativa
accacccaatttattgtttaaatttagtttttatttttattttcagcagcaattaccctttagtccctatattttatgtaatttagtcgaaacagttcatcagttgtataaacaattatgtaatgatcctatagaccactgatgttatgtgtttattaacataggtgtttatttaaataccctgtttcactaaatttatttgttgtcttaataacatgccttttgcatattatttcaagacacgctctactttctcgctttattaatttacaaaattctataaattttgtattttgatttagcaaattccattaattatgtccaacataattaatggaggatttaatgcatgttccacttcatactttgacttggaaattaattacatgtcgatggagtcctatactttggtcatatcgaccataacttaggcagcgagtatctcgcccatcataaagtggtctacattttgagatgattacctgatggagtcctagaaattggccgcactggtcataacttaggcagcgagcacctcgcccatctcacagaggtctacatctcacgatgattacccacatgtgttcttttccaagaatatgttttgagaaatgagattgtttgaaatttggttgaacacaaggtagtggagtcctaaacaatggctgcggtatattcatcagaatatatttgcctggagaccgtgttttaggcagcaagtataccttgcccactattaagagatctactccactgtttaattacttggagattagccacattgtgccacctaatttcgaattctaactcaaaattgtcaggtccataacctacatctttcgaaacattacagaatatgaagttttacatttcgcattgagatttcaaccttaatatcatgtttttattaatttacctctgtaaattgataatgttaaccatgattgtagggacatggcaacaaaagagttcgacgaactcgccctcgatgggactaactatcccatctgggcttctgatatcaaaatcaattttgcctctcgggggattctaaatacaattgaggaacctaatgatggggatccagcaattgagcccaggaagctcaatatagccctttttcttttgagactctacattcacaaggatctcaaacatgaatacatgttagagacgagccctctcaacctttggaaagctctaaaagagtgttatgatcagcaaaaggaactcatttagcctgaggctaattataagtgggttcatttacgcctacaggattttaaaactgtggcaggatacaaccatgttgttcataacatttgttccaggttgaagttttgcgaacaagagccaacgaaggcagaaaagatagagaaaactctatcaactatgcttccggaggacacgatactgactcaacagtatcgcgctaacaatttccagaaacattctctgcttatacatacattgactcaggcagaaagacaccatgagctttctttaaagaatgcccaacagcgcccaccgggctctgctccactgcctgaggtgcacttcaatgtacagaataatgctgagaataagaaaggattcaagggaaattcttcgaataatcctaagaatctgactggaaagcgcaaacgcaacaacaacaggcgcaaattcaagggtcgaaagaaaggaaaagggaagggtaaggcaccacaacctcgtagcaatggcaacaagcattgcaacaggtgtggatctgacactcatgtcgctaaagactgccgcatcccgaaacatctcgtcctcttgtaccaaaaatccctcaaggacaaaaaaatcttctgagaacccaagatttgaagcccacttcaatcttacacatgaagagcgccctgaggttgcaagttctcaccaggctcctgctgaaccagagagcaacctcaatgttctcccagaagatgtcgctccactctctacgatggacggtatgttcatcgaatactgctcaacggaccaacttggagatttgcaatgatctcggtgcgtcctacttggagatgaagctgcccttatctcagtgtgcttgaaacagtatattgatatcctataagtttgccaaataatattggttgtaataagtagataagtacgaactcccttgtattgtaaggttgtatggcttgctagtcattagagtatgtactattaacatatgtatttgatgttttaattattgtatgtatgtatatatattggataaagaattcttaatcatgcaattcttctttcattatagatgtctaaggatatcgctccgattgtagaggaattatgtcttgtggacagtggtaccacaaactctatacttagggagatcaaatactttcaaactctcaaaaagagagaaggcaaagttttgactatcgctgggcgcgatactgtgatagttggctcaggaagagcaaatattacactcccaatgggtacacaaattacaatcgaggatgctttattttatcctgattcaacccgtaccctattaagttatagagatatccgtcaaaatgggttccatattgaaacccatatggataatcgagaagaatttcttctcttaaccaaacaaaacggatatggcaaacgcatttgcgagaaaattccatctctcacatcgggattgtgactatacatacattaagcccattgcacatgttgcatacaaagtaatttttcaaaatgttgatgcattccacacttgtcatgatcgacttgggcaccctggtatcgggatgatgagaaaaattattggcaactctattgatcatcatttgatcactgacaaatttcccaaatcctctgatttcgtatgcactgcatgtgctactgggaaactgattttgaaaccatcttatctcaaaatcagagccgaaccacttaaattccttgaacgcattcaaggagatatctgtggccctattgtgccaatatctggaccgttcaggtactttatggttttgattgacgcatctactagatggtctcatgtgtgtcttctatcgacacgaaaccatgcctttgccaaattgatgtcacaaattataaggctgaaggtaaattaccctgaacataggattcaatcaatccgtatggacaacgctgccgaatttacatctcatgctttcgatgattattgtatggcattgggaattcaggttcagcactctgttccatatgtccacacacaaaatggtttggctgaatcattgatcaaaagaattaagcttattgctcgaccattattgatgaattgcaaattaccttcgtcgtgttggggtcatgcagttctgcacgctgctgaccttgtccaactacgaccaactgcatatcatgaaacttctccaatgtagttagtacgtggaaatcctccaagtatttcccatttgcgtaagttcggttgtgctgtatacataccgatttcaccaccacagcgtaccgctatgggcccacacaggaaagtggggatctatgtgggattcaaatctccgtcgatcataaagtatttagaacccttaacaggtgatctatttactgcccggttcgctgactctatctttgatgaggaacatttcccggcattacggggagacttcaagtaccagaaagaatgctaggaaattgattgggatgcccagggtattccagcctcagacccacgtactactgaagctgaacttcaagttcagaaaattatacatttgcaaagacttgcaaataacc

SEQ ID NO: 57692 - DNA, 8079 bp, Oryza sativa
ctgcaccttgacttcctctatggcaattgtacttggaacgcggcgatggtccttcttccgcgttggttcattgtcatcaacatcatccatgttaactcctggaaccgcagataaagtaacctttacccactcaataggctgatcagcaattggttgggaatctcctgaaggctcatttgaatctgctgtagattgtcgtgacctatgtcccgaatcagaaattgcaacactccttgaacgaccaagtttctcaaccgagaaactaacgtttacaaattttactttggcctcccacaattgagccatagcttggtcaataacctgagaggtagacttcagcattctgtctgtttcataattttgtgtttcatgccgactccacaaaggatatgcccatggaggtggctttggcaactgcacatctccattagccaagggtatcccaccttttgacaatttgttaacatctgatgaccctttggagtgactacaaaaaggaaagaactgagtttacagaatgaattctgacttaagatccaataataaataaaggtaatgaagatcatcagttctgccatttagcaggcatatggtacttttagacaagtatataagaaaacaccacaaacaaaaacaacaggagttttaccataaatttcatcaagattgtagtattgtacaaagaactgcataccttggtgcttctgctttcaaaacttcaacacatataagataaggagctttttccctggagttaagaagaacagcttcatcttcaggtatatgaaccactcgatatatgccctttcccatcggaaagcatactcctgtgcaaaaagaaggcagacgaaaagaatttcaggggacatttagctactgcgttcatcttcagtgattgatgcttaatccaaaaggtagcatatgttttattttcttaagattaactggtactttctttgttactagagataaaacaaagaaaagacagaacaagacagtctttttagatgcatgacaatgcatagtgtacagttttgctacctagatttcaatatagtcaaaaccagataacagtttaccagcttcagcaaatggagtgaaagataggcagcggcactacataaagaacataaagtggagaaagcagcccatgcaacaaaactacaaaagaacaagtcagctcattaaactacacaggtgattttgctcaattatttggtcatcattgggccatttttcgttgcacaacaaccaaaatgaacaagggtggccatagaacattcaaatctaattccaaaagggatattttaacttgtgagcaagaaatatttatcagtaaaggaaggtggccagagctcaaactgcagccagaaaaaaataatggaacagtaaagcataggccatctgggatatgtctaactgtcaactcaagtagcttccatctaatgattataatgtgatgttagagttgcagcaccaagatttgatgctgaaaggctatgtgtaagaacataggaagacaatgaaatacagtgatatccacaggatagcagaaactacctccatttttctcagtagaagcaatctgtgaattgatctctgtaagagactgacacgggaaaagagaacccaatgggataaattagaatagtgtaactattataaaacaaaaaatataaaatatgaccgaaaggggtgaagcaatttagcatacctctcgaagggcaatcttacgatcttccataggaaatatgtctacaaggccataagatgtatcacacaaagattgcacaagctccaatgaagcatagtaacatcctttccgaagctctgctattgcgttgtttggtaaaggtggtttgccactttgcttatcaccgtttccagtgggaacagagtttttctgaaaaacatacagcttcagttaaggtcttagcagtcataaaaagaaggcacaagacaaaaggtatacaagcagtgtaatcagagcagcagatgctattgttatcagacctagaacccgtcaaactaaatgtgctttcaggacatctacaccataaaactgagcaattggctagataatatgtattaatacataggaaatacatacatgcaattgcaatggaaggaaatttgaattaaagggtgaaccaacaacgatctatacaagacagcccatatatgatgttagcttctttaccaaaatgatagactagtagtggtgttgtagaatcctcttttttcttttacaggtgaagggaaaacaaaataggaacatacttgtcataactgtttaagaaattcacacctaagctccaccacgtaaaacactacatgttgtacattgcactaataagtaataagtcatgaataaatagtgttgataactatccataaaatgccacacctaagtaataagtatatgattctgctgaaaccagaaacggtgagtactcaatatggcgatgcatggtagtactaatatgcacaagcctaaagttcggaagaaaaaaagaacaacttcagggaactgatgtcttgcctctttcaataactttgaaccaaaaagctcagagtcttcaagtgagcgatctctgtctcggaatagtcgcttgaaaaagctctctgatcctgggctaccctcagaaataccgttaggctgacaactttcaatatgcccactcttagcatcttcagggtgcactctaaacaacctgcggaacgacaaaaactctgaattttcctcgtcatcaataccactagtccccttaccatcatcatcatgtttatccagcccatcgcttctcctctcctcatgcttgtctttaaacaatttgcggaagaaattttccttatcaccttcctcacacttatcatcatcattcctgtcatgagcagctccctttttctcttcattcttatccttgaaaagcctacgaaagaaattttcatcatccatggtcctgtgtcctttgtcgtcctcctctttcttgtttggtgtggtgccttcctttttctcttcgtttttctccttgaaaagttgccggaaaaaaccatccctcttgtcatcttcgatgttcccagcagtcttttccttatcatcttgttgcttactatgccctccgtctttcctctcctcatttttatctttgaaaattttgcggaagaacccttctttatcatcatcctctaagctcttgcccactctttcctcatccccatgccttccatgcaggctctctctcctctcctcattcttatccttaaatatcctgcggaaaaagccttccttttcttcatcatcaccctgcctatcttccttatcacggaacagtcgcttcaataaaccctctgagcttggtgtcaattccatgtcctcgtccttgctgtccctaagcaacctgcggaggaaaccatctctatctccttcttcctcctcgttctctttctccttactaagcagcctcttgaaaaatccttccttatcaccatcctcttcctccttgtccttgctgtctctaagcagccttttaaagaacccttccttgtcctgctcatcatccttctccacggatcgcctaaagaacgatgctgcatcacgcaccttaggtccaatgcttagtctcttgagtagcttgttatcctctgacgagggtgtcgctggctgcttcactccactgcccccaacatcctctgcagcagctgcattgctcgcacctgcggggggactcaagccgagtgagggtgatgatgcaagggacagaaggcgctgcttcgatgagcgtatcctgctaagcatggggttcccgcgtgggctggcaattggcgacggcggcgcaggccggacgaggggtggccactctccctgaacggtcgccgcagcctggcactgctcctgcaccctgtcgatcccatccaaatcgtcggtgtcctcgagctcgagctcggcggctagcagccagtgcaccttgagggcgatgcgcagcgacttggagcaggtgtcgatcacgaagcggtcgagcgacgggctgggcttgtgcaccatcatgtagcagacctggaagaggtaggcctcgagccccggcagcggcagcgtgtacatgcggttgcagaggtagtcgcgcaccccctggtggtcatgcttgtagaggtagctgacggcgatccactcgcagaagaaggcggagtcgaagaagcgaacgagccagccgctgctccccacggggtgcgccgccgcgtcgccgccgccgccccccgccaccgtgatctcccgcggcgactcctccggcccgaagctcaggctccgcagcccgagaagccgcaccatggccggcgacccctcaacacgccaatcaaaccgtcactcacctcctcctcctcccctcaccaccatcacaacgaacaagctcgatccagcgcagcaaaccctaggatccagagaaacggaacagcacgcgctccaccgccgccgccgccgcccaaaccctagcctcgccggcgagggggggggagaactcaccggggcagctcgatccggggccgccgcgcgagccctagcctgggaatcgaggcagcgatattcgcagatcgaattgggaagaaaggggggtagaacacggaagcaagcgggtggggggaagggggggagagattcgaacgaattgggggaggatttggttgagatttgaaatgtcgcggcgtcgtcggaggagactttggtttgaaattcgtgtgaaaatgggaaagattcgtacggttttttcgcttgggttctcttcgccggcgtggggggtggtggtgtggtggtggtggtggtgggggccgtggaatcggcgagagcccggagcaggtgggggcggtgatggccgtggcctggatcctctgtgcccctctctctgctgtgcccaccatgtgtcgtgtacttcgtgtgttcatcgtgttactccgtcatatcgtttggataattggttattgtttcgcttttgcttatatttataagtcaaattttaaagtttaaaattaaattttaaagttgatttttatgtttcctcattgtagtatattttaccgtattctcttttgaattgttaaaacactaatttaaaagctttactcatatttttttaaaagaaattgctaataataagtgttttgcataaacatgagcgaaacaatgataccgttgtgctgctgaatagttttggctgataaatcataaaaaacaaacgagactaggatatgtgtggttaatagctgaaaaaaaagaaaatggtgaaaagtgcctaaataaattaaaattaactttgagaatttaatttttttatggcttatatgagctagcaagcaaataacgaggattttattttgcaatacttaagctcgatcgtgtatatgcaactattgtaatgatacaaaaggagataactgagagagtttttttaatattactagctattttatcaacaatgtcttttgttaaatagatttataatgttgtcataagtttattgtatgggatgcatgacttgaactaggtaagttgcaaggtttgatggtacataaacctattagattctacaaaacagcatatggcagcctacatgattccacatttacctaacccaatcatcaggagtgaaaaaagaatatgttatattcggtcctagattcatttttatgggacggagggagtagatatttgtgattacggcctatttttaaaatataagattcatcgagaattttttttataacaaatgcttcaaaacaagctaaactatggaaccattgaggatttttgtctcctttgtcacatgatttgtccatatgcataattttacaacaaattcgaatatcgataaaatgtcacaaacttgacatcatttagtaacgaaaccaccaagctctacaaaatatcatggagagtatgtggcagcctacacggtacccattaatccaaccggttgaataaaaaaattgaggacaagatacacgtagcgtaattatatgcatgtgtatcgtcgaatatcacattcatggctaaagtctatatttagaaacaaagaagattcatcaagaatttacttgtaacaaatgcttcgaaatgagctaaactgtgaaaccacttgaaaatccatccttctgccacacaatttgttgtatgcataattttaccacaaagtcggaaatagtatggataaaatgccaagaacttattgtaaacgagggagaatttatagtcaatttgcagcccaaccttttggtgatagctaatttgatcatcatctcataagtacttgtatccctttccacgaagaaaagctgaaactttggtacttcctccgtattttaatgtatgacaccattaacttttttataaacgtttgaccattcgttttattcaaaatttttgtgcaaatatgagaatatttatgtcatgcttaaagaatatttgatgatgaatcaagtcacaataaaataaatgatagttacataaattttttgaataaggcaaatgatcaaacgttagataaaaagttaacggcgttgtacatgtacaaaatcaacgggaatatgcatatggactgttgaggcgtgcggtccaatcaagtaatcaactggaatggaccgggcctattgctggcccattgggccgatcgcggtggccatgagccctccgtatctgatttccatcctactgccattctgttgccttttcatttgttttgtcttcattttatttttcttcttcttttcttttttttaaaaaaaacttgttttgaaccagcgtgccggttaatcaattgacggctgaaacacgacgccgacgtacgaagcagtaaaactacgtcatctacgtgtacaacagccaggaaaggaacaaagtctacatgaaaaaaaaatactgcatattccagttgatcagtttacttcgtccacagtctacacctacccctactatttattactccctccgtttcatacataagtcattttgatttgccttttagttaaatttatttaaatttgaccaagtttagagaaaaataaagtaaaatattcaatacaaatcaaacatatcaaaatatattcaatgctataaatttaataaaactaatttgatgttttaggtacgttgctaaacttttctataaatttaattaaactttaaaatatttgattagaaaaaaaaattcaaaacgatatgaaacggatcggagtgagtcctaccaacgctgtgttgaccttgccaccacttgacggccaacgaccacaccactgccagcgaaaggagcgaagtcaacacgtgaagcattcagtttgattcagtttacttcggtcttgtttagttccccacttttgtttttaaatttttaactttttcatcacatcagaactttcttacccacaaacttctaacttttccatcacagcattctaatttcaattaaactttcaatttccccacttttgtttttaaatttttaactttttcatcacatcagaactttcttacccacaaacttctaacttttccatcacaacattctaatttcaattaaactttcaattttaacgtgaactaaacacaccattaaaaagccacaattcgtccactagtactatttctgtttgttctcgccaaaggttgttgattttcgatcgctggctaactgcaagatgcacaccagctagctctgcgatgatcattgactgcatatcgccgtatatgtatgtatatttatatcaacttgatgaatcaatttgacagtaatgtgatcgacggacagaccatttttcgtgcgtattctttgtggtccattatttttttctaaaaaaaaaagtactactccctctcgcattggataataattctcgacgttataagatattagaatttgattatcaatttattttattatcaataactttataagattcaataactttataagatatttagtttgaataccctaagagattagtcttaaatatactacaataaaactaaatatatgtttatttattaatagagaaatgcccaggggtcttctgggtagcttcacaaggtagggctag

SEQ ID NO: 57693 - DNA, 1143 bp, Oryza sativa
atttatcttgttttgcgttgttttccaggattcttccatgcagaaaagcctatatttatcacatatgctgccttccaaatctttttttttccttctgatatgtcattagtatgttctggtttcgaactaattgtcattcaatactgtaaaataaagaaaacgtttagtgaccggccgtctaccagctcaaatgggaagggacggtttcttttgtctttttttttttattcagcaccaatttttcatgatttcaggaggtattccgttcaagtgaactagagtcgatgctttcaaaaatgttaacttttatttgttttgcagaaattgcgttaattagcaagccataaactcatacagcatagaagttcactccaggctgcaaaaatcaaaggccttgattaatggagattgagatcatagaagttcactccaggctagttctgttgcctttcgtttcacagtttgttgctgcgagacaacattgatagtactatttaacagtatatttctaattatttgacgaaacccgctcttttgatctgcaggatgaatgaagctgtcatattcagcagagttttttgtcaggtcgtcgtccatcgtcctcgacttctgttacggttttattcagggaaatttacacttgaatataatcagtatgggccgtcaatccatccgtatcctgctgcatcccttcgcgacggaccttcagtgatgaaagcgtattttgctattttctgccaggaatttaagttcatagttaagagaagattcaattttgttacataatgctaggtctaaaatgttagattccacatcttgtggtataagtttttatccccaaattcttcatcatgttttaacttctattctctacaaaattctatgcatgtgttctatgtaacacatccttcataattggtccttgaccacttaatttagaatatatattgtctatagcatatccttatttaatagtaatagctaatttacatttaatggaatttgtttaaggcatgtttgctgcgcggcgtgctgcctcatatgttgcacctatacactgtatttctatacaacattaatcaaactcacactctctgcatagaagttgaaagaagaaattaaattcattagaagatatttgtg

SEQ ID NO: 57694 - DNA, 10635 bp, Oryza sativa
ggactaaagttaagtccctggatctaaacaccacctaatactcttcaaagctggtcgattctgtccaggctacagttggtgagaacaattaaccaagagagcaaagaggaggagtagccatggccgccgcagcgattggagggatgcttgcctcggccgccatcaaggagacgacgagaaagctgggttccgccatcggaggtgagatcaagctgcacagggacttcaggagggacctggagtgcttcaggaacaccctggaatcaatcgaagcggtgatggaggacgcggagaagaggtccatcaaggagaaaacggtgcagctgtggctgaatcggctcaagaacgcctcctatgacatctgcgacatgctcgaggagtttgaggccaaaactgctacaccagctgcacgaatggtaaactgtcccttcctcctagtcctaggctagctacatctccaataagtcttcatactttctttttgtttggctttaatgctaatagagccctggatccatctaggtgtgtcgattatcatgtcttgattttcttccaacatagttgtggttctggattaatgttccactttttaaagagtatcctctgaattctccatatgagatatattaacctctcttgatttggggactgtttgggaactccacaattctttgcacggctaaaaaatttgcaggcacatgaaaccaaatctagttaatggaaagtaatttcacaacatccctatgtttgtatcaattctgagcgcattctactgaaagcattatgcatatgtactccaaagaagcaaatctgaagcaaatcttaccttgctcgtccatcggtccaacccctccgctcatccacctatcatcgatgttctcccctttattgccatcatcaccttaaaaaatactccctccgtttcaaaatgtttgacaccgttgactttttagtacgtgtttgaccattcgtcttattcaaaaaatttaaataattattaatttttttcatatcatttgattcattgttaaatatactttcatgcacacgtatagttttacatattttacaaaagtttttgaataagacgaacggtcaaacatgtgctaaaaagtcaacggtgtcaaataaaacgaaacggagggagtagaattctctccatcatcccaccgagcatgcatgaaaccaccaaaactcaaacaggtgagtcactacttaaatctcagcaagacaaccatatcgatgtgaatccattcctcccaacccagaccaagtcatttggtcttagaaaccaacacaagcaacagcggtagtagtaccatctgccttcaagacatgaagatcggcagcggtagcagtagtaggttcccaacaacagcaagcagcctcggctagaaataagtggagattgaggagaaagagagataaccaaccaaaagttctacacctcaaacacaccacacacaccacagctcaaccatagcatccatggtcaggcaaccagagagagagaaagagagagagagagaaagagagagagagaggtcagaggagtagaaggagaagcaggagatagatacctgagttataagtggagcaaggagcttcagatcaggaaggtgattcagttccaggaagggctgatactccaggtgccaaccaagctccaagaggagaagaaacactttaaccaatttcaggagaagctacctgtagcagctcaagcaagatggcagaaatcagaacaaacagagcaaagaaaataaattgacaggagaaaaaataatggaggagaagaactaatacaagggaagcacaaaagagctcaccagatcaaaaaaatctcaccactaacaccagaacaaatcaaatgcaagattgtcaagcagataaatcaagaaagaaataaattcgaagcatgtcatcaagtacatggtttactatgattaggagttgtgtggatgcatctatatgaacttaaactgaacaagaatatctcagattcagcaaaaaggattatattaataatctaaactgtagaatagcctatgtaacagataggatatattttggtctaaatgacaagtagaagatattttttgtttcatcactaagatgggttgaggattactggtgtatgtagttcccctgatattaggttcagtaaggtttaattctataggataaatcttgaacacataattagttagaattagtataaccttaacaaattagcctctagtttcaacaataccatatcttagggacatcagtagtttagattagtatccagtaaaacatgtagcagtatgcttcagtacaagaattattctgaatatatagagtaatagacagggtagatatatttacttatgacatgatatctcgactaaattatagtagtatgcataacagcagaaaactaaattttaacctgtagctccaatcagtcagtagtttaatctttgccataattagcagcacagaacatcattaatcagtaccatatttaatcaataatctaagtccttcaattataaacaattctagcatgactacctccgtcccaaaataagtgcagccatggttttcagcgctcaactttgaccattcgtcttatttgaaatttttttgaaaaaaattaaagacataagtcacgagtaaagtactatccatgttttatcatcttataacaacaaaaatgctaattataaaaaaattttaaataaaagaaacgatcaaagttgggcgcggaaactcatggctgcacttattttgggacggatgtagtattttataggttgaatttcttttcagtagaaaatctagagcaatctgttaactgatcaagttttggggagtagtatagatgtttttcttttcctgattgacaaaaggatccagccatgcgaattgatgcaatgctaaagtgaagctccataaggagctgatgtgtacagtgtgtttactagttccaatagccaatcacttatacatgccgcaagtaagataaggacagaatcatgttagggtgctttcaatttcagtagtgcatttcataggattactactagctatgtgagcattcattcattcgtccataagaccataacatatagccatcatccaaccatacatagcaagtctcaattgaactagaaacttagaactacaaacagataataaccattagcagagcacatcaagttgaacaacaggagcagtctatagtcatcacggttggttcatagaaacatcaacccataagaagagaacacaaatcgtagcacatgagaggaagggggaagaagttcacctctggaatagataaccaaccgtacgccacaggagttgcgcggtgctcagcaccggccatctcggcggcggtagggagtcgcagcagcagcagcagcagaggaggaggccagcggctagggttagcttgggaccggattcgcggggagctgcgggaccaattctgggtggcggcgactgcggggtggttgttgggggggggggggtcgccggagtggggcgcggcagccggcgcttgggagagcggcggcgttgtcggcgctgccggaaagcggcggcgctggagtctggacagaaggatgggcttttcgagttggaataagttcactataggtaccttcccctatttgtcccttatttgtcgggtcttttaactatttgccactcttacgatcggtgcttaacgatttaccactaggcccacatgttatagacacatgagggcccatatgtcatagatacagtgtggcaaatcgttaattgtcatgtcacaaaagtggcaaataactgcaaaaccgggtatgacatgtcccccaacttataaaaaccaggcaaacgtggtccctcagcagttttgaagtctgttttggctgacatggctcatacgtggcttgtttgactaggtctccgtcccacgtggcattgacggggcgcttacgtgacaattatatctcagcaaaataataaaaagtgtggccccacatgtcagctgcaaaaagaaataattttaaaatggtggggccatgtgggccccacatgtcagcctcactcctctcttcttccctctcccttctatctcttcttccctttcacccctctctcttcttccccggcagaggacggcgcgggtgggcagcggagcaggcgagcttcggcggcggtggcggcgggcgtggtcggagccgccccccgaccggagcgccaccggtcagcgtgaaggcgagcagcgcggtagcgccctggaaggcgccatcgacgctgccatccgtgtcaccgccgccgaccaccggaccatccgtgtcgccgccgccgacctccgcgcgcgccgggacctccgctgccgacctccgctgaccaccggaccatccgtgccgccgccacgtcgggacggcatcgccgagcgcctctacaccgcgctcgttgtcctcccgccgcctacgccgcgctcgaaccatgtcaagctccctcctctcccgccggcgagctagaagggcggcggacggctaggcgagctccctggcacaaccaatcgactaaacaaattcttatcccttcctctttgatctcttctccctgctcaatctcaagaacgtacattttgtgttcgacaaattttcatcaagaaatctcaagaacacgtcgtgttcaggcaaaagaaagacaagaggcgatcgatggcaatggccatggcgaagctgttcatcaccgggctgagcacgacgatgacctgctcctccgcggtggtgttcaagggcgccgccatggccgtcgtgctcctgctcaggctggtccagctcctgggctacctcggctacctcctcctccgcgccatcagagctgccgtcgagggggccgtggcagccgccttcgccgccgccggggacgccgtcgcggcggcggcggacgccgcggcggggtggagggatgccgcgtcgtcgaacagcaccgcggcggtggcattcgtgcaggccgccatggggaggcccgaggcgctgctcgccaagatgctcgccatcttcggcctcgtcgccttgcttcgtgcagaccatcatcccggcacgtgcggagggtgtctgggtggtcggcggcggcgacacggatagcggcgtcgaagaaggcggcgacgcaacggaggagaaggaaggagagaggatagagagagagaaaaaagaatagcgaaagaggggcagtgaggattcagcctgcaagtggggcgggtcgacccattaggtccgtggcccgaacctaaatttgtggcaccaataggttttcgggccggcccatattttcttaggtgacaatgggtccaggagtcagttgaccctaggggtttttgggtcagccttgttcgagcgctccgcttgctcgcgttcgcatggcggcggcggcggctttacgggtcccggcctgaggcggtgcggcttcaccacggatcgagccggcggcggtggctcccggcggaggcggcagcggtggcggcgcagctccatcacggatcgaggtggcggcagcggctcccgacggaggcggaggcggcggcagcagcggtggcagcttcgacttcgcggtgtgctccaccgtgttttgaggcggcggcggctgggcgtgctctttcagtcctcctcccgtctccaactccccccaagacgtactgtggttcccatcgtagcaactagcaacggattctttggttcttgattttctctttcttttctttggttcttgattttctctttcttttctttggttcttgattctttggttcctcttctatgcagttccttctttcggcggcggatggaggcaccggcgggtggcggctacctgcttggtggccaaccggcgaggtgctacggaggacactccaccggcagcaacggcgagggtttcggaggacacccggccacatcgccaccttcgtccagctgggtttctctccctcgtgagcacaggtatgatttcctccatgaaccctgtcttgttcatctgtcttgctcggttttggtttgatttgtatgtacagagacaaagtaaaagaccatctatttaacacaaggcagtaggaaactttaaattagcagtaattgaaactttctgctagataaatgaagaaaattagtaaaatctgcaaatttgtgtagcacctgttagatgattcttgtattccttaatctctgattgtgaatactattgggtgactgcagattacttctgtttttcaagcatgttttatatgtcaaatactcaaatgcttagaacacctactgccttgattcctctgtctgtctgcatatgctcatgtcttgattcagttgttgcccataaaacataaatgcaccatttctttttctgagagatattgcaggttattacctttttaaaacaattattgtatattttcttcctgtcattataccatgatcattcgatctctccatcatgttaacctgcagaatctggacctgggtgattcaacgaacagtgcaagctagggaatgccaaatgatgcccactttgatcttggaaggcttcattttgtttgatctcaatctaatgaaccggatatttgggttgttcagatcgatttttgtgaatgatataagtatatgcatgtacttagttttaattgaactaggtgctagtacccagtgattgatgtttgtacttttgaatgcaaaagattaagtcatttcggaatgtttgcattgggtatacagtgtgttctggtatcgtttttgattatttatttattttgctgtagtgatgttgatttgcttcgcacaatcgaaatttctagtatgttagtatgtgttcagatataatgccagtgtatgtgttttttttcctaatttcacttgatatctgacttatataaaattagtatagtaaagaaatgatatcagtgtaatatccaatgattgttcattttttaatcttgtataattgaattgagtgtatagctacttgctttaatggttcaatgataacacattaacacagccagtcaaccattcactggacacggtggctcagacgctcagtgcatccagcccgcggctatggtgggtcggccacgaacctaacgggccggctccacttccaccagagacggggcgagtccaggcaccaagatagatagggtcagagggtataggggatgggtcggcccgatctgccccctttgcaggctgagtgaggatgacaggtggggtccacgtgggccccaccattttttaaattattgtgtgtgtgaaactaacatgtgggtcccataatttttattatttttcggatcgaattgccacgtaagcgtcacgtcaatgccacgtcagatgaagaccgagtcaattagccacgtaggcgccacctcagccaaaaccggagtcaaatactgccgagggaccttatttaaacggtttcgtaagttgggggacctgttgtacccggttttacgatcaagggacggaaatcagactaggcgacaaatagagggacccaaagtgaacttattcctttcgagttttggagactttgctagatgggctagcccaagaaattaaatgcagaattatttagaataggaataagttcactttgactcccttctagtagccaaatatgattcgtatccctaagccacaataccggatatcttggcccctcaactattaaaatcagtgcaatttgacttcctcgacagttttgaaggacggtttcgctgacgtggcacctacatagcggtgttgacctagtctttgttccacgtggcattatatatatatgacccatttatcattcacccaaaaatatttgtgggacccattgacatgggacaaataccaggtcaacaccgccatgtaggcaccacatcagcaaaaccgccctccaaaaccaccgaaggagttaaattgcaccggttttaatagttgaggggtcgagatatccggtattatggttcagggtatgaatcagattcggccactaattaaaggagtcaaagtgaacttattcctttataatacaaaagaacgtatgagaattgggacatatgtaaattagtttaaactcttcaaaactatttcttgcaaattctgatgtactggtgtagttacttagtattattcagtccatctgatttttaaaattaatttgaagtgtacattttctttaggtcaatacaaatacaacttaactttttatatcataattgaaataaaaatattccttcaaaatataccttataaattatttttttcaaacaaaccaaaatgtatattctattgaaagcaatacatttagaggctattgaataattttttttctaagtaaataattactctttcttaaaataagagtgtaatatgtgttttggaaacctatttttatagtttacaattaaaatttacttacacagacaaatcaaaaatacatctgacttcacctatacaaaggtaataaaaacaagttcacaaccctgcatatgcatcatattcatatagccattatcatatttagtagtattttattatttctttcagttggtcatttatcttggatttttttggagttctccgttgatgtattcgttcttcgattgcgggtatctcaagcaagtacaacacttttgaccatctattgttatattttcgtaatttcaatttatatgtataaccttgcattaaattgtactttaggaaattaaaataaatatgttgatggatttgattgactagtggagcagccggttatattatgggtgcattccgaactttccattgtcatggggtttcagttgcatatattgatcatcataaggttttgttatacggtatgcaagcattgtagcgatcgtgtcgaccacatgacctggtatgggacggactagcctagtaatactttcttattggcttatatctgtggtttatggacttccatgaacctcgtgagcttgggctagcgatgaggattatgttgttgcggaattcgagtagaggatgtggattgctattgttgccggatccaatgatctgctgttgttgcagggatcgctgcaaaggtatgacatattggattgatgaaaagtttgtgttcttgttggcatacaccatgaagtgtgcttcaagcgcggacgggcgtgagcattaaaatgtttaaggcgtgtgtgggtacagcgacacatctttacagggtgtatgaattatgatatgtcactccttgtttcgtgtacaaattgcgaagtcattaggaaaggaacctatcggaggatctaatacctatgatgccttatatgcaatagattttataattacttaatatgatcttttataacactattttataaacatgcataaaattccttgttgggttatggggctttggagatatattattatgcaggtgggttatgggcatatatttgttggattgctacagttagacttgttgagtccctttcatactcatcccttatgtgtattcttcatttgtaagatgattgaggtaactcttaggcgacaagaaagttctacacaattgatttgatcaagtgccttagatctatacatcaactagaagttgaaagtcatgaagaaatagaagaaagtcttcaaggtgttaatagtgattattttgacaaaagctattttcttatggtttttatttcatgggctcctctacaattgtttattttatgctactctagtgtggccatttcactgtaagttggttcttaatgagaaataagacatagatcggtattctacctcagaagtgaaatgcgaaggtcactatacaggtccaaagtgccacaaaggaaaaaatacctggtccaaagtgaaaacattggttggtcaaagtaaaatttactcatacatggtcactccttaaattaacttagatcagggtgtcacgtaggtccataatctcgcaaattgcttatctaggtctgtaatattggtttaatgtatcactcgaagtccaaagtgcctttgaccagtctcaagtgccgacgtggctgtccacaatggaaaacatcttgtatctaggcccctccaaaagtacggtacccccaatctgactcccaccaccactcctaccgcgcccctagagggaaaaaaaagagatgattagggtcggcaatcagagataaatagcacaatagggagaggatggtcttggaagtctggtgcatccccatcatcatcgtgaagatgaacgatggaccttaggctacttgaaaatgatgagtagcttggaggagccatggcagtgacgatgaaaagatgccacactttgcctcctccctcgcctcctagacaccctacccttaccgcactttgcgctgccaccattttccccacccaaatttaaaagaggggagatagagaagagaggagtcagatcggagacaaattgagagagaagggctaagtgcaaatttatcaccatggtgggttttaaaggaggctaaaattcaagatgctggttaccgtggacagccatgtcagcaccctagacctcaggtgatatgttatcaaagcaagattacagatataaatgagcaattacaagactagtaatatgcccgtgctaaacgctacg

SEQ ID NO: 57695 - DNA, 23344 bp, Oryza sativa
tttttagcttcatgtaaggttgtaaatggatataaaagaatggcatgaaataaatatcatttcttgttttcattcacaatactaaagttttaatcctaaaagtggtaatagataaatttgagcagtcaacattaaactcgcatagtatgagctcctctcatcctaggtgacttggtgccatctgattaaaaaaaaaaagacatgcctagctccaaaatagatttgctccacctcctacctccttgattcaggacttctctgtttccccccacatcaatgtcttcttctatcacaaatagtagtcaacatagcacctgacggtgtatgatgaatcttcatagccaaaaaatgatattccagcacaaatgatcttccatctctttacaaccagcaaattgcaagcaatgacaggttgatgattagccatggcatgagaaagttcataactggtactgaccggccagggttgacggagctctagatcggcgtcgctgttgaaggtgggaaatgggattgttgcagtgatctatagccaccgcagtgggggataggcagctaaggatcatgcaggaaacaccatatctgatctaaaaagaaagagccatgctcagtgccaccaactgattagtacatgcttgcttactgatcacaaacaacggaaaatctcataaaatagcagcactgaagtcaccaaaactgaaagaaaaattgcatccacggtagttctcgttgagcaggacatccgctcctcatccagggtcaagcgccatccttcgttctgcaaaaatgagtaaaaaaaatcaacataatatagcacaaaactaaatatgactcaagtcaatagtacatatcagttccgcaaccaggatctcaagcacaaaactgaatactaccctagttagttcccttcctattcaatcaccattcctattcaatcaccattggaggcactgagttcagctaatccaattatatgaattcagggtaagagctgcctacatgtgcatcaaagggaagtgctatcaataacatgtttaacataaatgtaccaagtttcacccacgatgactcaaaatgatgtaattaattaagcattgactaatcacaagtttggataaggttatgttatccttattgtaacattatataatgagctttgaaggagaattttatctcctgacctagtagtaataaataaataaattatgacaagattaaaccaaaatatacatccatacatgccaaaaggaaaatcgaactttaaagattcctagactcgtagcattcgatcagtgatgaccttgaaaaagaatctcccaagaaatacaaggaagcagatgtaaaatcaaaggtgtttttgattattattctgtgatgaacaattgggcattggagattattgattttgtatttggaatttattcacgaagtggttttggagatgattggatttacaggtgaatttacaggatactgctgtgattttatgtggaccggtcagaccggctgaacagcctcggtcagaccgggcaccggtcagaccggtggtacagaggcggtcagaccggcccccggtcagaccggccactgtacctcggtcagaccggcctcggaggaatttttctaaaaattctaaaattgattttgcacgtggatatatgtctattggatcttctggtcgtgtgtctcagtactggattcctaaatttttattatcatctaatcccagtactgaggcttcgacttctgcttgtgtgtaggctttggtggcaagaaaggagaacgtgtggatcgtgaattccggttgttcgcggcacatgaccgtagagggggagcgtgaggcttcccggtattgctttcgagagcaatagagttgagtttcgagttagggtttcgagtttagtcgaaatttttgtaaggagtgctgttggtgcactttgtaaaaacagagagaatcaataaagtcgtcatccactttaagagttcttcgatttgtgtttaccaggtttcggcggtcagaccggcgggagcacagcggtcagaccggcggcggtgacaagcgcggcgagcagcttcggcggtcagaccggttgatctataccggtcagaccgacgacatccgagcggtcagaccggcaaggcaacttcggtcagaccgatctccatcgatttcgagggtaacttttatttccgctaaaagttttcggttttttgggtataccaaccattcaccccctccctctggttggcttagttcttgtgattcgatcctacagcagcagtatattatgtttccattttatatattttttgtcatgttctccacacaattaaacaatatcatagtgattctaagccattagactcaattaaaggaagtacattttcgtaatacatagggcactgcattttaaagcaaataaataacattttgttccaacccaaccaaatctccaggaagcaaacacacaagcatatctaaaaggtcacatatccggcgatgtttattagtgattccactaagagcataagcatatctaattaagcaacatcagacataccatgaacactgcacaattggatctaagttacagcagagtaaatacagcagagaaaagtttagctattccgctccataatccatgaagatttcaaaatacatctatcagtaaaaatagtacctatgcctatgtcaattctcctgaactaccattgtataattccacgtctccgctcgccaaactgctcgatcaaaatagacataaaccactttaccactctgcgcctaacatatggacttcaaagtttagctataagggttaaaatatctggggttggtgattgcaaatcacctgcatatacccacatatctggggttttgaaattgtatgttgaagtctagcagatttgaagggaaaaaaatagatggatatgtattacttgcagattatagtattagtagtttagtacaatgcctatctatggtgaattaccgaaagatgcatcacttgcaatgtttatataagtagaactctgtcaatagagtgcagatgcagaattcctcctcgatttccatccacaccatggcatatatttgtgtatatgtatgtatatgtgcctgcaattgtagtattcatgagatcgtgctaatcagttagtatactgcataaattaattgcaggaaagacagggtaattcaaaagaacatgcctataaaatcacatgatattttaatcaagtagctaaatgcataacacaataatgtgtacccatctgcaaaagaaagtacatgcctgcttgaatgatcaagagcagtggaggacaattgtgatcatctccaacattggtgttttcttgagcagaagattagcatgttccaatctattctgataccatgaaaaacaagggaaatttgtagtacaaatcattcaagcttaaacaaagattgctaattacttagaaataaattcagcaagcagaccatcagtggattaatgctgggctagctgtttgtgaacaaccaactatcacatgtcctattttgacccctaaagcacgaaatatttttttccttttgtccccagactatcatgaatgcatagaatagtatgttagcatttcaggcagcaacccaaaaattagttggcactaacacattggcgtaatacattccaaccatcgataacaaaattgcttgacgaacagggtggcggactgtttctgcagcattcaatagaaaacataatgtgcatgttcaaaaacataccttgctggtacatcacagccaaaatcaaattggccggtttgtaaaaaaaatcaaccaggccaaagaaaaataatgaactggaagggagaagatattgaaactggacaacggaagaaaaaacaaaccgtgcggaggagaccggtggcggcacgaaggtgggcgacagtgcgacatgagccaccgagggcgacgacccaacgctgctccggtggcggatttcgaggtggagatcaggtgagacgtggaggaaactggcgagtggggaggggagcggcgcgcgacggcgtgcagggcggattcgtggagagagaggaggttagggttagggtttggagagagttcctccggcgagtggggagaggagcggcgtgtggcgacggcgacctggcggctcatgacggggagtccgggagagaggaggggggcgatgcgtgagttgggggttgaagatgcggcagggaggggtgaggccgtgagggcgtgatgtgtgtggggggttagcaggggaggcgcggaaatggagccgtgatgagcgatcggcacgcggaagagaggcggagctgatcttgatcgttcgatcggggtagagaaatatgagccgttggatttgatgaatgagtaatgtaggtgtaaaagtgagttggtgaattatagggtagataataaatgtaagtgacactgttagagtgcgcagcccgggccaccaactgtggatcacccaggtcacattgggcctgctccaccacaggcccaactttaggttctgggcctacacaacccaaaagacaagtctgatgagtgaggaccgcccctaccttttaagtcgtgctctcccatcatcaattaccgatgtgggactaaacccaacaatctcccccatcacacatcgggcccaacaatctccctcgtcacatcaacccatgtgacctgaagacttgttacctgggcctcgggcctaacaatctcccccgtcacatcaacccatgtgaccccgaagacttgttacctggcctctccatcatgtgacccatggaaattgttacaggttccaaaccttgggctctaataccacttgttatccaactggccccgaaattaccatcggaaaccaaacacagaagaaacaccatagtagatccaaacataatgacgacaccgaggcacgatatttgataatggagttcagccgaggcctacatctccagggcactgattacgggcgctcctccccgatccagcatatacagcgtatcagagttacaacgactcacagccggtcaccgccggcagccgttccctctcgctatgctaagtcgtcatgcggttacaacaggcatgcccctctatttatgagagatcctaagacagagttcgactcttattctagttctaatacctcttacagctccaagtcctaaactgtaaccgactaagtacacatattcgacacaaactctaacagacactgtgctccaagtttaggttccgaccgtgcattttactctatatttaaaacagtgtaattgtttagcatcaaagttgcactactagaaatgtaatctcaagtactttattagcatcttatatttcaaactatcctatttaatttgatgttgcttgaaaaataatggtcaaacttgatccattgctagtcaaaaccaaaaggtatgtgtgaacggagggagtacatggcatagtcgaaactagaatgttcgcaaccacacttgcttgattaattgaagaatgaacagacaccataagccacagatgaaaatcatgggtaaaccagtaatttaaaagacacatactaaggacaaccaaaaatccagtcgtggaaaaattgaagaagaaacacatcaccgagttgaaatttggaaaccaaccggaagaatcaatgaaaattttgcaaatattgtttttttataaaaaaaaacaatcagaggctaatggttaatgcataatttcttaccattacgtaagcaagcaagattgtgcatcaatcctaatcctggaaatttgcgaagatatggcattcaatttgcctcacatacgttgtcagtcgtatttgtagtgatgtgtgttgcaatcagactttgatctatcagaaaataattgagttgtttcatgtaaactgtattctcctaggtaggtcgtcccttgggaaatatccaacgacatgattccactttaatactgatctagaaagcatgtgaaaattagccatgaccgtagtggcatttcgacatgactcggagagagagacgtcacttaaagagatatatcaaccattaatcatgaatgcacctctaatacattatttcgttattattataagcacctctaaaatatctaaactatgaatgttatcacaaggaaaatacattttcaagccccatgtgacccttcaaggtataacttttggttaaaaaagaagaagaagaagaagtggtgcctcctggtacctctcaagaacaatagaataaaatcactcattttgagaagttacagtgaagctcttccataccctttcaaggatcataaaatttctccagcaaaatagtgaatacacctccatgccctaaatagtgaatacacctccatgccctgatggtttttcgagcttttttttttattaaatccgtatcctttgcctctttacaaaatagtagcatgtttaacaaggggaatttagcttgaatctacctaaaccaaaacttggacgaattatatggtttgtgaggcctacattccctgtatccacaggtcaccccatgaacacttccaaggagtgacctgtgaaatgaggtgatgggcagtgtcatgtcactggtcttgattagttgtggcaactatcaaggggtactaatcaatctcaggcgtaagaatggcagctaatttcgctgataggccaagtgggcgatggtgagggcgcctcatctgtctacatatactatgatccatccccatgctagcactcaagtgacatagctaacttagctagctagatcatcttagcttggagaagacagaagagcgttatcttggaaggacaacatggcaactgcagggaaagtgatcaagtgcaaaggtctgagtcttggtttacactggttttttcatgtttgcagaactcttccaagatgaaattctcctgggaaaataaactcagaaatgcactgatgccgcttttggtcattatcataacacggacacaaatttcaggacactaaactgcatagattgcagaggaaaaacagaaaaatgtacactcatatgtcatgcagatttgaggtctgaaatattttttttttatggagagttggatttgggtttgcagcggcggtggcttgggaggccgggaagccgctgtcaatcgaggaggtggaggttgcgccgccgcaagccatggaggttcgcctcaagatcctctacacggcgctctgccacaccgacgtctacttctgggaagccaaggtattctgaaccaaccaattccatcactattatattcactttggtgtatggccaagaactacagactgaagttcagtgttgccagtgtctgaattatgcttgattttttgaccatctcttggtttggatgtgaagcagagtgtgaacaattcccaaaatatacagtttttgttattcagatgtttactagcttgaattttgttaatctttttggtccttggttgaacataagtctgaaaactgaatgattcttgtcaggggcaaactccggtgttccctcggatcttcggccacgaagctggagggtaagaactactacaaaccaagaacaccctcagcaagaaccattaatcttcagtggcacaaacaattaatacctccgtcccaaaatacttgtcgctttgagtttttgtttgtaacttttgatcgtttgtcttattaaaaaagtatggaattattatttattttgtttgtaacttgctttattatcaaaaagtactttaagtatgatttattcgcttttatatttgcactaattttttaaataagacgaatggtcaaatattgcaagagaaaagtcaaaacgaccactaatttgggacggaggtagtatcatcttggcaaaatagtttgcaattcatcgacgtgtaattctgtacaatgaaattcaggcttaaatagttgagtgatttttacaatcttaaaggaagtaccagaagtaccatattttccaatgtaaaatttggtacatcttatttcttatactaggaggtaccgaatttgtactaaaaattttggtacctcgaagtactgaaaaatttctctaaataattttgtttgtacgtgtgcataggattgtggagagtgtgggcgagggggtgacggagctttcccccggcgaccacgtgctgccggtgttcaccggcgagtgcggcgactgccggcactgcctgtcggaggagagcaacctgtgcgacctcctccgcatcaacaccgaccgtggcgccatgatcggcgacggccagaccaggttcaccgccaggggagggcagccggtgtaccacttcctcggcacctccacgttcagcgagtacaccgtcgtccatgtcggctgcgtcgccaagatccacccagcggcgccgctcgacaaggtctgcgtcctcagctgtggcatctccaccggtatgctaaaactttgtgttttttttcttttttcattggtgaggtttaagtaggatgatccatacaacatccacacacacaacaatcatggagaaatactgtactccctcccgatttttaatgtatgacgttattagcttttgatgtgacgtttgatcattcattttattaaaaaaaaaagctaagtatacaaataacattcattttattgtgaattgttttatctaaaaaacaataatcttaacttatacttttagatacttatacttaatttttaaataagaagaatggttaaacattataagaactggagggagtgctttctttctttggttataaatattgtatttgctgaaaaaatatgtttatgatataattaaaattattttcaaggtaaaacttttgccattgtaagagtagggatatatataatacaacctgaacctagtgacctacatacaccacaattatgggagaaatattgtacttctccgataacaaatatatgacgtttaaggcaaaattcgctcaaacttttgaaactccgaccatcaacttttttattatatttatagaatatagtacatttctgtaggatttggcgcgactgtgaacgtcgccaagccaccgaaggggtgcacagtagccatattcggcctgggtgcagttggtcttgctgtaagtgactgtcacttctgctcttctcagacagagtacgagtagcccttaatcatcttttttctcaaacagagtagtatttttgaaagaagatttctgatttggtgaggggatcatgtataggccatggaaggtgcaaggatctctggtgcttcacggattattggcgtcgatttgaacccggccaaattcgaactaggtaactacggctcttttttggaacctggaaaatgtcatttttctactgaatttaaactgtatgctgcaagaaccctatctccataatttctcataaggatattgctactgtttttattgacaaaaatatataagataaatccacgcaaattcagatgccttttttttttctaaaattaagacaaagggaaggtcagcatcagaatgtcacattgggtttcttttttcctctgcatttgcagctaagaagtttgggtgcacagactttgtgaacccaaaagattacgacaagcccgttcagcaggtacactctcttcatgctctcacacaagacttcaaattgtagtaatccttttgtttcatattatgggtgtgtttagttaacgctaaaattgaaaatttggttgaaattggaacgatatgacggaaaagttggaagtttgtgtgtgttggaaagttttgatttgatgtaaaagttgaaagtttgaagaaaaagttaggaactaaaccatgcctatatataagtcgtttgaacttttttttaagtaaaaaagtttaattaaatttatattaaaaatagcaatatttttaagaaaataagcatattattaaaatatattaaaagtgagttttaataaaactaatttaatattataaatgtgttgataaaatttttctataaacttaatcaaactttaaaaagtttaactgagaaaaaaatcaaaactacttgtaatatgaaactgatgagtggtacctttggttgagctaaatcctatggccgacgcgataactatttcaggtgatcatcgagatgaccaacggcggcgtggaccgcagcgtggagtgcaccggcaacgccgccgccatgatctccgccttcgagtgcgtccacgacgtacgcacgccgtctcatccactcatccatcatatatattttcagtgatcagctgtgtcaatgatctgaaccctctgcacgacgatgtcgccgtcgacgacgacgacgatgcaggggtggggagtggccgtgctggtgggcgtcgccggcaaggacgcggcgttcaagacgcacccgaccaacttcctcaacgagaggacgctcaggggcacgttcttcggcaactacaagcctcgcaccgacctgcccggcgtcgtcgagatgtacatgaacaaggtccaaattattaattaatccatacccttttccagctcgagattagtgatgatgatcaatgcctgcaaaaatgcgtcatcatcttggactgatcataacaattctgcctgatggattggttaattaattaggagctggagctggagaagttcatcacgcacagcgtgcccttctccgagatcaacacggcgttcgacctgatgctcagtggggagagcctccgctgcatcatcaggatggaggactagccatccagatcgatgtcgccgccggcgatcgacggcggcggcgactgtataaacggagaaaataagaggctaaaactacctatgctacagcaataagctagccacggttgcaggaatgcggtttcaggtttgttcatggagaacatgggtggacacaaattatatatactgtgaattttctgaaaatttacaagacaaatatgaaattgcgcaaattacgatagcggatagcctttggctcgatcaatttgagcctatatatgctggctccaccgctacactgtttgccgcctttctgtattgcgcatctgctctctctaatgtaatgtgcaatctatatataactaaattatgaaacataatgtgcaatctgtcaatctacattctggtatgaatttttgcagatcataatattcacctaagttgggtgaagacatgtttatcaacaggacggattataagagataaaaagttgacctgtgttgtgtcacagactgaacaccatccaaaatggcatcatttgaggcatcttcctgtgtgtcaaaacgacaggaaaggaatctggttagcgcatgattaaatcctatcatccccaaagtaatcacagagaacacaacaaatcctatcctctctgcacatgcaagcacagcattatacacagagctccccactctcagaaattcagaggatgcatgcatctactccctgtcatggtagcatacaagtgcagaatctttgggttttggggctccataattggtgagctctagctatctagttggctaatctgttcttaatttcttgtagccaggttgcaggatgcaacttgcagagacaggctgccccataaacccagtatcggctttaaatgagattaaacttgtgtgttagccacgctactttggtagtacatacaaacaaactcaactatgactactgaatatagttataaattttaataacaacttaatttatttgctatagaattcaagttagaactgcataggctgtgttcgggagtgagggcctcactctccagcacgcaaaacgaaacagcatttagagcgtgattaattaagttttagcaaaaaaaaaattttaaaaatagatcaatatgattttttaagcaactttcgtatataaactaaactttttacaaaaaaaaaagtaccgttcagcggtttaaaaagcgtgcgcgcggaaaacgaggagaaggggttgggaacctgcacaaacgaactgagccttaattggcagagtgagtataactcaattgattaagttacttgtggcggaactaacctacaagtcaataatgagatgtctgtgatgaattcgtcaatctcaaatatgataacgagatgtttatgttggcttcattaatatcaagttatgttgggccctctctcggaggtgaaaaagaagaaaagaactacctctaattatactctagatttctatcagatggagaattcatgcttggtggagtaatttgaggataaggtctgaacaatgtacagtacttctccttctgataaagttaaatggatgccttttggaaagtgaagccaacaaaatatattagattgcaaattgcaccacttgtcaaattatatatgttgctagttggatctacggcgtcgctatcagagacctttctaacacaagtgttttggcttcatgttaccagttctaccagtagacagattacatcttgtaagcagtatggatcactgacttactagtcaccataataaggtcacataatatcatagtggccactacactactagtattgaaagagaacgaacaatggggcaagacctaagtttaagagtttattaataaagaagtttatttacaaagccgagcaaagaaggaaaaatgacttaaaagaagaaaaccaaaaggataaaagatcttccgaggatacactagacgctgatatctaaaggggtgaaaacggtcgggaaattcctgaccgaccgacactcgcttctgattttattaaccaagctatatgaaaatggtaatcggtgaaaatagaaatagtaaacaaaatatagaaagtggaacaattttattgatatatcgattgtttctgtattttttttattcttgtgaaaatcaatgtttttataatgtggtaattagcaactttctaaatataccaatatccatagtccatatctctatttaatacattgttgagaggcctaaatcacttattctcgtgcgctaacttttcattctagcttgcaagtttcgctttaattttttttctagtttgatattttaatgtgtcaattccaattccattcatcacacatgtacagactccagagatcatgttgatatttgtaaacgagtaaattctaccggcggttcttaaacttataaaagtaagtttcacctaaatccacaaacttgtaaaacacgcatcaagatccctaacacatggtttattgtatcatcctggtccaaagtcccatttactcataggcttgactaacatgccacatggatgatgacatggccaaattcctccttttccacctttttttctaccattcttcttcacttcttcctccaccactagatgcactagcggtgacggtacaggcagccgcaacaccaaagtacaggcagccgcaacaccaaaggcaggtggagagagagagagggaggcagtgagagcgacaacgctagtaatcgggggcagaggcgctggtggcggggtagacccaacagcagagcgaatatcagagcccttagctattgttcttgagaaatggccgggtctggcccattcctcaaaagatgtttttactagatccctatccacaacaatttatacttctggttctggcgaacaaatcagcattaagtctgggggcaacgatgacctcagaccggttgtggtttgctctgatgggatttgagctgggaggagtagagggcctgagccaacggaggaggtcgcgaccagagaagatgggtgtcggcaaaagcttgcaccgatgggtacggtggaagcagaggggaaaaaaaggagaaaaagaaaaaaaatttcatgccatcatccacatggcatgccacgtaagaccatggtcaaaccagactttggataaggatgatacaataaaataagtttaaaaatctcgatgcatgctttggaagttcataggtctaggtgaaatctacttacaaatttaagaaccgttggtgcaatttactgtctttgtgaattgtggtgcccaccttttcctttacatataaataaactacataccagttaaagtccaatttgtcacacgcccgttgcccttcatgaagtaaaacagttggaaaagggccctaatctatatcaatattgagttgataaagaaaatatgttagaaattactctaaaacgatgtttctatgccggagatatttctttctttttattttgaatagaataataccactgcttctgttatgaagcaaacaacaaagcacaacgactacaaaactaaatttggtgaacttaataaaataacatgtctgaacgatgaagaaaatattggccatacaaattactccctccattccctccattccaaaatataagacacaaccacttttaacccaaaaaccaaaaactaattattataactctctagtttggattaccctaataaatataatacgtgcacttaataaaattaaagatcttgagggcctaagctagcggaggaactcgtggccggaatgaagatgtactagcaatgctttatattatggaataaaaggagtagaaaaaattcattatgtagtaagatatgtatatatactccctccggtatcaaatatattgacgtttgagggttgtgttttttggatgcaaattattgacgttttggtatttgattgtcactttggactgctatacccttgcatgcatgtagcgcttgtcttcagtagctcatcaactatagcaggctcccaacgtcccaagcaacgacgcattaactccaactttgaaactaaaggccatagccacacaggtcgcatgagagtttttgataaaagagctacactaaagtttttaataggggtaaaacaggaaataggcaacctaattaatcacttcttggtaagtgagattctgtccaaaacgtcaattaatatagaaccggagggagtagcttccaacattgaaaagaaggaccaatctgtacgtcacaccatcccgttgtattctgttaatccatttggcacatgcccaccaaaatgttagtacgatgatctccatgcaaaattcgaatccacatccatgcaagctcattaaactctaaaagtacagaattcaaatccaattgtgactgatgggcggctctgcatgaaccaactaatcaatacacatattttttgtgcagtgatcagtgggcaagagtccaaatccagccagccaatttgacattatttttcaggtcaactaatcctatgcatgttactaccagatgcagcatgatcatatcccaaggcagggcgccatacggattgcaaattcctgcaccaggattgcatggtttttgcaaccctgcaactgcaactgcaagcacgagacgaacctagctagcttgctctgctttgttggttaattagtcagttagtgtttgcattaaactaattaagcgagagaaactttgctagttaatcaagtgattagccgctcatggttatcctccaaaccgtggctaattgcacggtttggcacctaaacccatcaaaagcatcaaacccttcccacatgctacagccgccaaaagcccagaggtagcaggtgcagagaacccaatggacgtgattcttttttttttttaaacatcttttgtttttaattttaaaaacattctatctataaacttattttcaaatttaaacatttttagcggggtaatgttatttcgtcacgccaaccaaacttaacaagggttttgttgtttaaccatgctagacgggatggagtgactaataggtttacggagccatcgtttagcgaaacggcatatttacaagtgaaaagtaatttgtaaataaaacttttacatacgtgttattaacgatctaaaagcaaatgctgaaaaataaactttgatgaaaaaacttaaaatcagctccaaatgttaaggttgaaaattcaaattttaactgataagtataagtataagcgaaaaaaagaggccattagatttaaaaatgagtttcttgaggttttatttcccaaaataaaaaatatgtaaaaaataataataattcaacgaactcagtacaactgcacaagaggtttatacgccatgtgtcaggtccagattcgcgggcagaaagcgacaaggcgtatatacattggcgcggccgctgttgttttgatattttcagctttcctccggcgccgcggcgtccgcgctggcgctgccccggttttggactcgcgagaagtcaacgccacatcgccacgtcacccccgttgacgcctatgggggggtcacagccgatgacgtgtcggtctagctagctactggtgcttctgcaagtggggctttggaagattcagaaaaggaggaatatactgttactgagtttgcgtcagtttgagttttcagacaaaataaaaatatcagtaggaagaacagtgagctagcagggcatccagaatatgcgtactgtgaacaattggccggacctggattataatggtaggattgatgtagaatttgatcttttgaatattttttatacatttgtttttcttctctggtataccaaatattttaacctcattgaaattaggaaatagtatgtattttcaattttaggtagtgcgaaagaaaacgacagtctatatattgattatatgagaaatatcatcattttgaggagatagaaaacgataattttcagggttaagcttgcgtgtgcgagcaattgtttttataagttggtagaataaagtatagttgcatgaaaaatttgacaatgatctggtggaaagtttctagattgcaaaaaaatgctaagaatataagtataaattgagatccttgtaccattcaatgggagcctacagctcaaatttaaaatcgtgtagggtttgaccataccaaagataatgtatattttaaatatatataggtagaaaacttttctaacagtgaaaacacttaattttgtacataagtttagtgccatgcaaagataacaaaacttatattccctgtaatcataaatatttaatgttataagataagattcggacagacattttagaaattttaccatcattttatattataaaaatttataaaatctagtttgtgatattatgatagtagcattacttttttggacaactttgcacgtacaataagtgtttgtttttgaattaaacatttgataaatatagattataaggaagttttaaaagtttaattaaattttgtcctaaacctcaaatattaataaatgaagagagtatgtaggataccctattttgtgccaatcaaaaaattataataccaaatattgaaaacataagcaaagaataaacataaaaagcaattcatcttctatttatttatcattattactaaaataaaagctaaaataaaccaccacatttactctaagggaacttgcccacccggattcaaactctagacttggcaagacgtaccagttgacagcaaggcggctatggtggcttcattaatctcaagatatgtcaacccagtttttaggatgtgctcataaatgcgataggtttaaattaaaaaaaaaactgtagaaaaccatagttattatgacacgtgacatttaaccctagttattacggttttaaagtttcataaaatcccattattgtgggttttatgcgtgaatttactcaaaaatctaagatatagtttgtataaaaaataattattaagttttttactaaagttgatagcttaattcttcaccacttttaaaaaaattgtttgagatatgctgaaattcatcaagattttaataaagatggggtttataaaacattgagaccataaaacatgtgtttgtgtgcaacatgtcttagtacatgtgattttctgtaaatttaactatagatcatgtggttttctaaaatttactatataaattataaacacatagataatcattataaaccaacagatatcttagaaaaaaaggtaatatctcaatccacaaaagttgcacattatttttatcaccaagatcaaggagaaattaaattatcttggatatttcaaaatcaaggactaaatgtaaacatgcaatcaatgagtatttaaattactccttggattctcatcaaatatttaatttatctcttcatttaagttttaaatgcataaagtctataaataggaacaacttatgtggaaaaaactaaaatatgaaatatgtctaacttttgtggatggaggaagtattattcctcatcacaagaaaaaaaaagtcaatgcattatgcttttctaaataatctagattaattcatagttggacagatatgaccgcatatcaacgttaattactgccgatttgactgttgattaggcatatcttagcactaaaccttactgaaaattcggagaattactattggagagaagaaaaggcatccatcctccttgtcttcactctgcaatgcatcatcatccgccggaaaccggaaaaccaccgaagctcgaaaaccggcggaggcaagcagcagcagcatgcagcagacgcagagccttcctcttcttccaagcaaaaaatattcagatgacgcctcctcctctttcccccctcctccacttgcttgtcttcaggcgtacttgcccgcgagactcctaccactctctgatccctatatatacaccccctcctcccctctcgtctcctcaccagaattccaagcaacgaactgcgagtgattcaagaaaaaagaaaacctgagctttcgatctcttcggagtggtttcttgttctttgaaaaagagggggattaatggcgacagccgggaaggtgatcaagtgcaaaggtccgttcttgctgttcttggagcggttcgtgagaaaattagtttgatgttttgtggggaggagaagctgattagatcgggttttggggtttttgcagcggcggtggcatgggaggccgggaagccgctgtcgatcgaggaggtggaggttgcgccgccgcaggccatggaggtccgcgtcaagatcctctacaccgccctctgccacaccgacgtctacttctgggaggccaaggtaattaatcagcatctgccatggctgagctttctcaccttctcaagcttgcaagaatgatcagtgactaactaacttggtgtgtgtgtggtttctgctttgatcttcgcaggggcaaacacctgttttccctaggatcttgggccatgaagctggagggtatgtgtaatctgaaccaaccctgtccaattcttgttcttctactacactgtttagtggttcagtctattctgttcttgtattgttttttttttgttttaaaatggcttttggtgtttagtggaatttagtgtgtacttgtacgtcataggttgtttggtttatggtattcggttactaactatagttagtgtgcacgttggggagtcctgattagtcagtggcattttcattaagttcagtaaagaaatctaccaagtgtccaattgtgcatgatattttactggtttggtataaaatcatatgaagaatcaaagaacagcgtcattgatgacatatacaacgacaattggattcctaggataatatacttttcttcatgtgctcctctatgctagtgctttattactttctctcctttgatgttttgaggtactcaaaggaaaaagacacactgaatcattatccatcttatgaactgtttaaacttgacttacttatcacttctctgctcaaatggaccccttttttttttccatttccatggaagatatatgtgtaatcctaacaatcaaattgatctaacaaaacaatttttttgctcacagcattgtggagagtgtgggagagggtgtgaccgaactcgcgccgggcgaccatgtcctcccggtgttcaccggcgagtgcaaggagtgtgatcactgcaaatcggaggagagcaacatgtgtgacctcctcaggatcaacgtcgaccgcggcgtcatgatcggcgacggcaagtcccgattcaccatcaaggggaagcccatcttccactttgttggcacatccaccttcagcgagtacaccgtcatccatgtcggctgcctcgcgaagatcaacccggaggcgcctctcgacaaggtctgcattctcagctgcggtttctctaccggtaagatgatggatggcttcatgattatgatagtagtagttttcacagtgaaatttgaaaggtctttttttttttgatgcattaagttgatgggattttgctgttcttgcaggttttggtgcaacagtgaatgtcgcgaaaccgaaaaagggccagaccgtggctattttcggtcttggagctgttggtcttgctgtaagtgacacgcacaaagatatatcatttccatttgatttgcagattgttgagatcttgaaactcaaactgatgaatgtttgtaaaattacatgattataggctatggaaggtgccaggctgtctggagcatcgaggatcattggtgtggacctgaaccctgcgaaattcgaacaaggtacaatcttttatcatctttgagtgaaaattacatgtttggtatatgttctggattgaacactgaactctgcaacttgttttcatctcttcagctaagaagtttggctgcactgacttcgtaaaccccaaggaccacagcaagccagtgcacgaggtacatcacattgcctcactaatttctcttattatcacacactgttcatgacatgaagtgtacaagcttaaacatcaactctgcaatggtgattctcaggtgctgattgagatgaccaacggtggactcgacaagggccgttgaatgcacgggcaacatcaacgccatgatatcctgcttcgaatgtgtccatgatgtcagtctctttcttacaaacatgaaacatgatagtaacaaattgaagatgatcatttcagcaatgcctccagttctgctgtaaactgtatcctgaaaactaagagtggcaatctgaaacctgaatccagggatggggcgttgcggtgctggtcggcgtgccgaccaaggatgatgtgttcaagacccacccgatgaacttcctcaacgagaagacgctcaaggggacgttcttcggtaactacaagccgcgcaccgacctgcccaacgtcgtcgagctgtacatgaagaaggtaaaaataattgcagaacagaatcagatttgcaacctgaatgtgcattgttcagaaatctatggtcagtgattccaatgagccactgattgatcactattttatgctaatgatttctggtgtttgatgtctgaaggagctggagctggagaagttcatcacgcacagcgtgccgttctcggagatcaacacggcgttcgatctcatgctcaagggggagagtctccgctgcgtcatgaggatggatgagtagagatgatgatgatctatctctctctctctctctcttgcagtttcagtgcatacaagaaaccaaaaatgaaagcaaaaaatggatgagaagtttgaggttttccatttaagtttaataatggtcgtgagacagggcttgtgtggagtcagctctgtttactccctcctttcatggcttgatcttgtttattgtcagcattgtggcttagcagattttcaccagttttaccctgtaaattagtaccattctgaaatcgtaataaactactagcagtgtgaggtactattgctggaactgaattgattgtgcagtaaagaggtgaatagcagccagtatgaaggttttacaatttgaacatcgaaacgaaatccacacgaaattcataaatttcatcgcatcttgctgaagcttaccagattctatcgattcgatctagctccaataggtcgatgggagcatctattgattttttcgacagacgaaaattttgcaagggactagctagggagttgtcgacagtttttgaggtccaaaactttcaaattttttgactacaggatttgtcatcaatggttataggggaacaatccacactagtacaaaccatgaattttagtgtccaagctgattgaacaacaagaaattggcctacatgtagaagggaaaaaaactttcaaattcaaaagtaatatgcgctcctaaaaaaattgcaaatcataattttatacaatgtaactaccctataactatcatgtaactactctgtaattagggtgtaagtgctatgtaactagggtgtaagtgttatgtaactactctataactaagatgtaagtgatatataactagggtgtaagtgatatataataaaaaagagttattgctaataagaaggtgcatggcttagcttaacgtgtgcatcatgttcgatgactgccttgcccatgcgaacttttttttaattctggccgtatatgttgcacgaatcctagagcgcatccaatggctagaaaatcgaaagttttccaaacaaaaaactgtcaacagttttttagcaaaaccgattttgcaaacatgtaaaagaatcacaaatatagataataaacagttctaaaatcatttttttcttccccgcaaaaaaaatcaattttttctatataactaagtgcaaatgcattataatcgagtgtaactacaagttaaatatacaagaataaaaatataaattttgaattaagattctgctgaaaaaattactccctccatccacaagagttagatatatttcacatttgagtatttccaaataagttattcctatttgtaatctttatacaaccaaagacttaaactgttgtgaatagaattgattgagcgagagagattgagtgagagagagaattgcacacaagaatgtagagaataaatgagcgatcctttattgataacaatggtcaacagaagacgcgatggtttgggaaccatctcgtccgttgttagaatcgccgtgaggcgagaagaggtgtggggcacaaccaaccatcgtgtcccagatttattgctgctctatccatatagatggatgagatcacccaaatatttcataacactcccccttgatcgaatccagctttgatcattgctcatttagtgttccagatatctgtaaagataatcttagaaataattatagttaaatacatcacgtaaaactcctcgaaaacccagtgggaaaaataaggagagaaccgtgatatatattattgactattttagatctatgagtaaagctcatagtttgatccaaaatagtataatgtctacagttatcatttagtaaaaaccccagtggggaaaagccaaatgacaggacatataagcttatgttgatattacctcgttaaaaactttggatgagaaaacctaaagggtaa

SEQ ID NO: 57696 - DNA, 5570 bp, Oryza sativa
tgtttttttggtttcactggttctgatgttgtctaattaatctattttttggactgttcaaatacagaaacactaatcgatggagaaccaatcataaaattgccaccaaaaacgattcagctgagcaaaatagacttctcaaaagaggagcgaactttctatatgatgcttgaagaaggttctagggaaaagttcaaggtatggccacttcaattttgcctctttttttttctatcgaaaatattgcattactatgtcaactattagatcttaaatgaaaaagcgatcggcagttatggtgcatagatagatactgtccgttctctagatactcattatttgaacttagatatgctcggttttgatttattcctaactcagttgttgctgcaaggtcttagaatagcaccatatcaatactccatacattttgttttctactcttgtcttatccgatgaacacttagctgtattgtgcccacagcaattgtgaaggttttacttttaatgaacagaagccaagtttttacatttatcttcgtaagcacaagtaggtttgctagtcaatagtttaccatgttcagtgtgattacttttctttttcaaaatatttgcagtagttcagaaatttcaatgcaaaatgtttatactccatgttcatactacaggaatatgcttctgctgggacgataagagaaaattttgcaaacattcttgtattgctgctgcgacttcggcaggcttgtgaccatcctcttcttttgaagggaaaggaaaaagatttgattgatactggttctgtagaagtggcaaacaaacttcctaaggaaacagtgataaatttgcttggacagctggaaggagactatgcaatttgttccagatgcagtgtaagcaatctaatcacatactgtacatgcaaaaaaatagtattacattatcttcgaatagtttcttttatgaaaaagcaaaataaggatatcagaacaggattgtcatgtgtgtgtgattaaacaatcagtggtttaattttatctgaactgtcatgtgtgtgtgattaaacaatcagtagtttaattttatctgaactgtttgttactccatggatactaagataactacggtaatttgatttctgcgcgttttgcaggacccacctgaggatgttgttgtagcaacatgtggtcatgttttctgttatcagtgtgtgcataagagcttaacaagtgatgagaatgtctgtccctccccttcttgtgggaagaaattaagcgctcaaacagttttttcacctggagtgttaaggttttgtatagctgataaattggagtctggtgcaacaactagtagttctgtagaagcagatggctctccatcaatctgtgaaagcagttacatatcttctaagatcagggcaaccactgacatacttaactcaatcgtgaatacacctgctctaacttggagtgatactatggaatcaagtccaagtgaagtagccccttctaaggcgatagtattctcccagtggactggcttgctggacttgctggagctttcgctggatagcagccgtataaaattcagaaggcttgatggtgcaatgtctctcaacttaagagaagcagcagtgagagaattcaacactgatccagaggtacttttctgacgcccttcatctctatcttcttttttttgatgttacatgtagatggtcaacaaatataactaaatttcattcttcaggtgagagtgatgctcatgtcacttaaggctggaaatcttggtctcaacatggtagctgcttgccatgtgattatgattgatccatggtggaacccttatgctgaggaccaggcagttgatagagcacacagaattggtcagacccgtcctgtaaccgtttcccgcttaactatcaaagacacagtggaagatcggattttagctctacaggtatcattttggctgttacattttcatttcaaaagcatgagcctttcttcttttagatggtatgcacttcattagtcgtctggatgtaggatatgaactgaacatatttaacttcatcagttaaagatgcatttctacaaaatgaaaattttccattcttgcgtatactggttagcatgtatttttttcttgaaactaatatgaggtttaccttttttacaaagtagctgaaatcatgtaggcaatttcatgcattttttttcgattctctcgattgtaagggttgttaaataattggacatgctttggagctagactggtgatcaattcattttagacagtgtcaccatgcttgtgcatgttttcttttttactctccatttttgtcaacacaacttttatgttctcttgccaggagaagaagagaaagatggtccaatctgcttttggtgaggacaaacctggcggcagtgcaactcggctcaccatagatgatctccaatatctattcggaatatgagggcagctcatgatccttttgtggagctagctggtgaattttgtcgtagcaagactgacatagtcctatcagctatagctgatgacaaagccttagcaccattaatttatgcacccgatgttcctcaccatgggtgatgccatgtcttttgaattgctctgatcattggacagagagggttagttagcttttgtaattagattatgttcgccgtcgctggaatgggatgttaggaggtcttacatcagaagcagcctttttttgtgtgtatatatatatggcatgctaattttaatgttggttctctgatggaatgcattacaaagtacaaactgttactcctatgattgtgatggggaagtctttttcgccctttaaggagatgcccttcgtttcttgcgatgttatttaaataattattaaaaaaatgtaaaaaaaaactgtcattgcaggatggattaatatgtgatatttcactgcacaagcatgcaaattcaaatttgatattttttttacaatatgtagaagtcaaatttgtgaagtgctagcgatgctgtgtaaaattttcattagacaagttctgattttgtgtaatcaagcataactactaaattcattcaagaaaatatgcatacaaaaaacaagatcataacaaaagggaatccactgcacattacacaaataggaacaccgcaacgcaaagatctcaaacgacggaaatgctgccaataattcagagacgatcgagttcatgttcagagcgcaagaatggcgccggcgccgactgcgaggcccaccaccagcttggaggcgagctcggcgccgccgccggccgccgcgccgtacgacgacgagccgcccttggacgacgacggcggcgccgtcgagttggagaccgtgatggccaccttctggcccatgctgcagtgcgacccggacgaacaggcgaagtacctcgtcccgggcttgtcgaagacgacggtggtgctgccgccggcgtccgacgagagcggggcggcgaagctgcacgccgtgtagtccgccgccgacagctcgtcgacggtgtgcggcgtcccgtacgtgaacactgcgccacattacacacgccgatcgatcagctcagacgccattgttgccagatgccaagaacggaggaggaatggagaagctcactcaccgacgctgtcgccgacggcgaccgtgttcttggacgaccagtcgccgtagttcccgccggaggcccacttgatggcccacgtcttgctgccggcggcgagctcggcgacggtggccacggccatgaacgccaccaaggccttcaacgacgacgacgacgacgacattgttgcgagctcttgcacaagctagctaggaatggaagaggctgcagagaagctagctaataccagcaatggcgcagctactgcctgaatttatatatcaagctgctggttttgcaccagctggtggttggatcgtggatgacgatgaaaattttgtatagttacctgctcgtgccatgtcccatttaatttgcaatccaactaactaagaggttgacagcattatgccaatgatatggctaatatacaagtaatttaggcaatagttagttggattaatcgcatatctgggggagttcatacatatatgatcacggcactatgactatggcaggtttgattgatcggatcgaaggagttgacaaggtatcaattcagcaattcgattatactcgctccaaaaaaaaaatccaatttctaactataaatctagaaataggatatatctaaattcatagatatatatatacatgggctatactgctatgcatctaatgagaattgtcgatcgagctggcgctcactagctacccagcaagtggtagataattaagttccatctcaaaaaaacaaaaagaaaagaaaaagtttgtatattgtttatgtattgtgcattggggacctaggaagttgttttctgctgtattcggtgtatctaacactcacaaatattactagtaattagcagtgtatgttgcattattgaaatgatcatcacaagcaatctcgatgcacgtcttggttacaaaggttgaaggctggatgttgacttgacatggtgatggtgacgaacacataaactcggaatggaactgggctagtacatatactcccttaacccaatatagaatataatatgatacatcctacctacttctatacagattcatagtactagaggatgaattacattctatactacggattaggtacttggtggtggtttaattgctttagcattctttttgggggaattcttgcataagcatcagggatatgatgacaatgttagttgactggagttgataatcgcaatttcacatataccatatgtatgcagtttacaagtaacattcacatattccttatgtgtgtgcagttatgcatacaccggctgtcaatttgaaccaaaaatggcagtttccgttttcaacaaggaggcgtacttcccttgtttccgccttcatagctcgaacacgtatgttcatatccacacctctcccccaagtacgagacaaggtctcgagaacaaaaccccccaaaccccacggcggcggcggcgagcggcggcggaagaagcagccgcaagaggcagcagctcgcgctggcggcggcatgggtgggagcagcgcaagcccgtgtgacctggacagggagttcgcgccccaaatcgcccagctcctcgccacccctcctctccaacccgcgcaggtacgttttctttttccttcccttgcccatccatcctccgggtctcaaatctatctgcttgggaattgcttgtgctgcgattattgtttttccctgtagaaaggttgggtaatcattgtcgggaatttcgttataaggaagtgatactatgatgggtatatcttactatgattggtttcagttatcttactgagaaaggaggatttctttttggtccgcatggatggttttttttagattggtgagatgagaggcgaattgtttagtttacaacagtaacggtgtagtttaatgttttatttgcagaagtacaatcttaa

SEQ ID NO: 57697 - DNA, 2726 bp, Oryza sativa
ctcagcacagtcttaacaaggttcgtctgcttttgaagtgatcctaggtatttgttcccttctattttttgtgtgaactgctccccctgaagtgtggtgtccattttgtgttttatttcagattgattgcgctgtgtgcagttattgctttcgcttcattggttctatagagttccagattggacgaagattgtattggcaaagcgttggttcaagcagtgactgcactaataggaggcattgccatgagagtgatttgggatcgagtgccagttcttctggtgcaacaaaggaaaacagtagtactttgccagaagaggtcttaggatcacttattactggtgacatgtcactgcctttcacagaccattttagtttgcctcaagttgttccttgtcgtggatgtgaggaagaacgctactgcaggtttgagtcactaaccattttacagttcacactttcttttggctgcaacacccaaagatgttaggaattttgtttgaggcataaatattttgttgatcaattcattctccatcataggttatagttgtcggtcgtgttaaaacttaaaacctaattatcttatcagaacatgtaacttgttcttgccgtcttagatagaaatgtaatcttggggtaaaaacataacttgttgattctgcatttttgtttagccaatcatgtgctgattccgactgggaaacttatcactctttgctgtgtactggatctaagactgaaccatcccagagatctgctcttcagaaattcatagaacatgcaaatggtaagtgcagtatgcagtgatcattatataccatcattacgaatttatgttgtgttcactattcattaaatgcagcatgcctagatcaattgttcctgattagtgatgattgtgattgaggttgtcagtctgttatctgctactgaccaatctttattttcagggtccaatgatatttttcttgttgctgccaaggtatgtgatagaaatatagattaatgtttagtgtactaagcactaaacatcgtgttatgtgctcatctcagattctaatattctccaaaagttttatggggatactagaactttgccattgtccatggctaatacaaaaagcattcaagcatcacacttgagttggtactgttatcactaatggctgtcagcaatctacttatcaatgcaccaggacagactattgcacaagacgagttttagtagctatatcaagaacatccccaaacaaaagattcaattgcaatttccttattgctaccaattgcagtcaatttaatatctcctgatcatgatgcatgagctcgatacaattttacatgtcaggctatcactttcactctgctgaggtacaagaaactcaaaacgcagcctgaatttcaaaataacacagatgaatcaaacttttctttgcttatggaagcatggaaaccactttcgatgggctacaaaaagaggtaaagtcatgaattcgcatgcaactattcatcccctctgataaagtagctgcgcgtatggcactaccagcagtgttattttaatgcacaatcgatagtttcttcatcaagtgtatatcaataattcaatggtactagtatatttccactcttctcatttataacagtcaataagatctctgttgcatggttgcatattttgttctctttttttggatttgttggcaagatgttattttcagctcagtgtggctttcactaccttgctctagctctacaagatcctttgagttgtttgcattgttgttccaccctaatatgtcccaaaaaaaaaaaatcttgttgcaggtggtgggactctgttgctttgcctgaggatgttgattcctgtgatgaagatacatttaggcagcaaattagggatctagcacttaccgtaattatgctgtcacatatttcattcttttgaaactatataggtattctattcacaatattgtgctctgaaacgaagctttattcactagctcgtcagttaaaatataaaaatggcacacaagaagtggttattgttttgattgaaaagtgtcccacataccaatggattgatgggcagatcattatcttctgtgtttcgcagtcattgcagcttctcaaggatgctatttttgattctgagtgtgcaccctgtatcctttttggcatatactagatcagttcatatatataaataagtagcttcccttcacattcaagtaatcaagtttcattgactcacgtaaaaaaaaacggtcaccttgacatttcctagtgttctcacttgacgtgtatggccatttaattggcatgtttgagctgaacaatctgtaagtaaatctaattatttttcatttgtatatgtgcattacatactctgtcattgtttctttccatcaacagaaataagttctgtactgcatttgatgtaataacctcaatatatttccatcttttattccagtggtttggttgttccgtctccagtggaagactatttcatacatattgatgatcttccagatgatgagaaggtattttcactggttagccttagcttttcttgtggcattgttaatctgaagtgcaacatatcccaggaggaagctgaaaaggttacaaggccatttctagatgctttaggtgaagactatgcagctccttgtgagggtatgtggagcttcttcccaagtttatctccccccaca

SEQ ID NO: 57698 - DNA, 1832 bp, Oryza sativa
tccagggaatgtactatcattggtacacgcaaattttgggttttccaaccatttcttttcacaaaagcttgcgatatgaaagaatgggaagctcccgaatcaaacaggactattgcgggtacggagttgacagagaacatacccatcacaacgtctggagcatcctgagcggtttcagcttgaatgtgattcacacgtcctcgaccaaagtggttggaagcacgagaaccttgtccacttgcttgagagctaggacgagactgagctgccgctggagtaggagttctggcagtgctgccattagcatgtcctgggctggtgttggtaggattctgaggacactgtctagcatagtgacccatctggttgcaccggaaacactgaactgctgacggtccctgtggtgacttgaaggaggtaacactgtttggcgcagtgttgccactaggggcacgctgctgtggcggaggtgccggacggttcatctgaggacgaggggcgtagcttgactggcggttagcctgagtgaccgactgatggtattgcatgggctgaccgtagcgagggcgaggtgcgcctcgggaagaatttccctgatggttagacttgcgtttcttgtattcttcggtggcctcttttctggcatcctcaagtagaagtgctttgttgatcatatgttgaaaagtggggaagtcatgagcaagcaactggagtctcattccaactgcgattcctttcaagaatttcctgatctttttcttatcggtgtctacttcctcaggggcgtaccgagccaacttgttgaactgacttaggtactcattgacactgctgtggccttgcttgagtctgttaaattcttctttcttcatgtcaatagtgctttcaggcacatgagctacacggaaagccgtagcgaactcatcccaagcaatgttagtgggttcaggatgtgcattgcagtaattctcccaccaatctgcggcaggtcctcttagctggtgagaggcgtagagcgtcttctcaacaggagtacactgcactaagttgagttttctatccacatctttcaaccaatcgtcagcctcgacgggctcgatggtctgagagaactctggtggacgtgacctcagaaagtctgtcagcttggatctattgttgcccacgtgagggtggccatttccatgcgcattatgctgaaagctggctatggctgtggttagaccttgcaagatctgtgtctgaactgccattatgtgttgcatgttgttttccacatgaggtggggaagggaggcgttcttctccagaattgtgactggcagtgcggtgagagcggtgagactgctccaactctgcttcacgggaaactgtgcgatgcgagcggctgctgcggcgaggttgctcaacctctgcgttgcgggaaacagtacggtgcgaacggttgctgtggtgagaatgctcattagctggttcgtgatttgcttctgcttcaactctaccatcttcaaaaccaaagcggactggtgcacgagctgtacgacgggggcggctagccatctaaactcccagaaaagggcggggtaagagtcagataagcacttaggagggcaaggagcaaagcaaatagcaactcagatagcacacactaggcataaactggattttttcaaatcgtaaaaacacctgatacaacgggtgtggacaagtcacagagctacgccgagcttgactgtgcgcacacctcctaggagaaccagactaccaaacaacacccacatcaaacacacacacgcactacctcgccacgactccaaaagagttggcggcgga

SEQ ID NO: 57699 - DNA, 2570 bp, Oryza sativa
aatatgggtgaagcgagtacctcatttgatccagatatcttcagtgtgaaaacaaaatggctccgggaagattgttcattcatttgggtcctacccacagacctggttcaatgtggtgaaaaaaaatttagactcactgttgatatgtagactaggtggctaacagacacatgtgaattcagataataagtgctagcttgtataaaaggtaaaccctcttatgtttctgctctctctaatatatttgagtgatagatgagagaatcatctagacatatccaaagcattgctatttcaaatataacattaaactgataatggtcaatacccttagagcaaacagttacaaggcacaagtgaatgattaaaaatgaataaagcgtatttacctgctttgggatgctttcgctagaagagaagttacgtcggcgctactaaaaacatcagcaacagtaaggtcagtgacggttgtgttcccttgtggatcatgctttatggtgtattgtttactggtagacagatcaaagttattagaccgaccaggtgctaacaaatcacgaattgtctcattgtatatttccaacattgatgcctgcacataggaaaaactctcagcaacactacatagaatgtacacttcagaatctgcattgcactatggatactaacctgcatactgtacttccatccttgagattcaagagactgacttgtcttaaaaatttgctccaaagaacgaggtatgatgcctttctgatcacgccctggtggacccatcattgtataagttttaccagaccctgtttgaccataagcaaatatgcaaacctgcatcatgcaaaaataacttaagcataccaaattgacaagtacttcaaaactgaaataaactagaaacatcagtcagagtttcaagataatggtgattatacaaatgcagaatgcaggtgatatatactagaaacatcaatgtaagatgttcacggcttttagcatgtatttgtgcttatgtggtggtgctgaagagataaaatttggggtgccaccatatcaattaaaacaactttcatttgttcttgaaataaaaaaaataaagttaggatatttgagttattagagacaggaacctcatgaacagattattcaccaatacttcattgttgtagtgaaatattcataccttgtacccatcaagtgcactttgaactagttgtgacatttccacaaacacatcttcttgtgaagcaccgtgatcgaaaactttgtcatatgagaaggaaaatctctgacctacatcaacacaaaacaataaaatgaagtctccgattaactttaccactgaaaacttagtgggggaaacatagtttctgtttagcttcaacaatgaatatgattttaccttggttcatcaaatcaataccacgcccggcagattcaactgatgttggatatgaaataagggcttcttctgcaccactagaatcgttgtcttgcaaaagtggtcggaccctacaaaacactctgatgtttcctttaagctcctgcaaatagaaaggctaatcagtaacaagtagcaatagcaagatgaaaaaatttcagtatttactcaaaaatttcttctgtcagtaaaatagagaaattgtttttagtaagaagtgctagtatgctgaaacaattaccaatattgtattgtgcagtttctttcgtagcttgtcagcttcaacaatttgaaattctgcggatgccaaacgttcttccagatcttttattatcaccttttgttcttcatatcctgtcatcgcctcaattgcagtaacatcagcaagctgcaaaagtaaacaattagatcaaatgtcatataatcatatctcacatgtaaatcagcactgacaaaatattatttctaaccttcagtttatttgttgcaactgcaagttgtttctgcaaagtttgaatctgttcttgttgcatactacatgtttcctgagcagaagcataatggtgagccaaatagttgcgcacagaaagtattgatttggttaatctgaaaccactaacctcaaaggctgacacttttacactcaagctttcacagtcttttgtagacttgcctgctagttccttgtaattagcaagctcagcactcaaggtatttacttgagaaacagactgatcacggtcttctctaatttggtgtagctcaattctaaggcaatccacttctttcataagttgttctttcattctaatggcctcttgttgagaagtctaacagaaatcaaaacaattaaatgtttaagtgaaacaagaactatactgcccaaaaaaattatcaattcacgaaaaaacacaactcaccctagaagaatccaaatggttcttcattgaattgtttaaatctttcagagaagccattgtttccatcatggcactcttctctttttgcagttttgagatgatgtccccactcttagaggcatcagcttgaagattactgttgtattgctgcaagctggtgttgtactcctgcagtcttttgttcgtgtcttggaccattttcagctagttca

SEQ ID NO: 57700 - DNA, 13095 bp, Oryza sativa
tcctgcagcccaagagaagtgcattcgaattcattacccaacttggcgtgctgggcattctctgcatccatcgtactacggagcttctcctgctcgaccaagtagccgtcctccaactcaatgtaccagcggatgcaagctctcagcttcttgatgtactcactcatctgctcagttctcccctgcacaggtccaaccaaattcaggaaacccgccccccaaaaattctcaaacagaacgaacgccaagaaatcccccaaaagaacccaccttgtagtcggtcttgctcttccccttcatcttctcggcgagcagccgctccacatcctccctcccggtgaactcgatcacaggcgccgccggcccagccccgccctcgccgccgtccaccgacgccgtgtcgctgttcgtgccaccgccattgttgattgccgagaggacattgcggcgcgggccaggcttgacccccatcccccgccgcgcgttgcccaagttctccttcttctgcaacaacaacaacaacaaccacaccccacaaatcgcaagaactaagctcccatgaatcaaccctcccccaaaataggcgatttctttccacaaaagagagaaaattaccgggtaagggctacggggcgtgagggaggaggccatgaactgggattagtggcaggattaggggttatagttagggttctctcctcctcagtggtggcggtgggtgggaggaggggagctttcttggggccggatggagtgagctcgaaggcacaagaatctctctctctcgtggcttacaagcgccgacaaagccgcgctttagatccgaaaaacctcgagaaaaaaactgcggagccgatgaaattggggaaggattcgaagtttttgaagccaccgagcggagattaccctcgatttttcatggatttctcgcctcgctcggatctgagcgagagatgtgtgggagaagagagagagagaggaaggagaagaagaggacgaggcggccgagctatttcgaaatattttgaacgctgacgcatcaggggtacccaccccacccctccgatttcgatttatttacacccaatgccactggtgttagtttaaagcccaagccggcggtgaccaggtctaagtggctggccggctcgggcagggtcattcgcgtaatatgattggttagtcaggggtattttcggtatttctgttgaacggtcaacttcgatgttgtgggcttcgagattcgcgtcgccttgggccttgctgataatgggccgggccgggccggggcatgttgcgacgttgctctcctcgttttctttgtccttttcgggaatcaacagcttagaggtgccacgtcttgttattaagcttttgacagctttttcttcctgaaatctcaacgaatagttaagctagcttgtcagtcacctcgcgcactggaacctgagaatgatcggacaatcgacgcgatgctaattagaaatttgctgtttgttagtattagtaaattggtgtctcgtctcgtcaagttgcgagattaggtcttaattgccttgtgccttaccggtttaggttgcgttcggtagagcgtattcaaatcttatttgtcttacgcaatacgagaagatcattagtttataattaattaaatacttaattattatagtttctttaaaagactattttaaaaatatatatagagaagttttttacaaacagtataaaaagcgtgtcatcataagccaacagacagtaactgaaaagagcttaggctcccattggttcctctatatagaattaaccgctgtcaaaatttaaattttagagtttattttaatttttttcattgaacatatctctactattataaaaatttaagatgtttttatcggtattttggtacgtcatatgtgtatacgtcagtttttaagtttgtttgcttttaaaaatatgtatccgtatttgattcggtttttaaaatcgtccacttttggtaatacagaagaaatcatataagaaatttgttttaaaaaacttgcatgctaacttgagatgattagactcctaaatatagctcatgattttctaaaaatatataaagcgaactctcacagtgaatttcattttaactaaaacatataacaataataagattaaaatcgacttcacccgttgtaacgtacgggcatttttttctagtatatagaaaaatttaacctataaactattcttttctaacgcgccgtacgacgtattttcgacaattggcccacagacgagggccttaaagatggatttgtgaagggggtttggtgtaatgatgcttggcgtacgttgtcagctagccatttactatttctggtgctttattagttgggggaaaagagcatgaccgctgctgtcccctctcaaagctcctgagttttttcgccttaaaaccacgtttcgtccttgccaaacgtggtccactgaagtgccagtgctttgttgtttgagtaatcgagttataattggtacagtatctgcgagcttaatacagatgtcaccgctgttctggattgcaatcctgttttgattagggagtgtattgattaccttgtactcctacataatggcaccgatagtggcctagcgatgcccagtgatgcgttctcttgcagttcacgcaaaacgtgacaatggtatagtcgatgttagaccggtgtacctcttgccaagatgtatgtacagtagaacgccgtaccagactaccagtttctgctagctaagcgtacgtttctgattaatgatagattctagaaaaagaaaacaggtcccatatcgatcaagcgggctgatttaatactccctccttctcaaaatgtttccgttgacttttttaaatatgtttgtacatgactccatagaacgatgacgacgacgtctgtgctgcaaccagaaaaatacaagagaagaaacagaggaaaataatggccttcgttttctttttcagaaagcggctcgtagtactgtattttagtataatgtatgtacatgtcccagccgacactgctgcgtatacacggtagcggaagattgacggatcgatcggtcgcgggaaggtgacgcggcgcgcgcatgtaagctcgggcgtcgctagctgccgatcgatcggtcgccgtcgatcgccggagcgggggcagacacagggcgctgctgcgtgacggcgacccggggcatgatcgagtcactcgttcgctcgccaccaaacctggctttgtcacggacgggggcgtcggaaaggaccacgcgaccgtgggggaagagcagaatgaattatgtgcgcgcgcagggcgtgccgccgaaaacgaccgcgcagccgtcgcgcgtcgccgcttgccggtgccgcgcgtggcgggtgggtggggaggagacgctgcgtgatgtcgcgcttgcgccccccgtcgcacggttgaggtcgtgattttcgcgcgatctcacggagaagtcgtcgtgtcgtctcctacgtacgcgcgacgccggcgggggaagcgctggtccggtgggccggctagccgcgaacgattactagccaactgggcctcgtggttcgcgagaggaagaaggccttctttgtttaggcctatgagctggaaagtctaagctcttaaggtgtgtttagttgagctctggctttgaaaaaaatatctgtgggctgtagttttcttaaacgattttgctatatctcactcgaaaatttttttcttatctctcactcgattttctcattcaaatttacagtgcattttcttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatataaagattaaaaatctgtgtgatacgattataaaaatctttcgaaagatgtataggtactcccttcttaaaagtagctggggaatatgtacggtggcttttggaaaagctcatttggttcaatagctgtggcttttgaaataactagtcccgctgacagcgacccccacatgtcatacacacgttgaaataaaagaagagggagagatggatatggcaacggcggtgtcgtcggcctcagcggtggcagcggcgtctcggcgaggaggagcggtagcggcggttcagcgacgaagaggacgcacggtggtgaggagcggtggcgccaggaggatgaggcagtggtgacgccaccgctgtcggccacctcaccaccttcgtctcccacctccatggccgacgagcgaaggggcggcggcgtcgggaggaggaggcgtcggtcggggaagggcgggagcggcgctggcgtcgcgttgaccggcgtctgttgaggaagggcgggggcggcatcgatcagggaaggacgggagctgcgccggcgtcgggttgggcgtcgtcggttggggaagggcgggggctgcgccgacatcaggttgggcggcgtcggttggggaagggcgggggcggcgccgatggcggacacccaatgcgcccgatggccgacgctcgccccatgaagtcacgactcgcgagaaggaggagacgaggaaaagaatatcggaccgttttttcataatggcagaggtgggtaatttttccctcaaaagcacttggagcaaaagcacttatgcttttgggtcctttggttgactcttgacttttgcaaaaggaaaagcaggttgaaaagtccaaccaaacacacccctagtgtatatttatagttaactattgtataaattaactattagattgactatagattatttgaagcttatagtaggctcttaaccttatgagctggaaagtctaagcttaacaaatatgcagttctttcgtttgtactcatcatcaaaaattatgttgaagaagtttttttttcttacgctagatagagttatgaccctactattaaacttagtacttcaatccattagcctataaatcatataaactaaaaaggcgacttaaaaatccaagaaaaaattccctaaataaagaggctctaagtatatttttcttccctcatctcttgcttctaattgaattgtctccttcaatagtaaaattcggatataataagtttgatcacggttaatttaacacatcagtagaaaatcgattttcaaaccatcaaaggagtcgatttataccggtttttgaagttggagagtgcgatatacccggttttgcggttgattgatgcaatttgaccgaggtctttcaaattagacttattttctttgctagagggaggaaaaatgggccttactggtccaaatttagctagattaatgggccggacgtgtactgtaactggccagcccagtcactcgcatcgtcgactacctcttgccatcggttctcccgggaagttttgcggcggcctagggttttagcattctcacctcagcggcggcggcggcgggggacaccggattttccgctccgatgcctcgtcagcacgcgccggcgttcacgccggaggcggcgtcggcgtcggccaccggcggggccggggagcggcagagcctcccggcgctgcaggcgaagatgaagcgcgacccggaggggtacgaggaggagctccgccagctgcggcgccacttcgagtcatcggtgttcctcttccggcagcaggcggcactggcctccacgtcctcgtccggcggcggaggggaggtggccaaggagctcggcgacctcgcgctgttcctcgcccacgtcgcgcccttctacccggacgacctcgctgacttgcccgaccagattggtggcctgcttgacaccaacgcgcgcgcgctgccgtccgggctccgtgtgcacctcgtgcaggcgctgatactactggtgaatcggaaggtgacgcctgtttagttcatctgttcatttcacattaagttaaattttgttcaaatcgtgtggattggaacgggattatcgtatgactgtagagtaaattctcctcgtatacattgctttttgatgtttagattgttgatctggaggacacaatggagttatttatggagcttcaagttataggggaccgggctgtcaaaaaactagcattctcacatattgtacacagtatcaggagaatgaatcagacccacaagaatgaagccaggaatcgtaaactgcaaaacatccttttcacattcctacaggtttgtgacataccactataccacacttgcactgattagtattatcgggtttaacatagtggcaagaatacattcatgattctcttcctacctcgtttagttatgcatcttgcttcgctgtttcccagggcgaggaagagtcgagagcaaagagggcctttactattctatgtgatcttcaccgtcggagggtctggtttgatgaccgcacagcaaatgctatatgcaatgcttgtttccatggttcttctaggtacatactgccagcatctttgtgtttattaataggtgttgatctaaaatatatcttttacatgcagaattatgatagccgctatttcattccttcttgggtatgaaaacgttgagcaagaagatgatagtgatgcatccagcagtgaagatgaagctcaaaaccctcaaattattcttagtaaagaggatgtttacaaggttatttgaatttttaccattatttcgatttatagtgttttacatcttttttctgttacgtgccttctgatataatgtattttattgtcatattactttctcaggcaaatcacaagggcactgctgctactaagaaaaagaagaaagctaaattgcagcgtgtgattcgtagtatgaaaaggcaacaacgtaaatccactgaggacactggctccaattattattcaccactgacgtatttaaaggatcctcaggtgggaaatggtgtaatcccataattgttcagagtgttatcatttacatattgactgttatattgaagctttcgttttttggctgacagggttttgctgagaagctcttctctcggctccagaaatgcaatgagcggtttgaggttggccccattccttgttctgaagattccttgttctgtaaagatttaaaaagttatatataattgtcagaactatcattacttagtacttttagctttctgctgaagttttatacatgagtgtatatagttggaaccagcattcaagtaggagaattggaacccagatgtgcaatagtttattttttaaacacaatgtctgttgtgagttccatccgatggttaaacgaaaataaacgttaattcaaatttagagaatgttggttgggtgcttgcaggtaaggatgatgatgttaaaggttatagcgaggactattgggctgcatcacttggttttgttgaacttctatccatatcttcaaagatacgttcaggtatgttcttaacttggcatgtgttcttcttgtagcaaccttatggtagatataatgtttatctatactctatactaatataaaagatggtagtggtggtggacccacggactgtgagttgcgtatctcttagcccccacatgccatagatcccgtcgaaaggaaaatatgacaatagaatattatgaaaattttcatctttacgaaatgacagcaaaattagcataatgataatataatagacaattagaaaaaaaaaccgttgcacctcacgtgcattatactagttcatactagttttgataataagttttctacctttctgtgatgcagcctcatcaacgagatgtaacaactttacttgctgcagcagtacaggcttgccatgatatggttgaaacacttttgctcttctcctatatttcactacttatatcatttcttttgctttgtccaaattcagctaaattaatatgcttcaatttcaggtgcctcctgatgcagttgaaccactgtttaagcagatagtaaatcaatttgtgcatgatcgttctcgcccagaggtttgcataacactcatcacatatctaatatatttaagtattttccaactaacatggcatatttctaaccaatctcattttaggctattgctgttggcttgaatgttgtgcgagagatctgcatgagaatacctttggtacttaccttgctcaaatctgtactcttgctttctagtgctactgacctctgaccagacaccccttaaatttgtgtgatggattcattaaatttttatggtggtcatgttttgttgtacctaattcctgtgccctggacatgctctagtagaaattgtgatttcatttttttactagtcttaaatgactggttgcgtagtccaaactccaaaaggatgtgatagtcgattgctacaggttttaagcatataagtgtaacttaatgaagaattgaaaaggtataaacatggttttaccaggccacatttagtcttgtgtagcctgacacgttagtcacttatgcatgagaagttgagaacacacatgcaggtttgtatactacattaccacctgaggtactgtgcgggttgtaagatatttaggaagatattcttggtctatttattttattcatctagcaggcctctgttaatccttctgttatacctgcagttgatgaatgaagatctactccaggaccttgttttatacaaaaagtcccatgaaaaagctgtttccattgccgctcgttctctaattactttattccgggaggtcagttcttatccttttgcatattctgtgatttctttttgttcacttcagctaaaccttcttttggtttgggttcagatctgtccttctctgctagtcaagaaagatcgtgggcgtcctgctgatccgaaggctcgaccaaaagcattcggcgaagcaactatcgcttctgatgtgcctggagctgagttgctagatgaagatttttcatcagaaggggaaggctcagacgatgagtctgatgcttttgattctaatgatgagaaagagttgcaatctgctcgtggtactaaacaaaatttggatggttcgtctgaagcaaacaagcttgacacagatgaaggtatgaaagaggaagatcaactatctggggatgaagatgatacagaggaactagatgaggatcaagacatctctgacaatgatagtgaagaaaatgatgatgagctagaattggactctgatatggatgaggagaatgatgtatctgaatctgatgatgatgaggaactcagtgagaaattggatgattctgatgaaggctctgatcaggatgatgacagtgaccaggatgataagtcaaaaaacagcagtcgcaaggcaaataagagaaagttgagtgattatatagggcaacttaatgctgcagatgcaagccttcgagctctgaagaagttggcaggagccaagaaggctgaagcttcgtgcgatgaagctggtaaaatcttatctgatgaagattttaagcgtattaaggagctaaaggtatgggagttttttccagctgtagttcatgctgtggagctttcttttgggaaagaaagtgaagttgtgtatatctgacattgttatgagtttcaggcaaaaaaagaagcaaaactggctctggcacaacatggactcggcaagggccatgacacaaaatcagtaacctttaaaatgccttcttctgatcagcttagtctgaaacgggttgacccatccaagcttgaggtgcattttctctcttcccctcccgcattgcactcgtgccagcgcgctcatgcacacacatccacactttgcttatatgaacatcttcctttatgtaggctcacataaagagaaagcttacgaaagaggagagattagaaatggtgaaggctggaagagaggatagaggaaaataccaagcaagaacagctgtgaaacagaaaaaggtattcgtttatatgatcctcctttttggtgcttattttgacctatgttggctatatggcacaaccttgtgaaatctgatcatgaattgttctttcgtagttgcttttattccttctctacttatatgcttctcattgcgttttagaccggtggcttgagcaataggcagaaacaacacaagaagaaaatgcccctcgctgcaagcagagcgaaggcagcgcgttctcgacaggagaagaaaaaactgcaaaagcgctcgggaaagcaattcagaggacggaaggcgtggaaatgagggattttttgtacttgcgtttgccaattcttgtggtctactggccaaaattttgactccttcagttaatgattttcgtatacaaatatggtttcacaaaccgtgtatcatcgatttttcaagtgctggtgtattcttttgtgagtggagagaatgaagccggtatatcatcgctcacagtggttgctctatgaatttggacagtactcgtatccagaaggttcagcatcacgtgtcctcctggcccagtgtctatacgttgcagtgactccagcgagagccacaattacgatatgataaatgctgtctctgtttctgctttgatgagactgtttcgattaggccagcaacctcacctctcctatataggctgtgtttatttcagcgtaaattttggattttggttaaaattagagatgatgtggctgaaaagttatgtgtatgacaggttgacgtgatgaaaaagaattgaagtttagatccaaactttggatctatacacacagacggattcagatcatgcgcagttatagctattactgcaacttatattctgtgctacagtatttatgctacagtacgatgaatagtgcacctcgctgatctggaccgttccatctacatccgttgatgaaaactggtaccgcctaaattgcagtcccagtagcgactgcagctgatccggattcaacacggacatagtacaccctcttgttgcttcgatgagactggtccttagcacaatcatcaaaccactaccattatatcagtgcttggtgttctattgggttaaggaattctcgatcgttctctgctagtaggaaatcgagccgactgaccagcgatgtcggcggttgagaggaagacggcgtgcgtcaccggcggcaacgggtacatcgcttcggcgctcatcaagatgctgctgcagaagggatgtgctgtcaacacgacagtcagaaaccccggtgagattcttcttcttcagttcataatttcgtgcatactcgtgcatagatttgcagtagcatcagtggttttaacctcgtttttcttttctttttttttttaaaaaggaatttggttttagcctctgaaactgctgctacacattgcaattttgagtcgcagaaaacatggagaagaactcccacttcaaggacttgcacgcacttggtcccctggcggtcttccgcgccgacttggaggaggaaggcagcttcgacgaggcggtcgccggctgtgattacgccttcctcgtcgctgctccggtgaacctcaagtcagagaaccctcaggtattacatagccgtctacaacaatttgattaagtttatagaaaatttaataatatttataacatcaaattagtttcattaaaaataactttgaatgtatttagatggtatgtttgttatatgtgagaaatgttctgtattttttttatgaacttatcataataaaacataattagaaaagagttaaatcatcttatagtataaaacggaggaaggggaaacatattttaagattatctttatggatttagctagatggtggttgccactcctcaagtctcttatggttgccaggccattaatgatactaagtattcctccataaaaatgtctctttgcacttcactcttcattgttggcttatgcttacatttacaagctaacatttaaaatttagaacttaattttaagtttgatctttttctcatcatagtttatttttatttactaataagcgatttaaataagcgaaacaatgctactttctgttgcgatgacacagacacatacacagaatcacatacacgcactccttctgtctcatagaaaccaatcagtactagatgtgacatatcctaatactatgaatctgaatatatctctatccagattcgttatactaaatgtatcataatcagttatagattttttttttgtacgaagggagtagttttgttttttacttggtcagcctgatggtaatgacagaaagaactggtggaagccggtgtacgaggcactctgaacgtgatgaggtcgtgcgtgagagccggcacggtgaggcgcgtggtcctcacatcgtcggcggccgccgtctccggcaggccgctgcaaggcgacggccatgtcctcgacgagtcgtcatggtccgacgtcgactacctcagctcaccagccaacaagacatctcccggaaaggtacacacaaaattacagattttatttaacacaggtcagtcaatcagaggctcagagcccattaaatcggccacatgagaacagctccgtgtgctgatgcaatcagcgtttacaatttcggttcgaaatttccggcaagcatttacttcatccaaatatttcatattttttttaatttagaaaaaaatatttaaattcggtcaagatttgtttaaatttcaaacttttttgggtccctgatagatttgtgcatatcgaaaatattaagacatggatgcaatgcaggcgtactcgctttcgaaggttctttcagagaaggaagcgagcagggtcgcggaggagaacggcatcagcctggtgaccgtttgcccggtggtcaccgttggcccggcgccggcagcggaggccaaaccgtgcgtcgccgccgtcctctccttgctctccggtgataactaatcgaatcaagaaccggccggtccatggcaaatgcggcaacgaaaagcaattcctgtgaaatttatttgttcatctcttgattttctttcaggcgaccag

SEQ ID NO: 57701 - DNA, 3230 bp, Oryza sativa
ccattgttagactttgctctaggatcacctaggttagatctagtcgggtggttctatttgggtttgatgaacgacattgtagatgaaagggagagggtttagataccgcccggttgaggagttcgtggaggaagaggcgccggacatcgtcgttgtcgtcgcggcttgacgtggatgcggcgccggtgaggtcgacggtgatgacggctgcggcagtggtggtcgtagacgtcccggcgatgaggcgtggcgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgtgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgattccatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggttgttgtagctcctcctctggtgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactcttcctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccaatgcttctgatcgctctttaatcggataaat

SEQ ID NO: 57702 - DNA, 9671 bp, Oryza sativa
tcgcaacacagcaagaccaatacatgcattattatgccatagttcacatttgccacttccaaagcggcaatcatatccatcaaaatccaactttgatacacttattaagttcctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaaatcaggacaatctttcttgtagtgtcctgtcttcttgcagtggagacattgatctttctcaacagcgaactgttgttgttgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaatttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcaagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcaacgacggccggcgacgaggtaagaattagggttagggtttttggttcttttgatccgtgcggatcttgtgcttttctttctttggatttctttccccgaaacgatctaaacactagggttgctctgataccattgttaaactttgcactaggatcacctaggttagatctagtcgggtggttctatttgggtttgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcgggagtgacggtcgtagatgtcccggcgatgaggtctggcgcggcggtggcgcttcccgtcactggctgcgccccctctcgatcggattagggtttgtagggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaggcattggtaagttgatttggtgggcaaaagagttggatcggagtgctccaatctaacacagctcagccttcagagattaagaccacagcacattctataagagactaagaacagctcatacaaaagcatggagtatttttcctgtatggttcagaaaatgatcaatcggagtgctcttttttttgtcaaaatggtaacacatatacaacacaacaatttactaattacatataattaatgaataaaaataaataattgaaatgattaacttttcttttctctacggagaacatcggagagcaaagcacatgaaggatctcttctgcctatttaccttgtatttgtttgtcagtaatatgctggcagctccgttcctgaagatccatgagctgagcatagtggcttgcccctcccaacattagcatgtatcatgaagtctagccgtctgtttacctgtatgctgaaaaacaccaaataatttgtgtaagaagattctgctaaacttgttttaatcctaagctggccactttgacctttctttggagctcagttttggacaatgaagtagtggcatactgacatgcttaaagtacaggaacagaaaaatgaatagaatctcattcgcaggagaggatgagagctccttagtaattgtaacttctttcaccaatcaaaagtttagaacatgatttctctaaaaaaaagtttagaacattgaaagccctaatggaaggaagctattaatgtgagaattcatcctaataaaacatcaatgttgccagggaatcaacaggtttcagggaagctcaccagttcatgttttgcctcatgacatcacatcgactctctttccataagaggaattggcgcagagttcgaattatcagaaggcaacatttaaaaaagaaatagagagagaaatctggaggcaccaatattcggaaatgtgctgggttctatctgaatctttgaacgaacttcccaaacaaacatctgataaatttagcctaaattcagaacattatcttcaatttatgctagatgagagataagagaagggaaaccgtaccggaggaggacaggtagaccgtacgccgatttctgccattgaggaaatggttgtgtcagctagcaacaccgtcgggcaagtcgctgaggaagaattgaaagatccactccccgcccgccatctgtgctagcagtgagccaccgagtcgaccttgatgccgaagaagaaggcgacgctgcgatgccatgcggcacgccgatgctgaggacgggatggggagtatgtgatgctattcaagcttgttgtacgtgcagccacagtgaagaacataaaggggaacaaacaaattgggaagagatgcggatgcggagaggacgacgacgagcggatgccgagaagtggaagggggcaacgcggatggctcggcgagcagtaaaaccacgtctcggtaagggttggccgcgcaacctagaaggcagaaaacaaaaatcaaaatcaatgagcataggcatggtcagaagaacatcgacatcacaatggtgaaatccagagcgaagcacaactgaaaaagatcaaagcatacgggatgatgcgactagggaaagtaccgtctccacaaaaaacaggaactaagaggaagaagtaaggaacagaaccagcttcgaatgaaagaaagaaaggagcgatgcaggtaccctcgatctgctcctcatgggggtctccgcgcgtatttttagtggagcagccaaccctgtcattcccgtacaccatgacagagcactaccatggatgagagaggggctgctgggcattggagccttggaggtgtcgctgtctcgctgatggccgacacgcggcggtgccgattcgctgaagcggagcggacgagaaacacagccttcgctcaatcctagccggacatgggttggagaatgggcacgcgtcaagacggtagcggtggctcgcggatggctgagcatacagccaaaccacgacgacgcaaggccgcgccaccgatgccacgatggccagtaaaaggccgtcggtcgctgggccaaacaatcagctggcccatggtagcaggaccactgtaacgaaacaacgtgtccacaccgtattggatgcgcctctccaaatcgctaggagagcagctaatctagcacctttaaggcctccttcaatggttgagctagtgcactagctcatgcttgtccacctcatacaagagatagcaaaaagcctacctttttaataggttgtctcatagcacattgttcaaaatgctttgggttccacaacccctctcatattttgtttaggagcttagctcttgaagaagagatagtgcactctctctccttatcttctctctcttctacatcatacaaaagctgatgtggagatttatgagctagctgactcatccttgttggaggaggcctaagatagctaatccagcacctttaagatatttaatatatgtgtcagatcattttcttccggatcacttattttaaactacttcatctatctcaaaatattactaggattcatttggaagtatcctccatgttaggacagaggaagtcattattaaatttattttttaaaatatttaatttattcctatatgcaagtatatgctcctatccgttgcataatccgttcaatgactatatccgtctcaaaatacagtaacttttagctatgaattctaaaaatgattatattttagaacggaggaagtagtaaatctattttcttaaataaaaaaaaaaggaaaagcgagaatgagagaggtgcccccactatgcgattgccagctagcccatcacaagaagatcagaggccttcggacgcggctttttccggcgttccgccaccagtcttctcatctgcgactgcggcgctccccttccctaccggaatccccggttttgctgccccccagcccgcggagtggtcggatccttcttccgtatgcgtgcgtggtgtgcgtggagtttggttgtcgggttcaggttaaaaccctctgtagtttccatctccttttaccacttcccacatgctcgaatcgaagtaaatcgtgtgtagtagttttgagtagaatggcgctatgctatgctatgctacgctatgctacatcgtgtacttccaattgattcacagctcgcacgcttcaatctttgtagatcagtggtctgtttcactgctgtgagaaattgcgtgtggttttgcaattcatcggtgcttttttcccccttcttctaggttttgtgtatctaccgtctacagtcaccatggttggcagctaatgggggattggaatataaatctctttttggtagttctttttttgtatgattgattttggcatgtctgtttgccatcaccttttttttttaattaggaccaccaatggatagggttgttggtattaaactcgcaccatatcaaatcatcatgttatctttctttttcaagtattctggactcgtggcctgcttgaaggaacaagggaacttctagagggtttcctctctcaaaaagctgttttttttttcataagtgagagcagttaaaccccaaatcttgttgaaacgattaaacttgccaaagctctcctagagactggattaatttctcatggttctgttcagtatcaaagtcttcaactaaaccgtaacactgaacttgagattttttattttttatttatttttctgagtaagagatattttatatgaagttactatgatgtccatcaaatttgaacacatccagacttgtaaatttcttggtctcgtctctacttttagttaacgcagaaaatgacaattcacagttattacttgctttgcaggaattctaggaatggcagcaaactaatcttctaacctcaggcagtccatgtttttgaggtgattctgtgacatgtgtgctaccttaagtaaaacaagctacgttttcccttccgtatggatctcctaatttgttcacttggtagctttaaactggatgttattgcaaggttgccacatgcaaaacttattactctagagcgggagaatacaaacttattgttctttgttattcgattattgcaataagaaatatatggaaattgcagtaggtgcgctctgcaaaatgatgatactttatgatatatccgatttcaaggagctaggaacacaaaaacatcgctttgtaatttaccatctccaatatgttctaacatccacaatttgttgtattgctaataaattgaccagctcatgtagaatacgttaccatttcagagctagtacccacctgataagcattccttttccactaggagataagctctctattaatttgctaccctttctgcatcacggcccttattcccgttgggcatatcttttatgtggttgatataagctcatagcttttgaagtactgcataggatactgactccagaagaaactaccagccaaaataaggcaggacccaccagctttagaatataaatccccatgcttatctaatcttcaggaggattgccacttctctttcctgtagacagtctgtgataattttgttctcttcttgttggggtcttggggaaaggagcaaggaggaggaggagaccaagaacacggagtgaaagggagagggttctgttcttgcttcttaggccatatggagatccagcagcagaagggggttggcaattccaaagttgtgaaggttgagaaggaggagtcatgggatctgttcgtcaatcaagcaagcaacgaaggccaccctgtgggttttttcttccttgccttgttcttcccccacctctttttttttcgccgggcttcccccacatctttcctgctttgtctctcatgatgaatattgatgttgtttattctcaagtcatattttggtcggcccacgatttttgtaattgctgtttgtagattataattttgttagaacgatatatgtataatagtttgtggggatggatgcttcatgcaacctgatttctgtaatcatgttcttttcgttctttctgggtctttctcgtttttctttcactgtaactgtaattgacaaactgagttccaaattgaaaattttcctgatgataattatccgctgcagttgcaccagaaatttctttttactcactcagaagttaacttggttattgacccctcgactttgtgtaggttgttgcccactttggggcttcatggtgtgtgacttcgctgtccatgaactacaagtttgaggagctagctcagacacaccctgagatactgttcctctatgtggatgttgatgatgtccaggtaaccattctctctgttttttttttaaagaaggaaaccattctcctatttttggtctcatgacgtgttgtttatgcatgtatttttggaatacatcccatggtcgtattttctctgagttgttctgaattctgaaagcgaagtgtcttttgaggaatagaaagtagagaaagtggatgcctaaactgataatttcacatagagttgtctagaaaatgtccttagacttcggagctttcatctttgatgttcaattgtttctactgaatatcatggcataaccatttgttacaaaactgctatgcatatatgctcattaaattagtttactgagccaagctgctatatcatataccgtgtgcatgcagagtgtttcgtccaagcttggagtgaaggccatgccgacattttttctcatcaaggacaaggaggtggtgaacaagattgttggtgccaacccagatgaggtcaagaagatggtggacgcttctgctgagtcctttggagttactgctcctcctgatatagtggtggaatagatatatagatgttgcctttatcttcagaaacttctctgtgaccgtgggtgcttcttggtcaggtccggaaaaatgcgtccatgtgtacattctagctttgctcctgtgactctgaatggtgtccctttgaactgataggcttgtgccttgcggtagtttgttctgcaggctgcagctgtggctttaccatgctctatgaaatttacttacatgtgtttccagttgaaaaatatgtggttcagacttcagagtttagactaaaaagatttgttgacagtatctggcatgcctagtagtgctttgccttttcacttcacatgatgatggatggtgtagttccaaagcgtactctgacgatgagctataaaaattgccatgatctctgcagccaccgcagaaagtgcacatccccaggtgtaagcaagtgtcacgagcagctgatttattcattgtaaaatctgcagatcatgttagtaggttgtaccgttatcttgctgttgcagggtactactaattaatgattagcttagcaaaagctctgcatttcaatcaaaagaatttgcatcataaaaggctctaacctaaagctgcatacctaaccacacctaggaatgaacaaaaaatgcaagctggtctttggcccagtgcaacatgtgaccaactatggacatgccactggttgtcttgaggccttccttcatctttgtgctccactattcaatcatccaaaatgagagtattaaaagctaaggggaaaaaagggcaaaagagaaataaaagtaagagaattattggaccaacaccatggaccctcaccacataacctgcaccatccaattctctgaagacccactgtagcattattctgaacttgtacacttcatttatcatcttgtcccagactccagttaattaccttcaatcaattactacctttttactagatgtgtcg

SEQ ID NO: 57703 - DNA, 2625 bp, Oryza sativa
gcaatgtgctgctacgtggggaaggcgaccaagatcttcctgtgcctcgcggcggcgctcatcgtagtgggcctcgtcctgggcttcgggctggcccaccggacgtggggcgagcggaaggtccagccggactgccggtggcccgactgccagctccagccggcctacggcggcggcggcggcggcggcgaccctctcccggccacctccggcgccggcacacgccgcccggcgtcccgctgacggagccggccgtggccgcgttccccggcgtcgcctctgcttcgtcggccgcgccgccgacggcgagcatgccgtaccttgggccgcccagcccgttcgcagtgggcctcgccccggcccatgggtgaaagcaagtcgcttcggagtatattttttttcttcttttttttttctgttgtatttttcttcttctgaatttgaaatactatgatggctgtgaattatttctacagttttgagtttctgcattttaagctggtctagccttctgtgccgttgatgatcattttggttggatataaataacgattttgattccaagtgttcttcggttcatgtgtttagggcttgtttagttggcaaaaaattttatccatgcatgtcacatcggttatacaaatacacatttgaagtattaaacgtagtctaataacaaaataaattataaattacgagacaaatttattaagcctaattaatcagtcaatagtaaatgtttactgtagcaccacattgtcaaatcatggcgcaattaggcttaaaagattcatctcgcattttcctaatgaactgtgtaattggtttttgtttttgtctatatttaatactccatgcatgtgtcgaaacattcgatgtgtcagcgtgaaaatttttgtttaaaaactaaacatacccttagtgctcatctttgaagacctgtagtagtccgtgcaaaataagtatattagggtgtgtttggttccacgtcaaaattagaagtttgactaaaattgaaagattgaagaaaaaaattgaaagtttatgagtgtagaaaatttttgatgtgatggaaaagctagaagtttcaagagaaagttgagaactaaacaagggcttattactctaatcctctcttgttttatattgtttttaataatcctcgtggctgtttatatctgcttagttgcaagttgcagcacagcaaaaaatcgatcagtaaaccaggaccgtccgatgttaatgcccaattaactaagatcatgggcgttgataatgatggttagtccgaatgctattgctaacaagagatttttctttgaacggtaacaagataattttaccgttgcaattacttattcgtttcctcctttcaaaatatcagtcgatttttcaggggttgacagcccccgttgcaacgcccaatagccactgacaggtggggccatctgaatttccgaggaatttcttccgaaaccgcatcatactttgcgttgagaaaaaaacaatttaaaacacacacgacccgtttccttccaacacaaggcacctccacgacgatttcaagccgcgaaccaatcgaaatttccaccctttcccgctcgcccgcgcccactgacacgtggggcccggcacgtgggccccacgcgtcagccacacacgagcgcgcccccggagaaaccggcgacgccttgataagtcccaggtttcccactcgtctttgcgagagagagtttttccgattcggccgccgcgcggccgtcacgaaccagataaaatctccacgcagttcccctcaaaaagaaatttggttgattttgatttgatttgattcgtgtgctccccgccgccttcgatccctccaacggataatcgccgccgacgacgacgattcggaggaggtaacttctttactactctctcttgcaagactggtttctttctttggggttattagcggttttggttcaaatggatggaatgcttttgtgagatgttttgtttcggggaggtgtgagagggttgttgcgatttgcgggagattttgattgcggcggatcatttttgaggaggagaaggcggtggctttgggcggatttcgcttaggtagggttttggtggattgggcggttttggggggaagttttaagcgatcgtgggcttgattagggttgtgcattcctgtagtcgaattgtttgattgttgtggagttggctttgccgttccttgtcgaaggcgatgcttgcgtgatggcacactcagttcatgttgtgacaattcttccttctttcaaaattttggcccttggattaatagttaatctttcatttgtgattttctttgaatagggtgctgcattttgatcaatacacttagcctaggaatgcattagtgtttacttccttaaatagttttatgtatcagtttattgcacatcactgtgcctggtttaggcaaatattgttcttgatgtaaaaaagtgttttttttaaaaaaatatttttaggtgttatttgcaacccttgtatgcaccaagttgaaattgtatttcctatctgggctattgcagtgccccttgaagaattaaaccacagttactgctgcaaattactgaatgcatcatt

SEQ ID NO: 57704 - DNA, 724 bp, Oryza sativa
gggcgacggccgtcaacgaaatttgtaggcggcccccttgccgccctccgctagggcgattttgtactgtgcggggggccgcctgcaaatgggcggcgagggggcatggaattttgcaggcggcccccttgccgcctgggggagggcgatttttgcctcccccctataaagcccagtccctcctctctgaaatttcattatattcactaaaaatccaaaaaaaacgaaagagagagaggggagggcagcagaaggggagcggcgaagccctgctggttcgctcacttcatcacaggtatgctcccatacatcttttacatttgtactaatatgttatgtttgagtatatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacattttagatagttcacggtgaaggaaatattagatttggtccagatggtgttgatctgtcagattttgtaatgacatctaagggcatcgataggcctgcgga

SEQ ID NO: 57705 - DNA, 782 bp, Oryza sativa
ctcgccatctcacctcaccgacaaggaaggtagtgaattttctgtctttgccatttaatttgttaattcatgctggaaattttgttggtaagcatgcatgttgattgcttctgctcagttgcgagatatttttgctgtttttccttgtattattcatggattcttccccgttccccttgaattgcagatggaatgcccaattccaaagacaatgactacaattcgaagtttgacctggaggtgccagatgatcttgatgtgtcaattgagctacgaaactggctcttcgcccttgaaggcacagaagaagtaggagattggttatcgcctcatggcagtgatcatatcagtagagaagagaaatgttggcataccacattcacgaatctacatgtgtcaggcagaagtagtgatcggcctggatctgcggagaaggtgattcacaaaagggcccttccaatagaacgttttacggtatgtagtggattattttcatacttttgcatttctatgtggcacttttattttttatccagttcaattctgagacactatgctgcacttgcaggctggaattgaaggtttacaggcaataaaaccttgcctgagagatcaactaattggaaatgcaacatcaaataatcttcaaacaggcagtgtttttgataacacaagtagcattggtgaccaaggtgtcgatgttgaagcgaccatggtcatttgcgaagatgagattgtaaggtcccaagtggacaatggataatgtcaagttttctgtaaaa

SEQ ID NO: 57706 - DNA, 7582 bp, Oryza sativa
tcgttttgatttttatcttagttaaacttatttaagtttaaccaaatttgtaggaaaaaaatatagtagcattttcaacaccaaacatactatcaaaatatactaaatgctagatttaataaaactaatttagtcttttatatattactaaattttcttaaaaattaaatcaaacttaaaaagtttgtaaaaaagtcaaaacgacttatagtatgaaaaagaggagcaagtttttcctctgatatctcacttagtactaatatcagcagtgaacctttatttttgtcatgtttcaattttttgtatggatttatcccgtgcaaaaattttagtaatgagaacaagatatgaggggataaatttgtaacaaaaatatttgaagtacaataaacctattggacctagatatatgtttgtatataggtgtattttatcggcatactcaatatacacgaaggcaaatgggtcattttcatgcccctccatattggcaatgtgacatgtcctacatatgctaaattggcaatatgtaaagatttactcttcaatgacattttttgtaatttcatccaaaaagagtggcatctcaatagtctagttgtaaaaatcgaactgaaccaagggtttaaccaaataaaccaaaaccaatgcctagtccgaagatataactgacttgagaaaaatcatttaaacccagatggtttactacataaccgaaggaaaattggggtggcgtagggattgaaccccccacggtcaaggcccatgggttctttcacaaccttacataacccttaaatattttcataccaaaaatgtataaaaaatgaacgcatcgtattttagacctaaccctcaaattttctaatcaaaatagttgggctcgttgctacctctatttgcatacatgcgtgcgcacctgactatttaggttagttgctataatggttttagaaaacgaaacaaatatatattttatgttgattattaaaccaaaattctctcaataaaatatataattttattattttattattgaaccgatggttgaaccggtgaatcggtggattcattcaccggttcgaacaccggtcgggtttagagaggcaatccgccgccgccgcctgcgccgatccccatccgccccgcgagcgagcagaggcggcgctgccgctcgtcctgctgcttccgccgcatccacatccttcgccgccgccgccgccgcctgcgccgatccccccatccatcccgcgagcgagcatcctgctgcttccgccgcatcctggttagcacatcctctttcccatctctccctctctctttttttttatcgaatttgcgttaaccctagcttctgttgcagaaatttggcttaaccttgatgtttgtttgttcccaaaaagtttgggggtgttgaactgaaccccccatgccccatgttagatccgcccatgaatggatcatgattcactccaaaacactatggagcatcctgttcctggagaggagcatgaggaggataacagcatgaaagtggatgtggcatttgatggagtgcacagcccgttccggtacaggcacaagaaaaggtccaaggtttgggaggagtacaagcccatctttctgaatgggaaggttcagtttgcggagtgtctctactgccataatcgcctcagctgcaaagattccaacggcacaagccatctatggcggcatcagaaaatctgccctggcaaggaggaagcggcgcagaggcgacagaaggattcctacttcccatgcggtataccattcttgcctattctgggttcattcattactcaatagtgtagataagttaacattggtgtggtttaggatcttgagatgtagatattcctttataaaggcgatttacctcaggaatataaataacgtttccatattttatatgcacagttttggtgaatgagaacgatccagtttcaccccacgatccggtcaatgatgttattacagagacgcttagtgatataaactcggtaacacccagcggtaacagattcacgtcaaaggtgtggaaggagtttacacctgtctatattgaggggaaactccaggctgcagattgcattcactgccagaagcgcctcagtgcgaataagttcggggggagaagccatctgagtcgacatcttataacctgtgcaggacgacgtggacgtggagggggccaaattcatcagaagggtttattttatccttctagcgtgcctagtttgaagtccagggtgcaagatgagctctcacctgccttgacaaatgggaaggttcagatcgcagaatactctagcaagcttctgagggcaagtagctctggtgactcgacccctaagcccattcgagtggtaccagcagagcattccgtgccgactccagattatacaagcctgatgaaacagaggacctcatttgtgaccactccagctggtcaggaaacatctgatccagacctagtcgggatgatagctttgcatggttatcctttgtcaattgtggagcacgaagaaatgatgagatttgtaaagaaactcaaccctgtggtcaatttagtctctcgcaatgctatggaagaacattgcttgacactatttcagaaggaaaaggaaaatataaagggtaaaattgcacatttttcccgacgtgtctctctgtcagcaagcatctggactcctgatggacctgagacaacagtaaattacctctgtttgacagcacattatattgatgaagactggaaagttcataggataataataaaatttggaatgttttggtccgcgcctgctgatttggaaaggatgatacattgtatggaagcctgtgtcccagagtctgagagcggatcatataatgtcatattggatgccattagagattggaatcttgatcagaagcttttaagcttgacttctgttggtgaagttaggggtgacaccaatacttcattgctaaaggaaatgcttatagagaagaagtgccttcctattggagggacgctattcaatgttgcctgtgtggactatgtccttaacagtattgttttcaaagtgcaagcagatatacttcgtcttgttggtgacatagtaatggattttttagtgtcattgacccagcagcagcttctggaagttatttcacagacgggtctaaagtgtccacaagaagatgctaagtggtggcacaaactttattttagacttgaagtgcttttgcatttcaagaagtcatttccttctgaagaaagggtgtccccagaagatacaaaaactgctgagtccgtttgcaagattttgaggacaatttatcgtgtcattgaagttatttccagccctagctctccgacagcaaatatatattttaacgagatatggaaagtcaggacagttttgcaagaagaagcattaaatgatcacagagaaatagctacagtggctatggtgatgcaggaagcattcaatgagtattggcaaaattcatatttgtggttggccatacctgttgtgctagaccctagattcaaattcagtttcattgagtttcgtctgaaacgagcttttggaacagattcggcaagctacctatctgtaatacgtgaaacagtccgggaactcttcaatgaatactgccattctttgaatcaggcaagtgatgttgtttcaaacagtgaagctttgtgtgcagatgataatgattcgttggaagattgggatcagcatctccatgaacaagcaagtcgtcagctatcttcggagcttgatgattaccttgaagatggtttagttcctagaaaggatgattttgatattttaaactggtggatgactcatagtactaagtacccaacacttgcaactattgcacgggacatcttagccatgccagcatctgctgttcaatctgaagcagcattcagtagcagtggaccagtaattccaaagcaccagagtacattaaacatcagaacaatcgaggcacttgtttgtactcgagattggatgagataaaactggtaagattctataaattgctactcagctccatcctatctttgtgattttggtagtgtgaacacactgtgatttagtccatgttttcttattaccagaatcttgtttccttgttttcctgtattggaagtttggaaccatactatatgatcagatgaatgtcagaaaccaaagcctacaatgttagtaactttatatggaagtacatattagaatcttacatgttcatgtgcaatcttagcagctacatcactttaggatgttttagatcatgcttgtaatttgtaattgaaacattttgatcccattggcaatcatgaatatcttgttctgtgattgcatgctttggatcacttaataagtttgtgcgttatagtttgtgtccatataatcatgatgatatctcattaggaacttgattcctcacatctttttgctatatgctcttacatgacaaaagaaggtcgctgttgaaatttcacttattaaatcaatgcagttctggtatatcctcatccaatctattcatgtgcaattgcttgaaaaatggtatgctgcagtgaactgttgagatgggttgcatgcagctttcgccggtggaagatttcaggcagtgtatgatggtgcttctgaccaaggataaccgctctgatgatcgagccccaacatggtgtatcaagcatttgggagctgttaaacttcatttcagtcgagatgtgtatgcatataaatgttactcccatcaccccatgcatttgcctggtgtagtgcagatgtatgccgttgtttagccaaagttcaggtcagcccagagccttaggtcaagtaggaactaggagttgtacgacgagaatgttgcaaatatcctctgttatgagcaattaatctgtgttatgtgcagccttgtttacctgcttatctgaattgtttgagggtacgtaggcaatgcgtgttgctgtctggtcctaatggaccgaatttaggatgtggcccactattcagcactatcccgtaaaggtaaatgttgtttaaaggcccaacagctgaacagcataaccctcatagtttattagagaataaaaattaatttataggtaaaatttgtatatatgtgtttttataacaacttaaaaactaatactgaaaaaaaattatgttgaacatatttaaaaatcaacttcaaaattaaatttgaaaattcaaacttgacttttcatttagcttgcgatgggctctagcctctggctagcatagcatgccatgtctgggagggggctggcccattggtcagacacaactgagccttctttttacatgggccggaattgtaggcccatgtacacagcccacaaggctattttctgggcctctatcctcctccacgccggggagccttccgtcgatgaggctccccgacgcgctcctccgccgcatcgccgtcaggaatggatagttccaaaaacccatcgatttaccacatgttccattaatgtaaataattctacatgctaatgctaaaatttaatttctactcccttcgtatcatttgaagtgcagccataattttccacactcaactttaatcattcttcttatttaattttttttaaaaaaattaaaaacataagttatgaataaagtattattcatgttttattatctcataaaaaaataattatcatattttttttcaaataagacgaaatattaaaattgagcatgaaaactcataattgtacttaaaatgggacggaggagtagctaagtagctagctaaattaagctagaagaagtcgatgccgcatcgcttctgctggaactccggcagcagctggccgtcgggcccgaccacgacgtcgcaggtggcgtgcaccgggtgccagtgcgacccccagaacgccacgcgcacccgtatcctcgaccggaccttcaccgtgaacgccacgccgccgccgccgccgcccgccgcggcggcggcagcgtccctcgccatcatgtccgtggcggcgccggccggcacggcgacgccctcgaacccgaccgccgacgtgcccctcggcggctcgtacagcggcccgccggtgaggtccttcccgtcgacgaccacctcgccgtcgccgcggtactgcaccgacatgtacacccggccgaagaagaaggcgaggtcgtggttcgggttgtggatcgtcagctggccggagagcgccaccgggccgccgccggactggacgccggcggcggtgaacgcggcgacgtggaaccgcggccggtgggggcggacgacgaggtagacgacgaagaggagcacgccggcgacgaggaggagggagaggaaccacgagcagagaagcttggtgcagcgcgtcaggtgcggccgctccctcggcagcgggcgccggatgcggccgccggcgatgaagcccgcggtggccgtcggcggctgcgacgacatggcggcgtattatatatacgtgtgcggcggccggcgagcttcgacgacgatgggatggagctcgttggtgcagcaaagcatgggcggcaaagcatcgccggagaagatggaattcgggagaggttaaggaggtgtgtacgcgtgtacatacgtagaggttgcatggcaagttggtttttgggtttcttttgttgcgcgtacatgggcgattctttgaggagatagcaaggaacaaaaggggtagcagtggccggttttcttcgtgttttggttctctaatctcctacttattttatttgaaaactagcatggtggcccacgcatattgcgcggctagcatcattatattttctgtcatataatagcatatatgttttctcaatgtattattcaaatatattaaaatgactacataattttaaattttgtactacctttacaaaactactaatgtataatattcatattgtattttatatatgtgttagttattaattatttttaatatcaaattttagttatttgtaaattatattcctatatggactctaggctcttctttcaatattatttatttttaattctgaacttttattatttataattgtatttctatgtggactttaaactcatcttttaatattctttaatttttaatttcgaatttcaggtacttctaaattgtaatcttatattaactttagactcttcttcccatatttttttaatttcaaattttagttatttgtaaattgtatttttatacgaactctaaactctacttttaattttattatgtttattccgaattttagttagttttaaattcctatatggactctatactctacttctaatattccatattttttaattcctaatttctattattttcttaattgtatttttatatggactctatactctacttctaatattccttatttttaattccgaatttctattatttcctaattgtatttctatatagactctatactgtacttctaatatttcttatttttaattacgaaattatattatttctatatggactctatgctctacttctattcctttt

SEQ ID NO: 57707 - DNA, 8796 bp, Oryza sativa
tttttgatttctccatttcaatcagtaacacttaacacccaaaatcatacagttgctggatagcggtacattacatcacagtacttatcaaacatgtaacaccgaaggcattacgcaacattttatttccttgaatgaagcaaatagtttactttgattgtacatcataatacaaacaaaggcataacaaaacatatttcacaataattctacatataccaaggaatatcaaacagctaacacttcagacaaatgcagttcagcggttgtatatatatttgcagcctaattcacaaaggcacagtgcttcctgatctccccctgggcgccggtgagcacctgcatgttccccatcttcaccatggacgccgcgaagtcggcgaagaactccgccgggtagccggcgacgccggcctggcggaggatgtagcccctggtgaaagggtcgagcatgagcgtctcgtcggaggtgaagagcgccctgcccctggcgatgtgcctgtagtagctggtgtcgaacgtcctgaagctccccgggtccatctccaccagcgtcgtcttgtcgccgggctggcacttgctcttcagcctcggcacgtagtacttgtccagcgtcgggtcggccatcatcatgccgctgaagttgtacagccggctggcgaaggatgaacaatgggaggttccaagagtgtgcccacctgtgaacaatgtgtcacttctcaaattgcatatgcacatttgtgatgagttcttggtaattaaacaagtttggattgcaattttgccatggttttgaatctctggctatagctgtttgagaagagtcttagccactatagctccattaagttcgctatagctgtttgagaaggtcaatcgctaaatatcttaacccgctatttaaaaccatgaattttgcaagtgcacaaatgagtatggtgctgaacaggaaacgatgttttgaccactcgaataaagagctatgctgtgtttgaggataaagtggtcttggtctcctggcttggttctgtactgtgccatgtgattagaactaagaaccacatagttttgtacttcccattttgttgacttggtatgcgcatatgataccttcctttattaacaagttgtatagtaattaaataagtgatcacctttattggagaatgctactgggatatatcgggatcagcagagtgtttaaaaggagcacaggcaacagaaccgagagttgcaactttcagtaagtacagtataaatcatctagggagctagtctatgaagattaaacattgaagttagtgaagaatagtatatacctagcagaaccacctgatcctttgcgtcaaggccctttgggatgaagaattgatacaagttccgcgtggcatcgaagaaggggggagggaggttgttcacagcatcatccttcactgatcttgtcccatccctccgcccagttggaacttcccagtgaggccctttggtctgttgcacaagggaagaatagggacttttctcaactatagttctagttactgtaagcagcaagaaatccaatagccacgtagaatatggtgaaaatcaaactgtgtggttttccactattgtcggcctaaaacagccaattctcaccacttagccaaactatactaacttttctaactaaagaatgaactaagattaatgaacatggaagctagttcttaccaagaagacaacatctctggctaccagagcaaggatatcagcacaggacacaactccagggcaggcttgctccagcttagctttgacacggtctattgtgccaaaacctcgcagactgaggtttggtattgattccttctcagatggtgatcctggtgtgctatccagaagtatagagccatcgcaaccctgcaaaacacatagaggcacatagcttagtaggataaactcaattcaaaatcaaaacagctcagagcatggtaagcagtatgcatacattcacaaaacaatcatggaaatgcatgcgaagtagagggcctgcgagacttggaactcgggatatgatcttggtcatctcatcacgaacaatgacctctgcttttggacatgtgtattggtaaaagccaatgtttagccctggtggattggataatactaaggagaactgtaggacaagagaaaggacaaatccgaagaggagtctgtaaggcatgttgtgcatgactactgtggaaccactgcctatgatgaaagagttgccttctatgattgttgaggcaaattataacttgcagcctgctttatagctcagttgcttaggttgtactatagtaaacaagtgacataaaccatttcccacagcttcattttatttttcctaatgcaacaagcagatggtctaagacttggagatcgagattttacaagccctatgagttgtgtgcatgtacttcaattgaagaatacgcaagtcttggatcaggcatctagatagtattacctggtaatattgcataattagttggtggtggtcatccttcgtggcttgtgcacttgtgagtaatacaggctcttgtattgatgaataggtcacgacatgttgctaaaaggtaatactctctagctgttctaattttttattttaaatattatatgggttgaatttattctggtaaagaagttcagaaggattcaaagatatgagataatatatcagtttatccgttgtcgtttgttccagaggaaattgtgtatgttcatgcaaagtggaaaagaaagaaaaacaatccatttcctgttttgttagtatttaagggaaccagggaatataatatggttgcctcgctatgacattatcactgctagtttctcttgggattgcatctgaacactaaaggaactgcccataataatttcttaactggcaccagtcagttaaagtaaataatatcaaagcaacaacccattgtttgatgaaatcaatcttcttcctttgaaattaagttgagaaaaaaaaaggttgcatgacagttgtgctcgtgtcaatgaagcaaatcaagggagaaaagttagaagagaatcaacatgatcactgctagctaattattgaatgccaaacgggtgcagaagcatctcaggcaatgtgcagatacttcattttgaagcaaaatttaggtttgatcaagcatataaacactctaagaaagatgagaacatgatgtgcaagttatggaaaaagattctctatgtttgaataaaaaatgcaagagtttgtgtaagtaaaccttcagtgaatccctatcatactgagaaaatcggtccattggtcagatattagttgcagcctttaagttaataaataactgctgggctcaagataaccttccgctgagctctccagagaataataataaaaaaaaggtgaaaacaagtcaggagtagtgaacagaaccaatggtggacaccatagtgcgtgggggtacagatgcacccctaaaacttgaaaaaacaccaaatatataggattacatgtacgtatacaatgtgcacttagataagaatcccaaagtgttaaaaattttgtatgtaatacatgtcaaactttatttttctttatttttttagattccattggtctttatagggcatattttaatttgaaaacaaaaattcaagattaaacattggccattgatttctcagaattatattcttaatagctataaagccaatattttgtgaacgcactttgaaatatgaatctatgggcacaaatttcacattaaatatatattaattatattaatttgattaattgctggtcaaaatatacataatttgacattttgaaatttaaacatgccctataaaaaatcaatgcaggttttttttttctgtctgttgtaatggaatcatggaattttctctatcaatattccatactatctactagtgcatcattacatcttcacccctattgtcaaaatcctgcaccacaggagataacaatggtttaagtgttcactaccacatggctgggcaatgtattcaattactcttggagtaactgaaaagtgatgtcttttggttgttcaagaattcaagtctaagacattcacagcaggtaaagaaatttttagttgacctagctcaaaatgtgtgcttcactcaaacagcaagggagtgcaggacagttttgaccatgaagttgttcaacaatggtggacattgacaagttcgaccttttccataggaattaaacagtactccaatttttacctcatgacttgttcatgcacataagaaaaaaaatgccaacccctttagtcatgttcagcagcaactcacagtctagttaatacttaataaatgttttctacgatattcttataggacatcaaaattgcttttaaaagagaagggttaatatcccataattattctgtctaatcaacgttatgtgacttgcaaaaacacatctacagtcctaaacaattatgggactaattaagatttaaagcacagtaacaattcagaaaattatttatcaaggaaagtaacccacagaagtcagatgaacaaaaaacttacactgaacgaacatgatggcaggtgaatttgtgataggtcaataggtcatgagctattcactgtttaactgaacaggcagaaattggttaactctggagtctgaactctgaagtgtgttgcggcttgtcaaagtggcccagaatttgaggttcatctgatgcatctatcagtggctaaaaactgtgatacaaatttcttgcagtggaaaagtttctgtcatattcagatgacactgaaaccaacttcctttccatctgttgtttcatctattacttctctcgtcctctgtgcatcctcccatagactacattctgcatacatgtttgcaagaacagcatagtttacagaactcccaggatctatactaaaaaggttcttggctgcagtttctccaagaagcatgtttccatgcaatttacaggctccaagcattgcacccagcattgatgagttgggttttaagtttgtcttctggacaagtttccatgcatcttctaactggcctccacgagcaagaaggtcaatagcagagctgtaatgctcagctcttggatcaataccatacctgctcatcatggaagtaaagtactccatccctttgtttgtcaaaccacaatgaccacatgcagatagaagagaaaggaatgtcacatcgtttggcctaacaccatcttccaccatcctattaaaaagagtcacagcatcttctccagaaccgtttcttccacaggcagtaataagtgacgtccaagaaatcacattccgatagggcatttcatcaaaagcacgcttggcatctgaaaattctcctgcctttgcatacatatcaaccagagcattgtccaatgcaatatcacccataggctgcttcttgcacatatatgcatgaatttgtgtcccaaatcttgcagaagcaacgcttgcacaaaggcaaagcactgagcttaatagaacaccatcaatccataaacccttccgatgaattttacagaagagctccattgcatcttcactgtagtttctatccatggtgtacccactgatcagtgcggttgatgacacgagatctggttcagagatggaatcatatatcactcttgcgctgctcatactccgacattttgcgtaagagttgataagtgatccgatgacaaccttttcatcccagtaacccaatttgatgatgcaactgtgaattagctcaacattgacagcaacaccgactattccacatgcttttagagcacttccaagcgtgtaatggtcaggaatcatcgctgtcaattattttgatgtaaaaaaaagaaagcactttcaattttagtgccaataccatcagcaaaaactaccttgcaatttcatgctaggacataataggcagcatgattacaggaaaaatgctcaagattgttaaagcaaaaggagggacggcataccttctttcagcattgaagagaataatccaagcgcatcaccgtcatgcccgcgttccacaaaccccctgatcagggcattccaggacaccacatccttcttccccatctccgcgaacagctgccgcgcatcctccacggacccgcacctcaggtgcatgtccatgagggcgctctgcacgaacatgtcgcccgcaaacctccccttggcagcgcacgcgtgcacctgctccccgctcctggcgcacccggcccccgcgcacgcgctggccgcgctcccgtacgtgaactggttcggccgcgcgcccgacgcgcgcatgagcgcgaacagctccagcgcctcccgcgggcgcccgttcctggcgtagccggagaccatggccgtccaggacacgacgctcctgtgcggcattccatcgaacaccttgcgggcggcggcgacgtcgccgaaccgcgcgtagaagatgacgagcttggtgctcaggtgcaggtccggaggagaggcggacgcggcggcgaccctgccgtggacggacttgccttgccggaatgcgcaggagctgatgcagcactggagcagggaggagtataatggggcggtgggtttcgcccccattaggagcgccattcgcgcgcgcttttctccctcctcggagcaattttgatctcccgagactcaacaattcatgaattcatgaatttatggcagggtttggcaatccaataatatgagcacgaaacacaccaggagcaaaaatctgaatatatttagattcagttctactaaccggcagtagaaatgagcagctgcaaatatatttttcatgcaaaagggctagaaaactgaactatacaaagttggcttcaatccataaatccaataaaggccttctgaagaatcaaattcagtcataccaccatcagttatccatctagcacatgaaaatcaaagtgtgaaaaaaaaggtgattggataaattaaacgtaccgttatgattcaatagcatagaagaaagattaaatggagaagaagaaaaaatggagatgaagaaaaaattatgtgcttttgcagattggaaagcagacaaaagggaatgaccaaattttttaggctgaagagaagaagcagaaagagataggacagaggggacgacaccaaaaacagttgaactgcagccgcgcagggacgctggtcgctggagccggcgaaggagctccttggcggcggccatggcgccgacggacgtgggtggcagcggcggctggagtaggacgcgatggttgggattggggaatggccgaatgggccctcaaccatttttgggcccaaaccaattttttttcaattttgctatatctcactcgaaagattttttcttatctctcactcgattttctcacttaaatttacagtgcattttcttgtaagttacagtgtaatttatgaaacttacattgtaacttttgtaagttacactgtaatttttgaatcttcgcatgtaaattttaaattttgtattggatttggtctttttcttttttattggatttggtctttttctcgaggatatggtaatttagtgtccattatggtgtttcttaattactttttactttttattatatctatcggattttaattcaaagattaaaaatctgtgtgatacgatcatcaaaatctgtgtgatacgatcatcaaaatctttcgaaagatgtataggtactcccattttttttaggcaccaaaccgcaccagcccaattgtgaaatcaaccaacaccattagaattccaagcatcagaagccgtaaagactgaaatgcgcatgaaatcaacaaacataccaggatagataaccaaaccaacatcgacaccccaattccaagcatcagaaaccgtcaagcgcaaacagattgatcaacaggcacgcgcaacagtggccggttacgaccatgtgagcaatgcacaaacagaatctcatctcggatcaaacatctcagaaacattaacagaagtagaatgataatatcatcgattggtaccgatgcacagtgaagcaaattgtactagtatggataatagtatcaacacaacttagggactctaaaccagaacacaacacaaccatgacacgatgatatgacagacgagcggcataggtataatgaagtccaatgctgcaccacagcacacgctcagagaccaccacggaggcgcaggacaaggtgcagggtggactccttctggatgttatagtcggcaagggtgcggccatcctcgagctgcttgccggcgaagatgaggcgctgctggtctggagggatgccctccttatcctggatcttggccttcacgttgtcgatggtgtcagaggactcaacctccagagtgatggtcttgccagtgagggtcttcacgaagatctgcatacctccacgaaggcgcaggacaaggtgcagggtggactccttctggatgttgtaatctgcaagggtgcgaccatcctcaagctgcttgccagcgaagatgaggcgctgctggtctggtggaataccctccttgtcctggatcttggccttcacattgtcgatcgtgtcagacgactcaacctccagggtgatggtcttgccggtgagggtcttcacgaagatctgcatacctccacgaaggcggaggaccaagtgcaaggtggactccttctggatgttatagtcagcaagggtgcggccgtcctcaagctgcttgccagcgaagatgagccgctgctggtctggtggaatacc

SEQ ID NO: 57708 - DNA, 3926 bp, Oryza sativa
tgtcagaggactcaacctccaaggtgatcgtcttgccagtaagggtcttcacaaagatctgcataccgccccggaggcgcaggacaaggtgcagggtggattccttttggatgttgtagtctgcaagggtgcggccatcctcgagctgcttcccagcaaagatgagacgctgctggtctggtgggattccctccttgtcctggatcttggccttcacattatcgatcgtgtcggaggactcgacctccagggtaatggtcttgccggtgagggtcttcacgaatatttgcatgcctccacgaaggcggaggacaaggtgcaaggtggactccttctggatgttataatccgcgagagtacgcccatcctcaagctgcttgccagcgaagataaggcgttgctggtccggagggatgccctccttgtcctgaatcttagccttcacattgtcaatcgtatcggagaactcaacctccaaggtgatggtcttgccagtgagggtcttaacgaatatctgcatctggaagaggcaagaaaggattggaattaacataggtaaaaaaaagcagctggagaataagttggcaccagatcctacgatatcggtactgtcagctcaaaatagatgaacatatcaatcacatcatactacactacaattggacagcatcattaatcataagagcgctgctcacagctcacaccacatcaacaagcaacaaccaaaaatatcttcagataataacaaaactgacataagtaactacaggacaacagatctatgtaagaacacagaataaagccacctagttctagcatctgacagatttgatttgcacgagtaaagcaaataaaacgggtaaaaaaacacagtacaacatcagcactacagttcaactaggcaaagagccagatacaatacagattaaattgaccttagaacccaagctctacagttcaagtaggtgtacacgatacagatgtaattctctaacccagctccacacaattccaatccaaatccaggggaaaaaaactaagaacacaattccaatccaaatccagaggaaataaactatgtgtcgcctaactcaacctaaagattttaacctaacgagctattcatctattggaacaatatcagaacaatcccatccgaactaagcacaaataagtaaaactaaatctgatcacaaaactcaaactatgtggcaggatcaaaacataactgtgaactactcttattatccatcattagggtaatatatcgaaacaatccccatctgacacatcattagggtaatatatcgaaacaatccccatctgacacatcattagggtaatatatcgaaacaatccccatctgacagaacaatctcaaaaccaatccatctattagatcgatataaataacacagatccctacctcgattctcacgaaaccctaaatcaatgagagattaagaggattaccctaaaatcgcacgaaaccgtaactcgattaagaggtggatcaccctaaaatcgcacgaaaccctgagagattgagactaactcgcacgggatcctcctacgctttccaccacgagcatcaaaatcgcgagattagacgggcaccacgagagattcgaggattaggacgaggtgattgattagttaccttgacgaggcgattagagaacgcaaagcttcgctccccctccccttcggtcgattcgactcgctatgcgattaatggagagaaaacctctctatataaagcgtgggcaaggcggtgcgaggcagcatccggtgcggtcaccgccacgcgtacggcccaatggcagcaccacacgtgtccatgtagttggaggcgcgacacgtgtccggtcccggtacgaccatccagacggtgcccggaaccaactccgcgtcaggtcatgccgcctctctttgacgaagtcggcatgcctgatcaagaccgtacgtttccgatccaacgatcaggaaacatcgtacttgatctgctataagctgcgtgtgggccttaataatcctctggggaaatatttgtgggctgaaatgaacgggatattgggcctagacaaaccagggcccatgaattttacggcccaatagattgttgagacctaattggctaagcccaactcgcgcactctgaccaaccgatcggaagttcgcgtccacgccgccctgctcctccgtcgccgccggctcggcggctgacccccgcgccgccgcaccagctgcgcgcgcgcgcgcgcgcgcccccaccaccgcggcctctccctcccacgcgcagagggcacgggcagaggccgccgcggcgccgtactcgccggcgcttcgtcggcctcggcctcgggtcgaggccggtggcggggcctcgtcagatcgccccccttcctgtgcagtaagtatttcccacggacccaatatggattcgttgttctaatcgatagctgctatcagagatgggttcttctgcgtgatttacctgttcttcacatcctctgtcgatatggggttgggtggggttcgtttcttgcgctaatgcaagatttgaacttgcaggcgtgctctgctgtgtgtgcgtgtgtgtggcaatggcgttgatgcggcggagagtcgggggctacatttgctcggagctgtgtggctcggttatgaatcagaggctgtactcttcgagggtggactggaagcagcttcggcctatgatcctcaagaggataaagaaccgggcaaaggagtatccaatcaagcgcatgattccagtagcggaggaggtagtcaaggctagagagattgtcaccaaaggtgtctcgacgctgcttcaagttgttcccatacattcatgcaagtaagggcgagaaatgtggaatttttatgtatttgtctgtttgtcttaacacttggggaagatagtatggctaaacaagtgttttatttgtagtagatcaacttcaatttaggcatgcactaaaaatgttccagaacatccagaaatggggcaacattacaagattaccagtcttctatagattaccgttgttattgtgtaccttgattgcatatagccatgattgcttttcttgccatgccaagttaagagcagctctctctgatgtgcatgtttgatatcattttcttgattcctgtcctaaaatattattgaatctttctaacaccttgtgtttctattctcactgaaggttttgtcccgaagttcatattggagctgtagggcatgagatgcaatcctgtcatggtttcaagcgtatgatcaagaaccagccgcataaatggggtccaggatgcttgaatgacatccttatccctgttgaatccttccacctggaaaacacgttccaggatgagataaaacatgaccagaggtttgatttccctcgtgtcccagcggtactcgagctctgccatcaggcaggtgcagatatacctgatgaagtttggcataggagtggcacgtcatctgcaatagtcagagaaaatgatgaaaaacctgctgcttttttgccagaagagcttagattcataggtcagaggacaatagaagcatgggaaaggcttagattaggtgtgacaaaactcctattggtttacccatccaaagtgtgtgagcgttgctctgaagtgcatgttgggctgtcagggcacaaggccagaatgtgtggggtattcaagttcgagggctggcgtggtaaacacaagtggaagaaagccgatgtggatgacctagttcctccaaagattgtttggcaccagcgacctcatgatccaccggttctggtcgacgctgggagagactattatggtcatgcacctgcggtcattgagctttgtatgcaagtgggcgcaagagcacccccaaaataccattgcatgatgaaggcgcaaggcctagc

SEQ ID NO: 57709 - DNA, 11305 bp, Oryza sativa
taagtattcagagcgattactttgctgccctttcatttgttcatcctccatcatttgccaagaatacgggtggaagggctttatgagcctgctgtttggtcttcttctcctctgcttgactactgtaacatcattggtttctgctgttttgtgtaaactttctcacattacctagacatccttataggcagttctgttataagttagccatgtagagacgccttgttgcaagctgcaacatatggtgtggaacatcacagaggaatgtaatatcacttgctgtattgtaagccctagtcaaaatccctccttgaagctgtaatctgtgtacagatttttacctggggctccttttgctgtgccaataattacagccacgttggctgattttttttttctggagataaatgaatggatggtgaagtttttgttctttgtatttgaagttgaacattacctcgagtacttgaccccatatgttgctgatgttttttcagttcaagtaatcttgtctctctatgaatgcatcattctggaaattaaagattacttggttggtatttgatgcgtctaacctgttattaaattttctctgcaaaacgtgtcactcaattgtacttcttccgtttcaagttataagggaactgttcactttgatgcaaaaaaaaccttaccaaaatttggatgccaaaattttggcaacttaccaaaattttggcaggattttttatatagttaccaaaatttagcagcaaactaaatgtagccatttttttttgtaactttaccaaaatttggtaaggttgaaaatgacatcaaattgaataggcccaagatgtttttgattttggtcaaagtcaaagtattttaagtttaaccaaatttatagaaaaaaatagtaatatttataacaacagcatagtaattgaataaattttcataatatatttttcttggattaaaaatattattatattttttctataaaattagtctaatttaaaatagtttgactcgtaacctgaaatgtatggagtaccatgtaaacactttttaccgtatgtggccgtaacctggaaggaaacattagcagaatttgcaaccgacatgatttccttggctaccaatcttccttctgcgcgtgcaattttggtacttccgtcagttccgtgtcgccgacgtacccggatagaaaccgtgagagccaagtttggcagcggcgtacgaggaggattctactcgcgacctgggtagtggggaccgtagatgcgccgtcggacggccgagatcacgccacgtctaacaacttatccgacgtggactccacgtacgacttggactcctcggcttgaacctttcgcgtcccctcataaatacacgcgaggaggcgccccctgattcgtgcaatgcaaaaaacgaacgcgaagaacacgaatcctccggcgatctcgagcgcaacgatccccagagccaagaaacccgccgctgccgccgtgtcgccgtcgtcgaagttggcgagcagcaacaaggtcaccaaggtgtcgccgccgccgccgcagttgtccgcgctgtgggccgccgcctcgtcgtccgacgaggaggaggaggccgtcgccgtcgccgtcgccgtcgtcccagcgccgccgccgccgcagccggcgagcaagaagggaaagtacgtcaagggccgcgcggcgtccaagaacaagtaccttgtcccccgccgcggcgaggaggatcaggcggcggagggcggcgggaacagcggcagcaagttgatgtccggggcgccggaggagttcggcctgccggcggggacgttcgacgcgttcgcggacgcggagggggaggacgccgccgcggccgcggcgccggcggcgactacgtgcacgtccgcgtgcagcagcgcaatgggcggaagacgctgaccaccgtgcaggggatcggcggcgagtacaactacgccaaggtgctccgcgacctcaagcgggagctctgctgcaacggcaacgtggtggaggacaaggagctcggcaagatcatccagctgcagggcgaccaccgcaacagcgtctccgacttcctcgccaaggccggcatggtccgcaaggacaacatcaaggtccacggattctaagtccagagagatcgtatatcacttgggttttagtataggttcttaattatcagttttgattagtataggttctggttcagtttagcagtgtgtcgtgtctgccgtaatggcttgcagtcgtcaggttgatcatgttaagcctcatacttcttttccgtattggtgtcaatggatgattttaagtatatcttgtttgcttactgttctctgaatacgtacttatccttgtgatgctctgcactttgcaacttgtgacacagatgatttttactggtgacaaaaaaaaattaaatactgaaaatatcgctctgaacaaatttgttggtgatacaaacaagtcaataatttcagagatcagcgtagtcgaagtcgtcgtcaaaatcttcgtcgtactctatctcacttacgtggctatgataatgtggtattgagctccacgggctgtcgtcgagcacgctccggaatcggctccgtaggaacgtgacggcctcccatgccgccatctgcttcgcctcctgcaccgacgacccgacctgcgtgaaacgcaagcaatcgcggttgagaacgttgacactcacggttacggcatggtagtcggcggcgccatcatcatcggcctccgtggtcgtcgtcgacgtcgtacgacggcggcggcggctagcgctgtaatagtaggttggctctttggttgctcccatgccgttgatgacctcccatagcagcagcgtggctccgaactccgtcaccggcggtggcaccatgctggcttcgacgcccaggtagcgctagctgcagcatgatgcactcccatggcgacgacggcttatggggtttttgctggtatctacggaagcagctggtccgcatgtcgtacgattgcaccgaccgcaatgcccaggaggagctgatcaccggaccatcaccggcggcgacggtgaccaccatgttcctctcgtcgtcgacgtaccaaatctgattctcggtgatcttgccgccggcgccggacgacgtgacatcgaacgcttggcaagaagcgtcgccgatgaagagcgcgtggccacgcagcctggggattctcgtcagccgcgtcttctttcgccaggatccccacgtctcgagtcgtgctcctcgaccacgtacaccttgaatctagatgtgtggtagcgcgccgcggcgcggccgccaccggtgtcggggacgcgggctctgccgaagtctctggaaactactagaaccttccccatcgtgtggcaggcaaccaggtagaactcggtgcggccaaacgccggcgcctgcttgtcgacatgcgtccaccgccactggtcgctgggcaagtgcgagtagtgctcgatgtccgcgtcgtcgaaggcgaagatctcctccgcttcggtgacggcgtacagcttcccttccaagaacacgatgtcttggatgtagaacaccctgctaatgtccgaccaagcattatcatcatcatcgggatgatgtttcttcttcttcctccccgggaggtggcagacgaagatcttgcctagccgcgccacgaacctcgatcgggtcggcgcgggcgatcgcagctaccgtgatgccgccgccgccgtcgccgtcggcggcggcgggggatgcggacatgacgaccttggtgatggtctctgggttggtccacatcggcagcttcacggtcgccatggtgaaagggttgaggaggaagggctggtagggaggaggcgacgacgtgggcaccatcgccagccagttgtcgaacgagccccggcagacgacgtcggtggcgccgccgtggaggctgcagacgcggtggatggcggcgtcgtggaggctgacgcagtggccaggggccacgagccacgggacggcggggcgcgggtagtgcgaacgctcggcggctcgccatgctcggcacacggcggcgaagcggaggcggtctcccagggcggggagcctctgcaggacgtcgcggagcaggtcgtcggggaggtcacaccacaactgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggggtactcagcaagccatgggaattaagtgtttaatgcaagcttcaaggaaaggctgtttgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatagaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcacaagcaccgacccaagtgtcgggttttccaagtcttttgtaaaactccagttttacccaagttgttactcaaattttaagtttgaaggcgaccgtcgatattcgcacagagtgcacgattatcgaggcgcatctgggtggttacaaggggacatggtgtagcaattttcaacggaaggatcaattgcaacaagttaggtaggtccgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacggaacaactcaacaaacggcgaaaataaagccctattaatgacctctaagcgtgccattggatagatctcgagatttgggaaattttggaagttgaacggagtcaagcggagttatggttggaaagatattgaatttctaagattattggatttttggtctaaaggaaaaaggatttaattaaatccttttttggaaaaaggaaaaagaaatgatgaagggagggaatctagactttcctcggacggctagggcgcggcccaagggaaatggagcggaccggccaagctaaatgggccggccggcccaaggcggcccaagcgcgcgcgcgcgcgcgggagggaggagagagagggccggtggaccgggctcaccacgcgcggtcccgggtgggacccgcttgtcggcggctcggctcaccgtgagcggggtgcacgcggcgtgctagggtttggggaggggaggcgcggcgcatgcgcgcggctcgcggtgagggcggaggcggcgggcccacgtgcagcctcacggcttaccgcggaccacgcgcacggggagaaacggagggagcggctggccgggtcggcttatctggtcgcggccgaggtggcgccgacgtggcgcctacgtggcagccacgcgggtcggcggaaggtagacgaaggcccagccgaaacggacggcgggcggcggcggcgatcggcggagcgagccacggcgatacaagcgacagcgagtacaccgggtggttgcacgggacgcggggaggcgagccaacggctcggattcaccggagggagcttgacggcggcgaatcgcggcggcgacaaccggcggcgggaggagagggaaacggcgacgaggtcacgaggggccgattcccggcggtgggagcatctacgcggccacgggaactcgatgctagcgtcggatttggagggaacacgccgagggaggctggcgacgtgcgggtgctacggaactcgggcggcgacggcggcgagcacatggcgagcaacggcatcggtcggggcggcgccggccaactacgggaggtctactcgagctaaaaccgaagtctaagggggggagacggagcgaggagggagaacgaagcgaaacatcaccgcggaaaggagaggcgctgtgacgagaggccgacggcgcgggagtgatctctccggcctcgggccggggaagaggaagaagaggcgcggccggagtcctcttcggcgtccttgctcgtgccggctcctccgacacgcgcggcgacgatcggcgacggcgaaaacagagacggcagtggaggaggcgaaaatggggagggaaggagaaggggaggccgggggtttaaggaggcggcaatgtcggtttggggaaccgacttgcgcggtcaagagcgcgagctggcgctcggctagcggccaaattggcgacagggaggatgacgccggcggagaggtaaaggggaaaaaggaggggagaaagggggcttgcccctttgccggttcgggaaaaaggaggaggggagcggggcgacgcggcagagggagggggcgctgcctccgtcccttggcggcttgcgcgcggagtggcggggccgggtgatgacgacggcgatgacggggggaacgtcttggagcggagcggcgacaccggcgacaggcgtgcgcagaggctgacggcggcggcgaccgggcggtcggccacgcgcgcgcggctcgcaacgggaaggcgcggcggatggtgcggcgcggctcggcacgcgcgctggctgcggggccgagcggctgcaggctgcagggcggcagggcagcgggaccgggcggcatccacgcgggcgcgcgcgagcaacggcccgcggggagcggcagcgagggatggggagactgagagcgaggggggggcgctcggggcggcgcgcgagcagcgtgcgggcgaggctgagcggggggggggggagagcgcgccgggggagagagagagagagagagagagagagagagagagctctcgggagagtgggccggggagggagagggagatgggccgagcgagtttcggcccatcgaccttgggggaggtaaactagactttgcggagggattttgatttagaaggaattggattcggagatgaactcgacgatagatcggggattgagatcatgagatggcacgggcactagacaacaagcaaggaaacaaatttcgcaattagggtttttaagagataattttcccgctaggcgccacgacggaacgggcgctacagaccaacccccctaacaagaatctcgtccccgagattcagcacctaagggagcagctccggaaactcggcgcggagaagatcttctcgttcccaggttgcttcatcttcagaatgattgctccattggactttgtagaacttgattgtcttccttcgagtctgacgttctgcttcttcaagaaccttgatcggtctttccttgtaggtcagattcttttccagctcgatattacctaggggaacttgctcttctggaactcgaagacatttctttaactgggatacgtggaacacgttgtgcacatctgcgagaccttcaggtagctcaagctgataagccacttcgccacgtctggcggttatgaggtaggggccgatgtagcggggtgctaacttgccggacatcccaaaccttctcattcctcggagtggtgatacccgtaggtacacatgatctcctttttcgaactcaaggtcacgcctccgattgtcagcgtaattcttctgacggttctgtgctgtcctcaaacgttctcgtatcagcttaacttgttcttctgctgacttgagtatgtcaggaccgaataccaaggcttcgcccacctcattccagcacaagggagtgcggcaccttcttccgaacattgcctcattcggcgacatctgaatgctggcctgataactgttgttgtatgagaactcggcatacggcaaacaacgatcccaagtgccttcgaaatccaaggcacatgctcgcagcatgtcttctaggatctggtttactctttctgtctgaccatcggtctgcgggtggtaggccgtactaaaattcagatcagttccgagtgcttcatgcaattgcttccagaaccttgaggtgaactgagtgcctcgatccgacactattttcttgggacagccaaatctacatacgacatgagtcatgtagagttctgctagtttctttccatcataggtggtcttcactggcacgaaatgtgctgacttcgtgagtcggtccacgattacccaaatggagtcgtatccgctgggggttcttggcaaaccggtgatgaaatccattccgatctcttcccatttccactcgggaatcggtaggggttgtagcagtccagctggcctttggtgttctgccttgactctttggcaaatgtcacacaaggctacgtattctgcgacatctcgcttcattccagcccaccaaaagtatgccttgatatcttggtacatcttcgtacttcctggatgaatggagtaagcggactcatgagcttcctttaggatgagatttcttaactccttcttggccggtacacagatgcgtggaccgcaccaaattgtgccttgatcgtctatggagaaattggtgtctttcttctcctgtattctttttattaattcttttatcccttcgtcgtctttctgagcctcccggatttgcgactctagggtaggctgtactgtcaagctggcagggacacctgactgcaccacggtcagccttaacttctccaattctctgcacaggtgatcttggtcaggccgtatttgagctatattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcgcatctgttccctattaagtagtgcctccagatcttaagagcatgaatcacggctgccaactcgagatcatgggtggggtaattgacttcatgaggcctgagctgcctggatgcataggccacaacctttcgttcttgcattaggacacatcctaagccctgtcttgatgcatcacagaagatctcgaagtcttttcggatatctggcaaggtgagaactggggcagtggtcaatcttttcttcatttcttgaaagctgtcttcacaggctgtggaccattgaaatttcttttccttctttaacagctcggtcataggtctggctagcttagagaatccttcaatgaatcttcgataatatccagctaagccgaggaagctgcgaatctccgacacattcttgggcgggttccacgcaagtacagcttcaactttgctgggatctacttcgacaccgttggaggagatcacgtgaccaagaaaagctactcggtccaaccagaattcgcatttcgagaatttagcgaatagttgatgatctctgagcttttccattatcagcctcaggtgttcagcatgttcttcctcattcttagagtatatcaggatgtcatcgatgaataccactacaaactggtccaggtattccataaagattttgttcattaagttcatgaagaatgctggagcattggtgagtccgaaggacattactgtgaactcatatagaccataacgcgtcgagaaagcggtcttcggaatatcttcagatctgattttcagttggtggtaacctgacctcaagtcaatttttgagaagactcttgctcctttaagttgatcgaataagtcgtcaatccgaggcaacgggtacttgttctttatagttacttcattcagggctctatagtcaattaccattctctcagagccatcctttttcttaaccagaagcactggggctccccaaggggatgagctaggtcgcacataacctttactttccagttcttcgatttgtcttttaacttctgctaactcattagcggccattcggtagggtctttttgcaattggagctgtgcctggtgccagttctatggcgaactcaatctctcggtctggtggcattcttgttaattcttccggaaatacgtcgggatattcacagactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagttaacttcctcaattctaaggttaacttccgggcatatttgagttgcccttatattccttccaggggaatgtactatcattggtacacgcaaattttgggttttc

SEQ ID NO: 57710 - DNA, 1673 bp, Oryza sativa
agagagagagagagagagagctctcgggagagtgggccggggagggagagggagatgggccgagcgagtttcggcccatcgaccttgggggaggtaaactagactttgcggagggattttgatttagaaggaattggattcggagatgaactcgacgatagatcggggattgagatcatgagatggcacgggcactagacaacaagcaaggaaacaaatttcgcaattagggtttttaagagataattttcccgctaggcgccacgacggaacgggcgctacaacaacgacaaggaggaggagcagtgctgcctcctccctcgtttcgctcgccgtggcattatcgcacgtcttcttttgtacattaccaccggccgcgacatatccatccacagctactatatgtaggagtacgtactaaagattagacgaagcaagatcactatctagctagcactaggtgccacgaataaatagaagtgcatgacgatcggagagcgctgggcgcctagcaacagctcccgcagcaactcgggataaaaaccgactcgatcgctcatcgcgttggaaaccgactcgatcgggcaccctgcaccctgttgtcgagtttcaaaacgggcctcgcgcatatccgccgcgggcgcagacgccgccaatggagggtcccgcgcagatgtggcgcttctttttgctttttttttttcccgctgctgattaccgcaccgtgtagggggactcaacatttaaaactttcaacttaagattttttgaaatttttaactaagattaaaaaatttcaagtcaagatttaaaaacttttcaactcggatttaaaaactttcaatttagaaaattttcaactcggatttgaaaactttcaattcagacttgaaaactttcaactgaagatttaaactttcaactcaaaattttaaaaaatcaagtcaaaatttgaaaacttaacacatgtttgaaaacttttaactcagaattaaaaattttcacattcgacttaaatttgaaaacttccgtctcaaaattcaaaacatttaagttaaatttaagaaactttcaactgaaattcaaaactctcaactcatatttgaaggcgaaagattgaatttgttaaatatcgtaaaacaaatcatgcgtgtgtgtggagaataaaataggaagcgatttcaaaaaaaaaaaagaagcaatatcaggtgtaacacgtttcttagttccctcagctttacgctaagtttgaattgcatcattcaaccgcaatatcaggtgtaacacgtttcttaacttgcaaaaccggtgtacttgaggtctcagggcaatatatcgcatggttttgcctgacgtggttaatgggacctacatgagccccacatatgtcatcgaccaactcttcttcctcatctctctcacattcttccctcttttccccatccctctttagggcaggtgctgctctctcgccgcacaaaagcgtcgtcatcctattgcacacacggaggtgcggaaggacctccagccaatgtatacattaatcatcgaatctgcatctatcccactatatcagtatcggccaattggttcattggtacagttctttctgtcatctttgttatagtctctaatgacatgaattaatacatagaatttatattagacttgta

SEQ ID NO: 57711 - DNA, 11921 bp, Oryza sativa
  unsure (1)..(11921): unsure at all n locations
atgaggccgcttgcttcttgtaacttgtacagtaggaaggagagtggcactgcgctagtgcgctgtgagcagaagagaacacgcatgcatcatgtgttttctttctgttgtagctgatttgagcaatattaactgcattgcaatgtattttctggagtaactttgtatgcaaccgtgggttccaaaatggtgtactacttttgcccggcagaacttcgctgctggctcctgcatcaaaatgatggttatgccacgaaatgtgtatcggttcgtgccatatgatttgtaactctgtatttccctgcgttttagttctgtcatggaatgcgtattcattctccgtcgatgcatccactgaactgcagtgcaaatgcagtcagtgctcatgaagtttttcagttgcaaacttggaatatattccacagaaccacagaacttgcggtggacgaagattaactgcaggtacatgattattgaggtttattacttcaaatattaaaaaataatttatctaataatttaaaacaacttctatataagaaagttgcacaaaatgcactgtctagtagtttgaaaaacatgctaataaaaatgaggtaaaatcagtatcactgtatcacaatgagaaatgaacggactatgccttttttttttccttcttccaatcgatttcaagatgcactatggttaacggactaggccatactctttttagattactagagtgagctcgcgcgctacgctgcgcggtattgtagcatgtaagactgtaacgcacagaaagaaatgtacgattgcaaggtttgtctaagaggattacctaacaacaacagtcaattccttgtgtacctactaagaacattatttaacctgtatagttttttttttaataactgaagtcgccagaaacagttcctgatagttaataatttaaacaataatttcacaatacatagcaggggtggcaagcatagtatgactcatccaatatcaatgggcacaagatgcagttcgttatgtcaactaactgaaaatggaacatggttaaatttctcgtagttttgtttgcgaggactgcagtattaagataatatctgtaaactctagaactggccaaaaacccagtcagatgagacaatagtattgcatttatcaactatggtatgaaagaccgactacatatttcagattcattagttttaagaagagacttgacacttcactatgagaactttctgttcaagaaacatatccgcctcagcaattcagtcaacttagatcaccaggtgcaatggcaagcatctgctaaaatcatttcttgaacactaagaaaatatgtgccaagttaaatcattcctaagttaatagtttggagaattaacttagcatattgagagatgttactaagtcagtagaactcaaagtttggagaattaagtcagcacatggagagatgttactgagtcagtagaagaaactcaaattaatgaacagatcctcatttcagtcagtgttatgttactaatcagagcagtggactcttaaaatagccatgtaaatgaacttatggttcctgaaaagagacatttaaatgcaacaactgagtatccactgtgaatcaatggacgatgtatacatttacatcacctgtctgattaattagctaccaaactactttgagagttgaatatttgtatagctaaggcagttgtagatgacaaagatgatggatatacctgccttacagtatttcgaaaagaaaaagatcatcatggttaacacatgtgtagggatatttccataggtatttcaaatggttttcctgctttccgtaaaaaaaaaatggttttcctgctaagcatgagcttcaatcttgtcgcagtccttgaggagaatctatatgatattatgaaatatgttaagataaaaaagtgagcgaagtacatcaattatgcaagtgagaaaaggcagtcactactacatcagtgcaggaaacaccaattattcaagtgtgggattgaaccaccactgcagcatgatttttagcttggaaacaactttggaagtgatgtggtggcagaacacaccaatggaagagctatatctgcacaggctataaagaccatattgtttgtgctttgctgcactcaattggcttggcattgttaaactttgcactaggatcacctaggttagatctagtcgggtggttctatttgggtttgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcgggagtgacggtcgtagatgtcccggcgatgaggtctggcgcggcggtggcgcttcccgtcactggctgcgccccctctcgatcggattagggtttgtagggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacagtgatcacaacgaaaagatgcaaatcttagcgtacattaccaccggtagcagcaacagcgagaacagtttcaagttcaaaaattaattgtatgagatgcatatatactacttcatacaataattttttaaactgatttttaggtgctctttaaaactgatattcaaaaccttgatcagaaccaaatggctcgttagaacataatgccctatttgaatgggagagactgatttcacagaaatataagtgcctcctattcaagcagcccctaagtctatagggtgggtggggagaggagcaacgatgttggttagatggcttaattgctgttcccggattttttttttaaaaaaaaagacacgttgaacgaatactctcgacctcctttttctactggagtactttgagtcaccaacatatagatccttcttacttccaaaatataaacatttttagaatagtgtcaagttattttttttaactttaactattagtagaaaaaagatcaatcatgtaaaattgatgttactaaatttatcattaaacaaactatcataatatgcaactcttttttatttaaaacattatatatatatatattattgatcaaaatagcatctcgaaaactgtgtcgaagtttaaaaatatttatattttggaacgaatagagtatgtatccacatgttagtgatcctaaaatcacttgatttaaatcaaaggatctcagtctaggataaatcagggtacctacgtttgctactaatcaaagacccacacaagacacgttctccctccgttccgaaaaaaataaatctagtaatggatgtatacgaatctaaacatgaacaaaggtatctccagattatagttatagatatgtcacatccagtgctaaattgtttttttataggacagagggtgtaagcattgagcatgctatgtatatattcctactcctttggtcccaatataaatacacttaatgcataatataaatgcacttagtatatgatgtgatatattctaatacacatactccctctatccaaaaaaaaggcaaaccctggatttccgtgttcaactttgactgtccgtcttatatgaaatttttttataattcgtatttttattgttgttagatgataaaatatgattaatattttatgcgtaagttgtctttttacttttttttataattttttcaaataagatggacggtcaaatgttaggcacggaaatcagggtttgtttgtctttttttttatggagggagtactcttttctcaaagtagttgtacctcccaatatgatgatctatgaccacgagacatgacaacaccaacaatgaccccgaccaaaagcaacctcagtacgctctgctcagtgcttggggtcctagctgctcctatttggtgcgtgaagcaattctcactctttcttcgtctactaggagaggcgaagtagccaactaaccgcggcgatgtcggcggttgagaggaagacggcgtgcgtgaccggcggcagcgggtatatcgcttcggcgctcatcaagatgctgctgcagaagggatacgctgtcaagacgacagtcagaaaccccggtgagattcttcttacttctcaccccaacaatggtctgtagatcgtcttcagttcattgattttgtgtgtatgcggtgacgatagatccgggcagtaacagcatgctgtgtgcatagaagattttgcggtgttctgtttggtagaagataaatgctgatgtttgatttgtttcaagttgatatgaccgaagaaaactatttcgggaattcacaagaacaccattggtttggcctctgaaactgcagcgcattgtgattttgagttccagatgatatggagaagaactctcatttcaaggagttgcaagcactaggccccttgaagatcttccgcgccgacttggaagaggaaggcagtttcgacgaggcagttgccggctgcgattacgccttcctcgtcgccgctccgatgaacctcaagtctcagaatcctgaggtaaatgcatgcagacacgtagcacatctcccaccaaactcagtgccattgtggggccaagtgccactcgatgttgtccacttgtcctaggtagtaattgccacttgtcaagtctctgatcgctgccaggccactgttgattagatatcaattatgtcacattaattactattccttcctccaaaataagtttgttttttacctatctcacacaaaccaatatttacctacaagcctataatatactcactttattaaatcccaatataattatttctatttttatttattctcaatacatatatactatcatattttcaagaactctaatgtaatgattagttaaaaataaatttattttgggataaatgggagaggcttatcatactttcacatgatgtaatgattactttaaaaataaatttattttgggataaatagaaaagtctaaaactgaatttattataggacggaaggaataatatttcctcccataaaaatcttgtctctgaaataataataataataataataataataataataataataataataataataataataataataataaacaactttattatgtacgtgtccaatccaatactatgttgttttattttgaaacgggagagtacttttacttgtatcgtcacgattaatttacttggtttgtctagtaaatcctctccataataaccagctgaaataacgatctagagtattatttggtaatggcagaaagaactgttggaagccggcgtccaaggcactctgaacgttctgaggtcgtgcgtgaaagccggcacggttaagcgcgtgatcctcacatcgtcggcggccgccgtctccggccagccgctgcaaggagacggcaacggcagcagccatgtcctggacgagtcgtcctggtccgacctcgactacctcagatcaaccaacgggatatctcctgctcaggtacacacaaacttacaaaattttacatgttcagtcagagttgatagtacagtcgcttgcgtgagagcacagcggtggtgtttgcgctgcaggcttacgcgatcgccaaggttctctcggagaaggaagcgagcaagctggcggaggagaacggcatcagcttagtggcggtgtgcccggtcgccaccgtcggcgcgtcgccggcgccggtggccaacgagagcgtcgccaacgtcctctccttgctgtccggtgagtacgtaagcaccggcagtattgtttggagatcatggatggaaactctttccctccgcacggaaaacggaacagttcattaacacatgattaattaagtattagttaacttttttaaaaaaatagattaatttaatttttttaagcaactttcatatagaaagttgctgcaaaaacatattgtttagcaatttgaaaagcatgcgcgagaaaaacgagagagaagattgagaaccctcagtagcaaacacgacctaagtgtgctagaataaactccttcttccaaaaacccaacctagtattagaatgtaatataatttagtataacgagagttttcatggtatggagggagtatctggttcggactcacgtgtccgattcgatttcaggcaacgaggagatcaacaccctgagaatgattgaccagtactccggcgggctgaagctggttcacgtcgacgacctctgccgcgccgagatattcctcgccgagaaagcgtcgccgtcgccgtcggggaggtacatctgctgcgccctcaacaccaccatgcggcagatcgcccgttccctggccgccaaatacccgcaccacaacgttgacatcgatgcgtaagacaaaatcatgaactggtctcaaagattatgcgtgtccactgcgagctgactccgacggtggcggcggaacatgcagactcggcggcggcctccctgagaagccgacgatcctcctctcgtcggagaagctgaccagtgaagggttcgagttcatgtacaagacggtggatgagatgtacgatgatgccttcgtggagtacggcatggcactcgggattctgcactactgacgccgacgacaatgctgttactacccagcttcgcaaccaaacggctcttgcaaaaataagtatgtgtaaaacagcagtgaatttgttcccatccgcttttatgaaaaacgtgcctattgacacgtcaaactgttcaataaaattgtgctcctttcaacattttctcaatttctacccctcaattttcacatgcacaattaccaaacgattaaacaatatgttttttacaagataaaagtatagaaaagttgttttaaaaaaccatatcaattcatttttcaagtttttcagttaaatagtatttaattaatcatgcgctaatccgtcactccgttttatgtgtcgggaggaaaggattcacaaccctcactaaagaacacaacctaattgtggctctatgattttcttttttgaaacaagcaagagatctgtcatttcattaagtagcaaagaaaatattctggtggaacaacgaagcctcacaaggtctttcaaggtccccagttcagcatctgaagatcaggtcgtgttaggccgtgtttagttccaaaataattcttcaaactttcaacttttccatcacatcaaaacttttctacacacacaaacttctaatttttccatcacatcatttcaatttcaaccaaacttctaattttgatgtgaactaaacacaaccttagtgtgggaaagttattacagagatgcgaagacaacttcttcctccttttctaaatatttgacgccgtttgatttttttaaacatgtttgatcattcgtcttattcaaaaaaaatatgtaattattattttttttctatcatttaattcattgttaaatatactttcatgtataaatatagttttacatatttcacaaatttctttgaataagatgaatgatcaagtatgtgctaaaaagtcaatggtgtaaacatagggagtactaataacatgaactaacttgctagcttttttttttatgctagctctctcagctcaactttgcgggcatcgcaggaattactttttggtatgattaatcacacacacaaacgagaagtccaattcgcaggcatgcagcgttgggttacttttcaatggcgcgtgtgctgttcctctctcgcttttgtttgcatagagaaagaaacggatcctatcattttcaacgatgttaaatcgtcacaggcttcagcgtcagatgtactacctctatcctaaaaaaaaaagttcaattctaagaatgaacctgtacacacgtcatctgggaagataagatgatccttttttcttggagcaaaagctttaccttttgaaaacacgatcgaccgcattaaaaatgtgaagcgtgagatgttcatcgatcgacataatcgatcagtgcaggtcattatctaaggaaggaaaatcaatcagaagagcaggtatggtgcatgcatcacgaaaagcatttcttgttctgcctctctgtctggcgactggcgtcgtcgcttgtaaaatagtgttggctaagtcaaatgtattatgttcctgctctccgggatttgtcctggcaagtgccacaacagcgcaatcagcaaaagaaacctcatcatcagtgtgctgctcggattctacctgggagtaaacccaagtcaccttctctgtcacaggagaggtattaactgaccggagagagagagagagacgatgtcgtcggaggttgagaggaagacggtgtgcgtcaccggcggcaacgggtacgttgcttcattgctcgtcaagatgctcctggagaaaggatacgctgttcagacaagcgtcagagatcccagtgagattctactccctttctttcttgttacatgtttttccagtgttcagttttaactgaaaatcgaagaacatgtcatcagttcataatttgtttcagaggagtatttgcacgttcagttttgggattgattgtgtcagtacaattttggtttggcctctgaaactgcttttgtaactctgaatttcagataacccggagaaggtctcccatttcaaggacatggaaaaactcggccccctgaaggtctttcgcgccaacttggaggatgaaggcagcttcgacgaggccgtcgccggctgccactacgccttcctcgtcgccgctccggtgtacgacaagagccacaagtccgacgatctcgaggtgaccactgctgcaacctgcaagctcgattagtatctgtagtcagttagttagttactgaattctgaacttggccatggcagaaagagatagtccaaggcggcgtcgagggcacactgaacgtgatgaggtcgtgcgcgagagccggcacggtgaagcgcgtgatcctgacgtcgtcgacggccgccgtctccagcctgcggccgctggaaggcgccggccatgtcctcgacgagtcgtcctggtccgacatcgagtacctcagatccatggagaagctgtcgccgacgcaggtacacatatatacacacgagctgttccatgtcactgaaccacagcaatgtctcgtagaacatgagttcggcgccattgttgctgcatgcactgcaggcgtactcgatctccaaggttctttcggagaaggaggcgaccaagttcgcggaggagaacggtctcagcctggtgaccctctgcccggtcgtcgccgtcggagcatcgccggcggtgagggtcgataccagcgtcccggcctgcctctcgttgataaccggtgaggaactatctagcgatcaccgaatgaatgaaacaagaagcaatccaagaactcgacttctgaacgtttttgggtcgctgcatcgatgatctgtgaattttttttttcaggcgacgaggagatgatgaacatcctcaagggcatcgagaaggcgtccgggtggtcgatgccgatggtccacatcgaggacgtgtgccgcgccgagatcttcgtcgccgaggaggagtcggcgtcggggaggtacatctgcggcagcctcaacaccacggtcaccgagatcgccggcttcctggcggccaagtacccccagtacaacgtcagatgcgattggtaattaagaaattaagctttatgcattcgtgcatttggttatctgaatctgatcatgcgttgctatgtacgcagcatcgaagagcatcaccccgagaagccgaccatctcgctctcgtcggcgaagctcatcggcgaagggttcgagttcaagtacaagaacctggacgagatgtacgacgacctcgtcgcgtacggcaaggccctggggttgatccccaactgatggtgatgatgggcggcgtaattccactgctttggcgattacgaccaaacgtgtgttgctttcaaaaatactattgtgtctagcattctattgctacattgctagtagtactagtaccaagttccaatacatttggcggtttggctgtacttcgttctgttcatgtaagaggaggattgagaatttgagatcctcttagggggtaagctgtctaattctccggaaaggattagctgaaatcctctaatagtttttgcaataccaacgtactttcccggtttnnnnnnnnnnnnnnnnnnnnnnnnnnnnnaaaaaaaaggttgtgtttagtttcttggccaaattttttttagtatacggatatacatttgaagtattaaacgtagactaataacaaaacaaattacagattccacatataaactgcgagacgaatttattaagcctaatgtgtccatcattagtaaatatttactgtagcatcacattgttaaatcatggcgtaattagactcaaaaaattcgtctcataatttacatgcaaactgtgtaattggtttttttccacaaataatactccatgcacgtgtccaaacattcgatgtgacctttttagcaaaaaaaaaaaatctaaacacggactaagccacatgactttgagtcactaacatgtgggccctctttactatggatccatgtgaatccgtaatgggaatgttgtggtctggcacgcgttgaaaaaaaaaaaactctctgaacagcgtttctacctgctgcgacactgctgctgctgtcaggtgcagccgagcaggttgagaaggccaaggccacaaatcgatcggtcaattgctcacgctacacgacggcatgcggatgcgggcaatgcgagcatgcaaaaaccacagacgtcacacgctgcctggctctgtcacgtactggccacctcgtgtttcacctgggcacggtggccggcctgatcttttgtgcagtgcgtggacgagatttttgagcgcgacgggcacgtaaccaggcaccggggcgatggatgcgcggcaagccggcaacgacaatatccttggcatcaacctccgccggtcgtcaacgtgggactagggatggcaattgtgcccgtttgcccgtttacccgcgggtaaaaaccctattagggttgggtttgttctccattttatacccatgggtatcttattgggtcaaaagctatgcccgatgagtaaatgggcatgggtatgggtaatcactacccatgcccgctttgcccgtttacccacgaaatctaacttatatgtaggctaggagcaaaatccactagaatacataagcccagttctttgatttcttcggtttcccttttatttcccttattatttctctcctcttactctatcgccgccagaggagagacacgacaccgaggtggagaatatttgatgttttaagttcgattcgaacttagtagcttgtagactttttgttccactgcttttgttgtggcgggtaaacgggcacgcccgcgggcaatgggcataggtaaccatccttacccgtcatgtagtaatgggtatacccacgagcacaaataatctcacgggcatgggtataggtaggcactacccgtgcccgtcgcgcccgattgccatccctacgtgggacaaggcgaacggtggaaattagtgcagagaaatcagtcaacggatcgcgcatgcgacctcccgctcactcccggcgcgtggtcgcgcattcccgatcccctccctcgcgggctcgcggcccaccgcggcctgctagctttctagcgcgcgcgatgggctgcccctgcctgctcggcatcagccccaattaggaaaaagtggatttttt

SEQ ID NO: 57712 - DNA, 818 bp, Oryza sativa
aaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaagtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagctttttgtggcaagtgagatgtacagcagtgttgttggtaacattggctttgaaccaaaatcaattattaggcacatcgagaacaaattcaagtacaccataagctatgcaaaggcctggagagccaa

SEQ ID NO: 57713 - DNA, 5965 bp, Oryza sativa
agtggatgctggattttgctgtgctaatgttggatgctgcagaaagtttttattccttctgttcagttgagatttttccttttgtgaaaataacacatttctgggatgaatggccgaacaaataactggatgacaattttaagtatttcggttatacaggaacacaattgatacatggattatgctacagatgctatctctttccatagcttatggggagttgcagaaccagtttaacatgacacgacttttacacatggtacaagaaaaacgagttccatcattcaaggaaaaaaaatgaacaatgatgttcgtctcagttctcgctatgccattgtttgctggagctcacctgcagagagatagacagtataaattagaggaacggcgtgtagaattgtgcagtacatatattcagtccgtcatgtcttccggtcggttgagcatacaggttttatgtcaaatttggtgatgatatacaggtgctgctatcaatttcatgagaaacacgccgatgcacatgtcaaataataaattctctcctgctctacctcatattatcatctctgatcaaggcctccaaagaattgttccaagcttgtagagctgaaaacattggatgctactctttctgctcgttgtggagaaatatgtagttgatatttgataaacctctgcaagggagcatagcaactcaaaacctgcttctataagtatgatacttgattgttaaaattgtgacttacagctagctgatgaacaatttctggactagtatcaatgtgccaatcaggttccagttgccgcacaaaagaggtgcggccattttctgtactacagaagagaacctgccatttgaagaaatgtacataaggtccattgcgaacatccaatggctatacccaaatgaaaaaaaaaacgattaagcagttatatttctgaagtgacctcatcatgcggcttaccttgtcctttatcaatccactgttcgtaaaaagtccagcttcactcagggcagataacaccttttcctgcaacattattcagttgtgctgatgtcaagctataatagctcattcaaattccgtactaggcagtgtgtctatagtgatgattccaaaaatactcttctgcttttctttttttaaaaaaaaaaagaacccctgaacataatgaaataaaatagcagaccaggtagttgttcattcatcgtattattccgatatcaatggtaaattgattactgtttattccgcgtgcatatgccgatatcagtatatattgacatatcaagtcttgagcatacttgtaaagcgtaaaacataaatgcaacagaaaaaatgcatggtccttattacttactccgctttcatcgtcaagaatgcgctccatcagatagacatcacagaattttgcaatttctagaagaacctccaggacagaaggtctcactgtgacatggttctgaaaaaaaagtataattccgctaaattaaattcgttaacaaaaaacaggaaattttttttgcagcagcgcttttgctcacctggagctcctctggagttgtttcctccaaaatcacaccaagtaaccggcatgtaacctaaacattataattcacacatgggaaagaaacatgcattggtataacaaaactttaaatttcgtgaaaaaaaaaggtgtgaaagcagttgcttgcaaaatacccttcgtccttcgctcagtttatgcctaacaagctgctcaagagtcagctggagaagaatataagcaaactatcagtccaaggatcctaaaagcagatacatcatttcagtattcagaaaaggaaacaggcaatacgtttactggctggaaaagctggttgattgcttcctgtgctcttgaatctgctgaagatgaacaagcatccgttgaggtcaaagcacctggccgtgatctactgctggtgttgctaggtgatggagcaacgcgtctacgtggcctccgaggttgctcttgaggagctctcaacagtttccaggcaaagataagtgtgattgtaattgcggcaagtgtagtaaatgagcgaagtttctaaaatagaagattgaagtaattcaataattcttgtagcaagaattaataaaacggactttgtgtgtgagaaatcacaaaaaatggcaccaattcactcatccaaaccacaacaacgactgatacaagggattaaaaattgacaccaagtacaatcttttgtggaataatatgaatgctcatgctgttgcaagttgcaacatagggcccagaaggtcgattttcgagcgctacggcacttttaagtgctttcacgtgatttgatacctaaagtcgttttaatgacgttgtagcgcagatttctgagcatagaaatcggtttacctcgccgtgcatgcacatgtcatgttcgcatgtgtatgcctgtgcttgcatccattactagcctaggatctgcacgttgtattactaccgagttcttggaaatagcgttgtaaaacactacagtcaagagaacttacaaaacgacaacatgccattaacgaattatttagtgattcattaactgactatagaggtaagtagatcattcgatgatatcacataaagcaagccatcataaaagtttgcatctttctggccaaccaaacttctacatagtaactatttctcgcagcactattagcctattactaacctaaaggatacatcaaaatctcaactatcacaatgacccaaatacgaccacatttcccaaaagggagacatatcattagcgaactgcgaatccacgcctaaaaatttactacagcttctagcttgtacagctgctaagaacgaattaccaaatcgatgcttcgaactcatatgtatgtaataacaactaaacaatagtagaatggccacagtataaaatatagttccaaacaaaaaagactagccttccccacaaacaatcaagcaaggcgcgccacctttacaccacggaccaccacaaatccctaaacagcgaggaaaacctagagattatcaaaacaccgcaaaacacacgcgcgacacgggggggatcacagatccgagcggcaaacctggcgatcgaggtcgaacgggaggcgatcggagtagcgggcgagggcgtccactaggcgccgcaccagatcagccagctcgtcgtccttcccgccccccgccgcccccgcctccacccccgccgccgacgccgctgcccccgacgacatcggacgcgcgcccccgctgaccaccagaacaagaggaggaggaggaggaggacgccgcggcggcccgaaaccctagcgcgcccgctcgcggcggcgacggcgaggaggaggaggaggaggaggagaagatttggagggggcgaagtgtaaattgtgccgtctcttctacgagggggcgggctgcgacatgtcggagggaatgagggcggaggagagggaagctcgttgtttttgcttgcggcgtggtaggagacggttattttgcagttaggtccttgaagagtgtctttatttttggtaataggtctttcagttttttttttgttttactcccagtcacagtcttcatggttgaaccaaccaactgctcgaactatgactttgggtgtgttagttacgcgtaaaatttgaacgtgtcacatcggatatacggatacacatttaaagtattaaacgtaatctaataacaaaataaattaaagaatccgtatataaaccgcaagacgaatttattaagcctaattaatccatcattagaaaatgtttattgtagcatcacattgtcaaatcatggcgcaattagtcttaaaagtttcgtctcgcattttacacgcaatctgtgtaattagttgtttttttatttatatttaatactctatgcatgtgtccaaacattcgatgtgacatgtgtaaaatttttttttggcggggaactaaactggccatttgatgagttggttttcttctatggttggtctaattttgtactcctcggtatgagctttacatgatttcctctttattttttccctttgagaccttgatttcaacaaacttagcctgatccatcatgttttctgtacaaactattgaagtactgtggtttttttctctgcgaggttattagatggtgtttttacgacacattgacacacggaaaaagaacggaaaaaaacagtttctttttccgttttacacaagatggtggtgtgttcatgtatattttctccgtgttctaaaaaaatcaacatgattcataatattagaatatgttatatccggtattaggttgtttaatgcatgaaaagaaattccatcaaacaaccaactctacaacgactcgacgattgttccagattttcattttcattgctgaattgctgaacaggcaacgagtaatgttcgtgtatggcaaacatttgctaattggcactttggcaggtaattaatccgtctttaatttttttacagcctcaaaaactctcgttgataacctgatatatacacacagaacgcgctctttggcaacgctggctatactagcaatcgaaggaataccgcgacgacgacgacgacctgtgccgccgcacgccgttcgccgcctccgccgccgccgccgtacccaggctcctccagtcgtcgtgctgcgcggcgccgttcaccgccgcgcgttccagcagcttggacggcgagacggccgccattctccccgccttggcggcggcggcggccgacgcgccggcgagcatgtcgccgccgccgccgtccctccgcgcctccttctcgaggtgctcgcggtagagctcgtagacgcggtggctgagcatgacctcgaagtccagcacggcgaggagctccagctccagcctgttcatctccgcgttgctcacgccgccgacgcgcgcgaagaacgcgttgttgtggtggctgcacacacgcgcgcgaatggtaattaacccaacagaactgaagtatacagtatactccactaattcagaaactgtttttttttcctcactcgagtggaactacgctcatgcaactaaaaagtcactctcttttttttaaaaaaatatcaacatataacatttcactctagaaacattcaaattaaaattctagttctgacatacaaatagagaaaaacaacacatctaaactgctaatagtacataattttttattgtcatatttataatttttttatttctatatgtaggtcgaattttaaattgtatgtttatagttgatatatcttatcaaaatgttttaattttttatagtgacaggcataaaacgagtgtatgtacataaaagtggtaagaagatttcccaactactaggttactgtcacagtgtaagtactaactaagaagcaactaatcgctgaataaatgcaactaactactaatcgaatgatgacacatggtactagcactaatgatcgattactgacgcgaaaaatgacgttaagctgtattgatcatacgcatgtcagtatcagaagaatacgtacgtagggcaaccacctactgacctgatggccaaaggattaaattgagcatcaagaaaaggatggataaccctcggtcatttccatgccttgcaaagtctactccattaaaaaaaaataaggaaaaagtacgaattaccctccgaactatagcagtcgtctgaattaccccccctaaccacaaaaccggacatttttcaccctgaactatgtaaaccggacgaattacccccctcgacccaaatccgcggtggttttggtctggcggtccagtcagcaatttatttattaaaaaataggtgggccccacctgtcagtttatctctctcttctatctcttctatctctcattctctctctcttctccaagacggcggcggcatggcaggagcgcggcgaggcgaggcggcggcggagg

SEQ ID NO: 57714 - DNA, 4655 bp, Oryza sativa
tccgccgcaccccgccgccgctcgccgcctcatcccccccgctcgcctccaccgccgccgccgctccctgtcgcccgcctgcctccgtgtgcgtgagtgagaagagagtgagagaagagggagataagagagagaggggaatagttggataggagtatgacaagtgggttccatatttttttaataaataaaatactgactggactaccagcgtatgccacatagaccaaaaccaccgcggattaggtcgaggggggtaattcgtctgatttacatagttcggggtgaagaatatccagttttatggttcagggaggtaattcagacgaccgctatagttcggggggtgattcgtactttttccaaaaaataaataataattaccgatcgattaattcattcttatttaattgtggtattggttggtctcaatctacccattgactgttcatgcagtagtgactgcagatctgtggttatgtttccaactgttcatgataagaacaaacacagttgctgggattaatacacagacaaagtggccacaatctttgtgtttgttcttcatgtatcctaacaaaactgaggttcttttacatggttcaattatgtgtaagattttacttgcgaacgagtaaattagaggttaattaagaagagatgatttatgcttacaagtcgtcgagaaccttggaggcgacgaggaggcaggcgaggaggaggcggtggacgttgcgggaggcgacggcggcggcggggcggcggtgcgccgccatgtcgacgtacgcgtacgccaccacgtagcactccggctccagcccggcgtaccggtgcacgcgctccagatactgcgccacgccgatgcgcggcgccggcgcgcccctcgccgcctcgaacgccgccatccctgctcctagccccgccgccgcctcccctccgccgctcagcgcctccaccgcgtcgttccgcgccaccagccgctgcacggcgcgcgccaccatgtccagctccggcggcggcggagccgacgccgtcgccttctgccgcgacatctcgccgcccgctgccgcggcggcgtccatggccatgcacggcatcgacagcgtggagtggcgcgcgttagctcaagctgtagccctgtagctgattcggcttggcgcttttttttttcctctttttggttggcgggggattaaccgcgggaacggacggtggatgatgcggcggcggtggggccgtggccgtccgatgaagctgtctctcttcgattttaggaacggaattttctgtttcgcgattcagacaacaccagaatggactgttcaacccttatttccgattttgtcggcattccgtgccaaaatcgtgatccgaaatggttttttaggagtggtggacaggatgctcatcctctcccactcaccgctctttgctgtccataattttagcacagtttatcgttaaaaaatatacaacttttaaagcgataaactttaagaaaaaatatgtatatttagtttattgatgtcatattattctcatgtttttttttcatccgttcgtcatcgccacttactgaattctaccgtaatttttccccttaaaaattgcacacttggacacttggttcatttaagtccccctctcatgctctaattacgcgttcaccgctgactgaaatttgggttactagaaggattttgctcacaaacttttgactcttctatcagtcaagaaaaaggaaaacctttcactctacttgttaggcatgcggcatcaaagttttcttggtcagttttggacttgtggttggggctgcacggcctaatcaaagtgtgatccaaatgatggttttatgccatcatgggccagtggtgtcactataaattcaggcctgataagcactagtgttctgaatatcttcagagttcagaggtgaatacccaaaatattcagaaatcagtagtcatgagtttatacttttcagctggaacgaatttgctattgctcgagcaccgaatgtaggatcaactacttcacaatctccagaactccagaagaagtttatcactgaacacagttcatggacaaactacccggtaatccgaagaacaacacctgcaaaaaaaagatgtgaaagatcacatgtcaggttgtcttctccacaccgctttagctcacatggctggagaagcgagcatgtcaacttgggaagtgtgctaatgactccatgaaattaaaagatcggaacggtggggacgaagtaattaagcagatggggggctggtgctttctgacctccggaattcatgtctgaattctgaaaacacaccggacaaatgctccggtctgaaagatgacagccgttttttctctgttccttcctcctcgcttttattatggctttctgcaggatggtgcaggtgactgttggctcaattctggagaacgcttttcttggccattcactggcctgaaactctggatgatttgattggattgacatgatgcattgtatcatatgatggcctacatgctaccttgaactcctcaattgatcagagagaatcagttgcatttgcaaaattctgcaatcttctcatttcaggcttcagagatgctatgggctgcagttgcagtatcctggcatcaccaacctgacggtccttaatcgtagaattattgaaaatcttcactttatctgcataaaagaggtgacatgtagggacacggacaggcatagatcactcgctcgctaccttcctttggcataggttaagttaataatcattgtgattctctgcgatttattctctgcttgaagagttgggtgagtgagaataataaactttgatgttctggccgtgcagatctctctccctttctcacgtgccacggttgttcttggtcccatccaagaatgggctcccactgggaaggaaggaacaaaagttcagatctatgatctatcgatctgtgtttcctcacaacgacagtcacagtaagtcagtaaaaaaatactcaggtaattaattactgtcttaagctgtaaataatttttgtttacccggactgttctgttcctaatcatcatcgagaggaggagttggagatgatgttgtggatttcgaggcgagcagctttaccacgagatgaagcttcgtctagttatagccagcgatttgacagtatgcgaataatgtagagtgtgatgtgttgtaattgcttcaaaattaatttgctttttattgaaggtttcggttaacttttgtgcacactcgccagtgagagtttggagcgtagtaacatggtttggtgatcacttttttgtagggcagtactgagttaattataatatttagaaaaggattaccatgtggaaaagggattatggtacaaccaaactgtgatgagcagtaaggtgtgcaagcgtcggttcggtctactgatgttacaacagcaaacgaggaaaaatcatggccaatcgcttgactaaagttggagagaattaaaacaggagaggaaaacacaaagcttaagacaatagaggagagaacaatgctgtgttctttcgagagagttaccaactcatttttcacgtgcacgattttcaaattactaaacgatgtatttttttaaaaaaagtttctatacgtaagttgcttacattaattcatatttcaaaacaataacaaatacttaattaatcatgttattttaaaaataagttaatatgatttttaaagcaacttacacgctcactatacttcaaattaaaactaattaaagttaaatggtcatgtcttaacatgtccagattttaacatgttttactgccttacacgtccactgtacttcaaattattaaaaccaataaaagttaaacacgggtattgatctcacgagcatcatttacaaaacaatgcgaatctgaacctgtcaaattactacagctttgcaaaaaacaaaacaaaagaaaaaaaaaagataaaaaaggcttaaggcgaaaggaagtctcagacctaaaagagggccccacattttctttcaccttctcttccattccacctctccatctcgccggaatctcacctccgatccggcggcggcgccgccaccgacaccgagaaggggcgtcccctccctccgccaccgcgcgcgcggcacgaagagccaccggagcattcaggggaggggcgttgtagaagcgcgggcggggggaaggcggggatggagtcgatcatagcgcgggcgctggagtacacgctcaagtactggctcaagtccttctcccgcgaccagttcaagctgcagggccgcaccgcgcagctctccaatctcggttgggatccgcttctccggttgaggatgccaatttggtcgcctccgggtgctaactttttttttgggcgtgatttgggtgatgcagatatcaatggcgacgcgttgcacgcgagcctggtgctgcctccgtcgctcgccgtcgagaccgcgcgagtcgggaagctccagatcacggtaatggcgggagccctgacccggtgcctttgtatatgtcagtgtgcttactcttcccggcttctccccctgaaggcttaaggggtgcatttagtgttagatttcttattgtttggtttccaaatttagatgatttt

SEQ ID NO: 57715 - DNA, 2876 bp, Oryza sativa
tgcaacttttggtgataggcttatttcgtttccctgctacagcttccatcagtgtcaaatgtgcaagtagaacccattgtggtgaacattgataagcttgacctcgttcttgttgagaaggacaattctgaagatctttcaagcactagcaggcaaattcattcttctggctctggtctcatatggttgaatgagcacagtcatttactgatttcagtcttctctgtcattttgttttggtttgcagtgctttatcgccatcaccagctaaaaacagcggatatggatatgctgataaggtttatttctttgaccttgatgttcaacgtaaacacattccaaacttttactctgtaaaaaattcaatatgctgtctaaaaataaaaattgtcacttccagttatccatgatggttgcatccaatgcacctattttgctatctgatttgataattcttctatattcttatgtgatcttgtctgatattctgaaaagcaattctctgctcttttattacaatatatacaattttgaaaaaaaatacgtgcagaaaattgaactatggatagggcttaatttgctataccgtggttagattgcagatggaatgacagtccaagtcggtattgtgaaccttctattagaaacacatggtggtccacgtcatcaaggaggcgcaacttggtattcatctttgtttgaatgatttttggccctttttcttatggcttagctccatatctcagttcttgttcatttctcttattaatatctgtttcatgatgtagcttttccctgcaatgtttttctgcaaacaggaacattcattccatctttccttttcaggtcaccaccgctagcggctatcacatttcgtgatcttgtactgtacactacaaatgaaaaatggcaggtactcttgcaaattagattagcattaaatatagtaaatgattgcacttcagtacctgattagaatgccttttatataggctgtaaatctgaaagaagcaagggatttttcgaacaataaaggattcatttatatttttaaggtttggtactctccttttctctccagaagattaatgtttatttatgttgctaactgttctattgacatttcttaaaaaaaaaactgttctattggaaacataatgaactgagaaatgctacacttgaaaggatttatgaccacacacatttcttctttcaaattcacagaaattggaatggcaatcactgtcagttgatctgttacctcatcctgacatgttcacggatgctcggtttaactcttctagcagtgaagatggaaaacgagatgatgatggtgcaaaacgaatgttttttggtggtgaaagatttttggaaggaatatctggggaggccaacgtgagtgcttttgaacttcaggacatatcatatggaactcgatgtttttcttttcagtttctcttgaacttccctctttgtgtgcttggcttacacattgctttgaacatcagatcacagtcaaacgaacagagcaaaacaatcctgttgggcttgaagttcagctgcatattactgaagctctctgtcctgccttaagtgaacctggtatttggttacttttcatgatgcttgatcccttccctttctgaatgctgtttgaagtggtatttgagcttgaatgctattttattcaggtttgcgggcttttcttcggttcatgaccggggtatctgtgtgcctaaacaggggtgatgtggatccaaaagctcaacaggtttgccttttccatcatgcattttaatcactgcattgcatgcagtacagaagtaggatgtttattggttttctttgtgtccttatttcttttctgcttttcttttttgaccagcttgcagaagctgcaggatcttccttggtatccattattgtagatcatatattcctctgcattaaggatgctggtatgtaccagctctggaaaacttcaaatatgctatgtttactattctattctgactttaaaccattttgtcaacagagtttcagcttgaatttctgatgcagtctttattcttctcacgggtaaatttctttaccttccaatttattgtactgatgtcatctgctgatgatatgattgatttaggttatgtaatttatcttattgtactgatgtcatgacaatcgtttttaaatttgttgaaggcaagtgttcccgatggggggatttcaagaaacttgtcttgcataaagattgccgggctctttctgaggtactatatgttactccctctgtaccctaatgtcgtgaccgagaaaaattaccttttcccaaacgctagtgtattaatccccgtctcaggaaaagccggggtacaccacacaaacatgatacaaaaggcacatctttattatatcaataatatttacattattacaaaggcactttaggcctgacaatcaaaaataaacagcagcggactagcgggcctacggctccatcttcacaggcgctcaactggggtataagccaggactccacctaggacatcttctccaaagcttctcttactgaaggggggaaagatagagcaaggatgagtacaactacagtactcaacaagccacaccgggagatgcacgattaatgcaagggggtacaaggggtaataatataggggttaagttttgcagtaaacagcatttaaaagacacttagttgctcaaagctattttgtaaagacgatcctagagatacacaatattattaatcaagaccgtgaacccacacgaacctgccttaacccaaggcgtacgatgattcagaccgaactggcaacccgacctgggtcccagctcgtcccaagccaatccgggcc

SEQ ID NO: 57716 - DNA, 1557 bp, Oryza sativa
atggccaaggcatggtcatccgaagtttaatgctgttatatggagatttgcggattattataattaagctttgcaactataaaacatgtgtaagctctagcctggaaagacaagaaggctgcgctgctgacatgcggaccccacatgtcaacctaagggaccacggtggaccgggtacacagagacagtccacgggtcgacgaaagcggacctcgtgtgttaaccgaggcaagtggccgacaaacggactctactagacaccacgtgggctgcacacgtggaaaccacgcggctaccgagcgggcacactaacacggtcaccacacgcacacacgaacgactaccgacaccggtacacgggtactggggtcgacaaccacacaacgggcacggggcaacaccgaaaggacgaggacggagcaacgagaggagggagtgggccgggaaggagaggagggaggggcggccgggagaaggaagggagggggagggagctggtccgaggggagaggaggcccgagagagaagggaaaagggagggaggagagaaagactttgggctgaactcggcccaaaggaggaaggaggattatttttagttttctttttaataaactttcttaattgttgttgttgcttaataaatatttccggtgctctgaaaattcaagtaaaaatttgagggctccttttagaccaaggagaatttaacaaaaattctccgggccacattcgaatttttcttgtacgtattttagtgtttgccaatttcttttcgaattttaattaattctattattccttttagagaatgatttttatttcgggatgaatttatcaggacgtgacacctaatataagggattttgacattttgcttgcactgtttgatcactcgtcttattcaaaaaattttggaattattatttattttatttgtgatttactttattatccaaagtactttaagcacaacttttcgttttttatatttgcacaaatttttttgaagaagacgagtggtcaaacgttatatgaaaatagtgaatattccttatattagggggcggaggtagtacgtgcatccttgagtcctttttactggagattatatgcacctggaagttcatcgtaattcacttgctcagttacaatacatactaaattcagtgcattttgttgatgcctataagtatcacatgcattaagcccaacagaatttagttgagtgcattgctaggttaccaaaagatgcatatggtgcaaaataggatacattcacagtttaacttttcgtaagtaagggaatttgtgttctacctgtgctagaatttttgtttgagctatcaaagcaattgaagaacctctgttcgatcctcatgtactgacatgttatttctccagggacacattttctcgtccaccatgcacattgatacagccctctatgcaatctgttccacaagaacctccacctgtgcctgactttggtaagactttatgatacctttgctgagataaatgaattggtcaagtctaacgcctcctattgaattg

SEQ ID NO: 57717 - DNA, 2441 bp, Oryza sativa
ttttgtgaaatgatatattaattgcacatgaatctatcttgtcaatttttttaaaaaaaaaatcataactatttagttgacattcatggtcactgctgtagtagtacaacatactccctctgtctaaaaaaaatctaggattggatgtgacatatcctagtacaatgaatcaggacggactaggatatatcacattcagtcttaggtttattttttgtgggacggagggagtatatagtaacctcttaccgctttatgtgattcctgctgaaatatttggaagtccggacaaaatacagccttcttttttgccgggtcggccgaccactttcattaagatttgagggagaaaaataataaattgttacaaacgacaatactacgatgtcgtgccagttcgggaaagatccccggtccagctaagaacgaaagagaaagaaaagaaaatagccggggcaaatcctcgagacctatccaccgtgatcactcgccaaattgggaaaagatcccagccactctccatacagtaattgcagtgacctgcatatagcctagtggttacagtgacttgagtagtaccccaaaatcctgagttcaaatctccatatgagcaaatttcagattgggttgtttatggagctagattccctatttcaatggcagtatatatacagttggttgtagaggtcgggtaaaaaaaaaacccttctctaaaaaaaatacagcaatttcctctcttatatcctccgctagttgctccggtaacttggacacatgctgaaatattcttgcattacgttccttccaaatcaaccagcaaattagcatgaatgcactgtcgaaatccgacatgtagctcgtccgaaaacaacgtcttgttgcaagccaccaatcggccagagtattgacatcatccgccgggattgcgaagttagcattgcaccatcttcagagaaggatgtgtggtgcaagaagctttcaatagaaacaactgaggaggggcatcaacatcatcaactaccctctagctatatcatccttgtcagaatgatacatctttgtcagggatatttcattctgcacataatcacaatatctggttaacacatctttgtcagggatgaaaaagccttcgaaacttctgcatattgcttgcctttgcttgtaagatttcttttttgtgttcttattgtttctgaagagcgtgtttgtaaggaacatcccaatggcgtacaagatgaaagggatcttcaagggactcaaggtcatctctcagatctttggtcagtacaatagtacaatgttttgggcttttcatgctcctctgcatctaatctcctttcttgcttgctgacatctctcattttctactgacggtcttctttcttgcattctctgaatggtttttgcagtagtgaaggagcatgagatgcagattggtagtccgacagacgtgaagcatgtcgcgcacatcggttgggatggcctgacagggaatgcttctccaagctgggtaaatgtacctgaatttcagtgaaatgatacaatcatcttcttgtttcaaattgtctgatttctctcatctgttctttagatgaatgacatcagggcatcgtctgaacttctgtctttgggcaactttgcaccatctgcagggacctcttgggcttctcaaggtatggcaagaattacttgttcttcagagtggaagattttctgtgttggtgcgattgcttcatatgattgtggcttctttgggaaaggctttggtctgtcttatgagtggcatgtatggataagcatgcaaacttggcaagttactctagtttaatcctagaatcatgggcacgtctgcatgttcttgatctgggatccggagttgcagggaacactccgataaaacaaatccacacttctgatttcctaactaccagcagcatcttttgccaggcaatggattgtgtgtacacatgattactgaaccttttgaaagaaaacttgatgaatgataaaaacatgtaagcctctggtaatcctcttcaatcattatgtgattgatggttagaatcacgagaatcgaaatttattacgagttaagtaagtgtgaggaagttcagagaaaacaatgtttaaccaagaacaatacactgtatcatgcatagtttaatactgcaatacggagtgagctcgagacgtggtctagctaataaactagcagaaattttcttgttgaactcatatggcaggacaggattcggatttgataagaacatgatgtccattgtccactcatgcataaatagatccttcccaaggcacaaacaccgtagattagattcccattgtcacaaactgctgtctgacagacaacaaacaagcatgctaatggccacggaacgactgaaattttgcatgatcactcaacatattcagttaaacac

SEQ ID NO: 57718 - DNA, 2292 bp, Oryza sativa
aagagaagttttttttagtgaaaaaaaagttctcccaccaattttaagagttattgagaggtattacctctgcttttaaatttatgacattgttgatttttggatatttcatttgactatttgttttataaaaaaaagctactcatttcattctagaaaataaaccaaagatttaccttataaattgtttttttatgaagggtgtatgtaagtatcatttattttgtgttttaaactaaaattatcattattttattattaaagacactctaaatatgactaatatttttttatatttatattttttgaatgagatgaatgatcaaacgtcatattcaaaagtcaatagcgtcatacatttaaaaacacatggagtattatatcttctagcattatttttttttcgccgggcttctagcattaatttgcctgaaactaataaaagttacttgtgatgggatgaacaggggagtgactaaaaagaactaagacacttggaaaagcctgcaaaaacaatcatgttgccttctggataaactgatatcacaattgccagtgtggaatctcagcgccggctctccagcctccagccatgcgtattccctgacgctaaagaacaagttgagcaagccaaccagagactaagattcgttcaaacaatgcagtacaagattcctaccaatggtggacagtttttatatcagctccactgttttaatttatacacatggttaatatgcagttatgttccaagccccagcctagctatagtctctgcttgtctcttccggagccgatgaactgatgaacaccgagatgcttttggttggataagatgccgttcgtccctgaattctctgaatccgtcctacttctggtctgtttatagctggatcatcatttcggtttgttgccgagtgaaccaagaacagaaaggattttaggtgcacctttcgctctgacgctgatgaatgatgagtaggaggttgacattgtcacaggtctgccattgctgaattcttaagtttagtacgatccctgaaggtcaatatcaaatcggtgttaatgtgtgtagatggtactaagtttgttgcagtgatcattttcagaaattgtatagtacttgtgctgttccctaacccagctagccttgactgactgcaaaatattcttagctagagcagattcgtgtgccagatggttcctacctcgaaatatgtcttaaatagtacgttttgttcttcaatatctcagagtgatacctgattcagacttcgaaatatatcttaaatagtatattttgttcttaaatacctgattcagactctaggcaatttttactccatttcttgtacttgtactattccctaacgcagctagccttgactggctgcaaaatattcttagctagagaagattcttgtgccagataattccaacctccaaatgtatcctaaatagcagtatagtacattttgttcttcaatatctcaaagagtaatacctgattcatacttcgaaatatactacctccgttttttaagtacataacgctgttgactttttacatcatgtttgaccattcgttttattaaaaaaaattaactaaatattttttcttctgttgtggcttgatttatcacttaagtaccattaagcattacttataacttttaagatgtatacaaaattttcgaataagactaatggttaaatgttgtaacaaaagtcaacaacgtcgtatattaaaaaactgagggtatatcttaaaagtacattttttcttcaatatcaaaaagagtaatatatcttaatagcatttgatcggcctaatcctttggccaacccggcaacaaaagagtaatacctgattcatactgcaggcactttttactccatttctccactggtctttgtcacaaatgtcttgaaatggcaaggtaacctaaaagaactttttgataaatctttatactagtacttttacagctgccaagttgtcataaaaaagtttagtacattaaagtcagtactaaggattaaggaatatggataacagtcagacatgtcaagtggcattgtttaaagagcaaaacttatccacactatgaaaagagattttcctagcagagtcggagataggatcttcatggaaagaaaatagtctgcaagttactactaaatactaacataagtgtgaccttttctagacaactaatctgatgtataaagtataaacaactgggcctatacatatcatatatgattagtaaggcaacatgctatgctcca

SEQ ID NO: 57719 - DNA, 1565 bp, Oryza sativa
cgtttgcagaggtgcaagggcactcatttaactattgatagaatgtaaactgactgaactagttgattaatgattatacttagttattaaagtttgagaatttaacattgcacttaacactctgcaggtactaagttgctatcttctagtaatagatttacaggtcaatacctgtacttcagaagaatgaatgcagcgtgaaaatttactaagtattacgatgacataattaaggtatgcagtaacacatagataaatgactaccctgtcacatagataaatgaattgtactgaaagtttgcctaaacttggaaatttttaacaattgaatacttagaaagaactgaagctatgcgtacaaattaaatttcctcactggcgtatgcactagctagattatctcttcctacttgtttattgttctccaatagttgaatacttatttttctaagcgagtggtacgatcagacagctcaacagcatgataggaattaggtttctgatcatcagctgacacaagagagtgatatatgaacactatcgttgtatacgattaattaaactgaatactgacagtacacattaacagtacaatcaatcatccgaggtaatttatcaacatggagagagggaccaagcagagccctttcttcctcagctcattacattcatacaaggacttgtcgttgttgttatcaacactgactgtttcttgaagcacttcagccgccggctgtcgtgaactggcatcgacaaaatacttggcctgcaatgttaagtaaacttgtaaggaaacatacatggatacatataattgggttctgaacaaagaaagaaaatatagagaaactgtttcagaaacttaccagctgtgtgatgttgatatctttagcctccattgttgccattgacttcatatcaacattgttcaagttgctagttaactgtaaaacaacagatggtagctatgtaagaaatgcaggttatatatgtaatgttgttttgaacaacaagaagagatgaacagatgaacaggcatacaggcagaatcttttctaaccttaggggcagctgcagaagaacaggcagtgtcctgcaaggaatcatcgtcatcgtcgtcgtcacacatcatctccgacgtgatgaacgatgcgtcgtcataggaagtagcaaacgaagaagagaagccagaggagaagctgctgctgccagagatcactggttcctggcacatctcctggctgttgtacggtgatgccaagaagttcgcaatgtgcatcgcccagctgctctctccagctgacatggacgacgtctcagctgctgggctaatgcaagaagagtaatgagatgtgttgttctccatgtgtgattctttctagctcgacctgtctctctctctgaatttgtgcctagcaatatgcagcagtagcagtgtgtagctagagctggatgatggtgtgtttatatatagctgcaagaatgcagagaatggatatgatacacaagagaatgaactgtctgtcagagactgaggcaggccagcattggaaaaactaatgcta

SEQ ID NO: 57720 - DNA, 5984 bp, Oryza sativa
attcctgcagccctatctatcggatcctgagttagttggtcgcgcgcggcgcgcaatccagacagatgaacggctggccgggtcaatgcgtgaatacgtagttgatgattcgtataattaactccatcgtctaagtacctagctacagtagcctagtgttcatagccagtagctaccaatttaacaatcttgcagcacacccggcgtagcctcaaccattgattagagatttagaaaaactcagcgcgtgtgctcgtttttctcacaagcatatacatacacaacatttagttatatttagtgcaactggtggtgtctatcaagaaattagctgtacgtcatatatacctatcgatagcgaggagtccatcactttatcaattttaagatataccgctccagaatgcatgcacttatagatttaggtgtacgtgcgttcatatgggtgggtgtgcgcgtgttgtgtttctaaaaagaaataatcttattttggttaatttttgatgcagcctattagcatcaagccatgtgttgatcgatgaagcgctggctgacgttctcgtggacgaatggagattctagatctcagcgacaacgacatgacttgctaacgaacgcgcgacaacaaagaggatcatcgtggatatgccgatatggctcaactgctcaatatagaatttgctaaggccctgtttagttctaaaaactttttctcaaaaacatcacatcgaatctttgaaaatatgcatggagtattaaatgtagataaatttaaaaactaattacacagttagggaaaaaatcgcgagacgaatcttttgaatctaattagttcataattagccataagtgctacagtagcccacatgtattaatgacggattaattaggctcaaaagattattctcgctgtttctaggcaagttatgaaattagttttttcattcgtatccaaaaaccccttccgatatccggtcaaacgtccgatgtgacaaaaaaaggccctaagtaaaattgtttttgttagaaatgaaagaggtaggaagagagagattttatttatacccaacttagcgattttatatatatggtgatgggatggacaatagctagcttggtcgtccagtagttgagtcagcccaagacgaagtgtcgcatcatcgccaaccaaaactcatcagtcatcacggtaatgaatgtcaacttgccaagaaaagaaactcataaggaattaaaaaaatctacagttaagctaccagtgtgaattctcatttctcaaccccctgtgctcaacctatgcaagtggaactgtggaaggccttgtttagttgctattttttttttcaaaaacatcacatctaatctttggataccgtagaacattaaatatagataaaataaaaaactaattgtacagtttgcatgaaaaatcgcgagacgaatcttttaagcctaattagtccatgattagtcataagtactacagtaacccacatatgctaatggtggattaattaggcttaataaattcgtctcgcggtttctaggcgagttatgaaatttgttttctcattcgtgtcaaaaactccttccgatattcggtcaaatgtccgatgtgacgcttaaaaattacttttttcgcgaactaaacaaggccgaaatatggatcctccgtcttgacgatcactataagaatactttctggggttcgcatcaaatgctacagatacaaacgccaccaatgcagtttcagtccacagttaaatttccctggtaaaaaaaagggttgggaaaaaaaatcaaggattcaaaaaagaagaaaaaaagtatatatatcacgttttgacaatcttttattatcgatgtttcactttgaaccaccttttaattaactattatttttattttggacatgataattttacctttgtgatatttagacaatctacatcaattttgtcatacataaaaaaacggtctacatacatccgagggagtttattgacgagtaagagatggcgtacacaaggttgttcatatgcttgagaagagagtcaggtgatccaaagtaaaacatagataatattatctggcctaaaataaaaatattggttaaatgacagctcaaaacattaagaaaaacatcggtaacacaagatagctcaaagtaaaatatacattaagaaaaaagaatgggaacgcgggccaggtcacggcctcaaaccggcgagcccattcggatccccacggcccatgattggctaaagcccattaaatcctcgtagaaaaaaaggcccagtaaaccactcaccacgacactcccccccacttcgtcgtctccgcgcgccgccgccgccgccgccgtcgcgcggcgcaccaagccaccaatcctcccgccccccaccaccgcggcgccgagcccgcgcgcgcgcggggctgaaatggcgccgctgaagcccccgccgccgcggctcctcctcaacggcgtctcctgcatgcggaacgcgcaggcggtgctccgcgacatcaacgtcagcgtccacgacgggacggcgctggtgctcaccggcgccaacggctccggcaagagcaccttcctgcggatgctcgccggcttctcgcgcccctcggcgggggaggtcctctggaacggccacgacatcacctccccgggcgtgttccagcagtacaagcttcagctcaactggatgtcgctcaaggacgccgtcaaggagaagctcaccgtgctcgagaacgtgcagtggttcgagctcctcgaggggaagcacggcaagtcggccccggccatcgagctcatggggctcggcaggctcatgaacgagaaggcgaggatgctctccatgggccagaggaagaggctccagctcgccaggctgctcgccatcgatcgcccgatctggctcctggacgagccgtccgtcgcgctggatgccgagggtgtcaagctgctggagtacatcatagcggagcaccgcaagaagggtgggatcgtgttcgtcgccacgcatttgcccatcgagattgaggatgccatgtcgctccggctcccgcaacggttccctcggaggaaaactttggttgatcttgtgcgttgatgtggggtcaagaattcagctgtatgattctaattcatctccattcatatgaaatccgttggaacaacttcttgatggttcagttttgtgacactttctttcggaaattaacaatgcactcaccatttgaatatgtatgccggttcctttttgctaacataacatacattgaatttggtgcattcacatgtatatgctggtggtgggttattctgttccctaatcaatgtagaaattgaagagtatttgatcatgagttgtgtattcactcgagaagtttcaagtggggggagatcaggtggaggaaatgctgaccaattttgtctgaaggaaatattgactgaatcaggtaacctattgctggtttaagagtaatttcgctgtacacattcaaattgaaacattcctgaatctcatgtattgactaatgtagattatgtacatatagttatgtttgtctgaaatttgtgtacaatggtacatcttacatatatttttgtttacaagcacaatagtttcaaatggcttactgttagttcatttttagggtctgtgctggctagtgcaatatacaactcaaccatgtctgatctacattaactaattattctgcctggtatacattttccggctggtgtttctccttcctatttgaatttttggacaaaaggcatgatggccctgcttttactgaaaacataacagctgtctttcctatttgaatttacttatttgtgtgcaattctcatgaatttaagttaggatgcccctgtagaattgagcaagtatgttggtttatctagaaatttgccatctaatggaagtctcaaatgtttggtatgaatatgaaaagatcctatcgtggtcttctgaatctctaacttatggcttgttacgaatatggcatcacattttgcacgcatgggtgtaatgatgtgcaatagtgttgtgttgttttatactctcattcactcattcctgctgtaaaagattctaacctgttgtgttcataaatataggcctcagatgttcttggggaagtagcttgctttgttgattttatgaacacttctgacctctgtatgccatatgctgaaattaaattttctgtgctctgtactgttttaaaactatttcaggtggcaatcttttgcgttatgtgtagcacattccattcttctacatttttctggcaacagtatcgaagttttccttttgtccttgtataattcattaattctattatgcttgtatacttctaacttataaacctaaactgatgttcacattgatttcagatgcaaagtatgatcaagcactattttgaacttgaagagtagactggatctttcacactgattttctcttcgctgtaatgtgaaatagaagatcattgcactaaccagtcacattcgccttaagttgaatatggaaagtaatgtgcagtagcaatctcgtatgtccatctatgactactcaaattctagttcctactctgaactttcatgtattagtatttacctgctagcttcaaatttctgcaagctactagctttattatcatcagtaatctatcattctgggcaaaccatcatatttttttcttagatgtacaaataatttctgcattattttgtatacggaaatatgtaagatcagtataaccattgtaagtgtttccattctccaaccatgttgttccctctagactaataaaaggtagattttcaagagagatatgcatatctccctctcttgcaatgttatctctttgtacagggaaaaacatatattatttgggagcaatagctaaaatgaagttaaaattttatttccacctgatactctttgagtaacatcatcttgctgatagcaagtcgaatggtctgggatagtttacattcagtatactaggctggtctgtgactctgtgttaactctggtactacacaggtgcaggctgtaacaagggagcactgaatgctccactaataagtccccaggaccattggaggtgctatctgaccccatgctggaagtagctggcccactattcaagacaaggtataaagccacttcccagtccagcaccaagccaccaatactacataaatgcgcactgttcttttgctgtattttgtttggttgttaccttctcttcaggcccaatctagaggatgctagcgtggaatatgtgcgcaatggatcacggtcgaaaattatctttatattgcaaacgatcaggtctagcccagatctgagataacttgttatttttttctaaatgaaaattactgatccgtggtggaattcaattaggatcttggccatctggttcaatacagttgtgttgaaatgctcatgttgtcatctgacataagattgtgattgccctctatcgcgttggtgaactttgttttctcttcactttataaatcccatgtttttcaattgcagagagaagcctccggtttgcattctacaagaacccaagacaggcgtggtaacctctgttgcaggtccaaaccagacatatttagcgcatgcgttatgcaccaccatctaccgtagcacttaattgtcaaaatgctattctattaactaaagggctattggatgtgggaagactgagagtatagataaattgcctgaaataggtagaataactttatgaaaaaagtattggatgtggagacttgagagactggtatatccgtccactcattttcaaagatgatcttttggtttatcagtcctcttattttcaaagataattgttccattagttatctcttcatatcttaggagatatatttggtttgttcctgcattactactgttttccagcacataaaccttagttatgtt

SEQ ID NO: 57721 - DNA, 5090 bp, Oryza sativa
  unsure (1)..(5090): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctcaggattctctgaattgaagttcatcggagcagcgacgaggaaggcgtagtcgcagccggcgacggcatcgtccaagctgccttcttcgccgatgtcagcacggaacaccttcaaggggtcaagtgcctgcaagtccttgagatgggagttcttcgccatgtcatctgaatacaaatcgcagcaattagtagaatctttgagaggtgaaactgaactctgaaaattcacaccatctttttgagatcatataaagtctcataataattcgatccatcatatgtcacgatatgtatatatgtaactatcagttggaagttggaaaaggataagattttgtcctcatgtgcggctaagcctgccatttgctaattggttaagcgaaaacactcgctaaaaagctcatatggtactagctggcctatgatttcacacctgaactgaatggaagaaacactgcaaaaaacatgaacttagagagtgaaaaaatgaggaggagaacctcaccggggtttctgaccgtcgtcttgacagcatatcccttctccaacagcatatcttgatgagcgcagatgcgatgtagccgttgccgccggtgacgcacgccgtcttcctctcaaccgccgacatcgtcgtcgtcggtcgctacaacctctccagcccagatgacgaagaggacgatgaatttatttttgttgctgttctttggaaagagttcaatttgtgtagtgagccagtgaggtggtctggcgtgcttatcagtaagtattcctaaaagaaacattctgacgagcactatatccagaatatcacctttattataaaataaaaccggtgcggtgcgagttgggtggttgattgaagtgtcaatatggagtggacaaatagatcgtcatatcacgctgctctcagcaatggtaagcatagctggtagagtactacacaatactacggtggtgtttgaatattgaagatgaagatggagattaaggggctgtttggttcagatactaacattgactaggtttaccatgctttcttaaccaaacttgccaaagatgaggccatcaaaatccaagccacactctagccaacaaaatgaaaccatgccacactttttagagacacttacatgtgggacctagattacaaaagaggaatcttgccacacttgtggaagccaaccaaacaatcatctaacatggtcaaacttgtctaaccttaagtatggcaaagtgtagtaacttatggccatcaactaaacagcccctaagtttttatgcaaaacaatatgctattaacgtatgattgattgagttttaattcttacaaacttgaaaaatagattaatatgatattttagtgcaacttttatataaaaagtttttgtacgaaacacatcatttatcatttaacagtttgaaaagcgtgtcacgaaaatcttaatatttatctaagtcttgtggaagaaaagaactggacctgagtcatgcattcgtgcgtctggactgacatgtagattcatggccgaccatcgacttacaactgacgttaatccgggcgtgcgtcatacgcattgtccgtaagccgatcgagagaggggacggtaggtaaagtacaatcgcgccgtgtgtcgtgtcgtgcaccgtgttaattgggggaaaaagtacacccaaggtccctcaacttgtcagcgagataaaaaaacatacttaaaccataaaaccatatatatatatagtcccttaactaaacaaaaccgatcacccgagatccttcggtggttttgaccccgatttcggtctatgtggcggctgagtcagcatgggaccaacgtgggtcccatatatcaggatgccatgtcagccggtcctcggttcctcctctctgttgagcgcgagcgcgaggcttgcaggcgagcagatggttgaggactctgcgagctcggaccggtgcacgacgcggaaggggtccgggtgaccggcgagggcgcggtcgacggctgcaacgcccacggcctcggcggcggagaggaggagatcggcgaccagcgccgccgccgccgcgcttcctccacgcgctagccaccaccgcctccacggggacctcgccgtgggcggcggccatcgtcgacctcgccgcccctagggccctccacgccggcgcacaaggggcttgccgcggaggatgagcggcgtggagctccagacgcgccgccagcgggaggcgagcgcggcggtgcgagtcgcgcccttgaagggaggcgggcgacgaggaggtcgtcggggagcgcgctgacgcggtcctcgccgtcgtatccctcggcggcggaaagcatggcgccgttgtcggaggcgggatggccggggaaccaccggaggcggacttggacgtggcgctgtcgtcgtcgtcgtcctcggcgtcggggaagaaggtgggcgcggcggcggcggaggctagggggttgccgcggctagtgtggatggaaagctgaacattgcttcttcagctccaatatattgtaattcacgagcctttttattttgatggttgcttcttcagttcgaaagatgtctctgtttttattcttgttcaagccattggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtaactagccaatgctaatcttttcagctcgattatgatatatatcacgtcgtcagatttgtgcaaaattggtatagagacattctgaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcagccatgtttcccaagatagaatgacgcgtacacaagcttccagcgtgtcgagggcgaggtcgacggcggcgccgcaccgcgtgtgccagcaaccccaggcgccgcaccccgggagcggcccgctattgggagccgccaccgacgcctgcctgctgtacagaaactgcagcacgagcacgagcaccagcaccttgtaccgcaccagccgcggcaaccccctagcctccgccgccgcgcccaccttcttcctcgacgccgaggacgacgacgacgacagtgccacgacctcctcctcctcggcaccggcgccgcccacctctgccgcgtgccccacgcagcaccaccctccccggtggcgccgccgcgccactatgttcgttgccggccggcttccaacaggagaaaagagtgagagagagagagagagaggaggaagggaggatgctgacggcggcgttgcctccgccggcgcgacgccggctgccggaccttctcctctcccctccccccggcggcctcctcccccacagcgccgcccgtcgccggctgagaaaagtgagagagagaaagggagaagaggggaaataagagggaagagatgaggtggcgtgggttccacgtgggtcccatgctgactcatccgctataaaccgccgaggaatctcgtatgatcggttttgtatagttaaggaatcccgcatatctggttttgcggttcgaggatgattttgtatctcgctgacaagttgagggaccttcggtgcactttttccgaattttttttatttttaattttttttattaaaagttttacaaaaataatttttcattttgaaaattgacagaagtggtcgcctaccgccctctgggagggcgatttttaaaaatcgccatcccagagggcggcgaaaatgacgtggcagacggccgttcgctctcgggcgacggccgtcaacgaaatttgcatgcggcccccttgccgccctccgctagggcgattttgtactgtgcggggggccgcctgcaaatgggcggcgagggggcatggaattttgcaggcggcccccttgctgccctgggggagggcgattttatactgtgctatatttttttttataaatatcaatagttatcaaatctttttatattgaaaactatacaagattaaaatctccaagactggtaaaatacaattttattattttttagggcatagttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattatgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtacgcgctactggatctgacactaccatgaagcgccgaaagtgcgttgtcgtgagcataagttgttctagcaccatatgaatgaaaagaactatgtagacgagacaaacacaagtagt

SEQ ID NO: 57722 - DNA, 2043 bp, Oryza sativa
tccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacatgtgaagagaggtacattatatggctcgatgatcgcttaattatcataaaaatttagaaatgaacaatccgaactcacgagtggtcggcaaggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggcaggagacggtcaaactcgaacacgaagtccgggtaacctcgtctcacctggacgtgagcgtaacgacgctgcaataaacatgatcggaattagacatgttatgtgaagaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgtggcacgtcctgtggctgagcatccgcgatgaaccgtgcgtagtggaccagccggaagtccacagcgtgcccgtgggtgctagtgaacatcacccacccgaacaacaacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacacagtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtggaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaacagattgatcagaaacatataaataattagttcaacataagtaataaatgttcataagcgaattactaacacattctgcacaagagtacaaacaaacaaaagtgtcaccatacggaatatttctgattacaacaataactgcagttacacgatatgagtacttagtccgaatactcatcacgataacattatgatacaactccgaatagttcgcaatactactagtacaacaatagtcggaggtactcattacaacaa

SEQ ID NO: 57723 - DNA, 1055 bp, Oryza sativa
acaggtggctggcgtggcagagacggcctgagtcccaagagatagtgtcaactgaggtgacacccttctcggccagacgggcctccaaggcggcgtagcggcgggcaagggagcggtaagcctcaaggagtaggtcgtgctgagtggcctgagcctccgaaagctcgaccatgcgagtcagcactgctgagactcgctgtacggacaagggtatctggcgtttgcgtggccagaaggaagacgtggaagctgccggaaggcggagcctccgagacggtggccgtagtcgtgggccaggcggcgaagcgcagtccaggagaggtcctggtacgcgatctggagagtgggcctggccacagtgaagtggtgggggcgaaggccaactccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaaactggcgttcactgccatctacaatttgaaagaggaagaaaggatcagtaaccattttagaaacaaactattgaaagaaagaagaagagagaaaccttagcttttcgcaagtagttttgaatctagtatccttagggtcgtcctaagcgtcgggtttcgccctagggccaagcctgtgctctgataccatctcttgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatca

SEQ ID NO: 57724 - DNA, 20408 bp, Oryza sativa
catgtaaaagtaaattcaatgaagcctaaaagtaatttacatatattatagaagtaacttataaaaaaagaaagtaactttaatgaatgtcttttttttaattggatgtgactacacagctagtggtagctagtttgtactccatttagtatctcctttcaacttgaaaaatacaatagtatcttcttttctcattctacatgaaaaacaaaagtgaaaggaaaaaaacaatcgatgattaaacagatttatagagagttacttttgaaccatgcaaaagttacttccaattaacattgaaggtacttttaaaaattgttaaacttatgtgtgttgatctgtgctgattaaatttaatttcttgataaagtcatatttttatctctacaacgaatttacttctaatgtcgtgacaaaattacttccgttttgttttaagttacttttataatagatgtaaattacttttagactctattaaatttacttttatatgtctaagaagtaatttagtcaactctaaaagtaacttatatatatatatatatatatataaaaatagcttacatatataataaaagtaatttacatataaatatttttcattgtaatataatcatgtaagatcttgttttgaagatttaattgtaacgaacacaatgatgtaatcgaattgtagatcggataagtaatttgagagaaaactttgtttgaagaggaaaaggacgtacatgtatattgaaaaaatgtatgcatgtagtaccacgtagtagctggagttctccacatttctccgtgttcaggcgtcatctccaaatagattttacgattttcttaataagtcgtatgtgaaaataatggttgctttttacagacgttacggtccgtctgtaatctaaaagaagtctcgtcgtttatgtagtagtgtcactatataagggcatgtttagggagcttctagctgctgcagcttctctcaaaattagaaacttcccaaacaatttagttttttatatagattctgagaaactatagttgtaaaatccaaaaaataaaacaagaacccaaagctgaaaaacctagcttttttaaattatcagaaattaactactaaccagctgcttaaacctataggatcgaactgcaagaactaaaccaaccaggggggtgaatggttgtagtacccaaaaaccaaaacttttagcggaattaaaagttaccctcatatcgatgtcgatcggtttgaccggagttgatctaccggtctgaccacgccgatgccgtcggtctgaccacgccgatgtcgtcgatctaaccggagtagatcgttcggtctaaccacctgaagatgccgcagtcgcctgatcctgctgctagtctaactgccgctgtcccaccggtctgaccgatgcgttgccgccggtatcccgccgattgaatcgctgaacctgagcaaacacaaatcgaagaactctcaaagtagatgacaactttattacttctctctgtgtttacaaagtgcaacaacaacactcctcacgaaaatctcgactaaactcgaaaccctaactattatctcaactcaatgttctctaaagcgataccaggagaccacactctccctctctatatatacccgaggtaggcagcctaaagccacgaaccaaacttgtacaagaagacctaatcccctagaaaaccttcacgtacaagaaactaactttacaaactccaattgtaccaaatttggactctttccaaatataactccgcatctgtacgcacacaacacctccatcgtatgccatatggaatcatcaccaatcacgtgcattgatctttagcctaagcatctcgcatgatatatgaccgtccagacgtcaccttatccccaagttgactcccgatccatcaccggcaacactctcccgagacatcaagatcacctacacatgaatcaaataagaaaccatattatgagcacaagctatctccaatttgactcattgctagcaaacaacagaatttcatatgcatagtatctatctagaagtcataaatataattaatccacagatattcaatgaaacaacctaaaaccgaaaccaacacagagtcggccggtcagaccgcgggctggccagtctgaccactcgaagcacgccggtctgaccgacaaccaatgcccggtctgaccggaccgacaatcagtagtccctattcatcaccaaaaccacttcgctaataatctttaaatagcgaaaccaataatctcatatgtcaattgcgtgagcgaccatagcagtgcagtgattctcttctccatctctttccccaaagtgcgtgagcgaccactttggctctgtccggcggttcgtggataggctagtgtagtgtcagtaccttcatttgacttatttttgttctcttccctaaagaatcaaatcagggacacatgtccacatgtaattaatggttctgtcaaaggcacgcaagcatgcatgcattgccagccgacttcgatcgatccacattgttttctttctgcaagctcgcatctttggatgcccatgcactgacctttccactggtattttgacatgtgtgatactgtggttacagttttttaaacaatcaatatcttcggaatgatattttcttagcatgtttacagactgataatgctaaacaaatttgaagtccgccaaaagttcaaaataccttctgaactattgcaaccctcgaaattttctcacttaactacaaaacccaaacatttaattcaacacttaaaattttgacaccgaatgaataatcccaaacactattgtgagtggtttcgaatcaagcaatccaattgaaaaaaaaaaacatgagacccaccaatcatcgctaaaaatcctctgcaatcgactgcaccgtgcttttgtcactaacatatggacacgatgtgtcgtcggacccacatgtcagtgacaaaggcacagtgcaattgactgcagaggatcctgatctaccgatcattccccaggcaatccctctccctcctctaccactttgtggaggcagttatgggcttgcgacagagactgaggcgacaacctactgtggatctgttgtatggctgtgctccttcttgaagcgcggctagccccgatcatgtctccccactacctactccttgacgtgccgaacatgagcgtggatctagggcaacactgaatatggcagtgactgcaacatggatctaggatgataccaccaacctccttcatcccgcaacattggtcactcctccgtggtgtcagaggagtcgttgggagacgaggagagggttggcatggcaagaggtccaaatctactccgtcgctcttttcctttccctatgtctcccctctcccatgaaggatgatgagcgacttatttagcctatgcaaagcacgaaggataagagaaacgtgtagcaaagcgagtgtagtacttgtagcgaatatggcaactaacgggctcacagatgacacaagtgataggggaagctcgaagttggttgcatgcgctcgtggcccttctctcccgcattctgcacatgacgagcatatctggtgggacaataggtagtggagttattaaggaggaagatgatggagctcaaggagcaagtggtggagtcaaagcttgaggagaggtggcatggggagaaggcgcggtggaggtaggtcttagcggagcagagctcgatactaggtgagctagagacgacggtagtgagctctctcaccatggtgcaaattcggaaagactgacggagagcaaggtgaagaagaggaaacactgataggtgggccctcaccggttggttgctgattagcttagactatcatgtgtgcatcatgtcagactaaaaccgttcaaattgagttatgcgtaattcatccgatgttaagagttgacagatatagaattttgagtattggagttgatggggaaaatcgaactactgtaaaagtttaataacgggtataattgacttttttctttttaaatcttggtaaataaccgttgttagatggactgaacggtaacttataatgaccaagcatatcaggatcgatccaacaacggaacacccagatctagttcatttttatgatcaccaaatactacaatcctatgttatgttcttgcatggcaccataactagttgtgtttatctttccattttagaaagaagctggctatctgaacccattttagaacgtaatctctctccagcaaaatccaatgacctcctcctcttcctcagaacaaggacacaccacaaccacgtacccaacaaaacacaaaccaaacaaacttgtattagccacgctttgttgctaatcatagccagtttagcttgttcatcgttggattcgttcgtttttccgcatgagaaatatataaaactgatgcgccgtcatcgttgtcgcatccatccatccatccatcgatcggaggagtcgcctcgcgccgccgcaccggccgtcgacgtcgtgacccgcgctagctagctcgcgcgggcggcaatgtcgtcggacgacgacgacgatgggtcggggcgcaccaagctgatcatcgccgccgtggtcatgctgctcgccatcgtgctcggcacggtggcctacgtggtggtggaccgcgccggcgacgacgacggcctgagcaagcgcggcatgaagtcgacgatgcgcagcgtggacctcttctgcgcgcccacggactaccgcgtggcgtgcaaggacaccctggagcgcgtcctggcgcggtcgtcggacccggccgaccacccgcacgccgccgccgccgcggcgatcacggcggtggagcgggagctggcgcgcgggttcgaccggtcgtcggtgctggaggcggtgcgggcgagcaacgacagccgggtcgccgaggccctccgcgactgccggacgctgctcggcgactgccgtggcgacgtgagccgggcgctcaccagcatcgcgtggcgcggcgtggacgccgtgtcgcaggacctccaggcgtggctcagcgcggtgatcacgttccagggctcctgcgtcgacatgttcccgcagggccccatcaaggaccaggtgagggaggccatggagaaggcccgcgagatctccagcaacgccatcgccatcatccagcagggcgccggcttcgccgccatgctcgacctccacgccagcgagagccacgccgccgaaggcgaggagctcgacgtcgaccacgacatccagcaccacgtggaccgccacctcgaggatcagtcgttaccaccagtcccgccgtggttgtccgacgaggaccggaggatgctcaccagcggcgaggagttcgtcgccgggctgaccccgaacgtgacggtggccaaggacggcagcggcgacttcaccaacatctcggcggcgctggacgccctgccggaggcgtacgccgggaagtacatcatctacgtgaaggaaggcgtgtacgacgagacggtgaacgtcaccagccggatggccaacatcaccatgtacggcgacggctccaagaaatccatcgtcaccggcagcaagaacatcgccgacggcgtcaggatgtggaagacagccaccttcggtacagtacgccaccgccattgacgactcacatccattcatgcattgatcgacatggacatggacattgacatggacggatggatgcagcggtggacggcgaccggttcacggcgatgaggctggggatacggaacacggcgggggaggagaagcagcaggcgctggcgctgcgggtgaaggcggacaagagcatcttcttcaactgccggatcgagggcaaccaggacacgctgttcgcgcaggcctaccgccagttctaccggagctgcgtcatctccggcaccgtcgacttcatcttcggcgacgcggccgccatgttccagcgctgcatcatcctcgtcaagccgccgctcccggggaagcccgccgtggtgaccgcgcacgggcggcgcgaccggcagcagaccacggggttcgtgctgcaccacagccaggtggtcgccgacgaggacttcgccggcgccggcggcgggagcagcaacacgtcgtcgtcgtcgggggcggcgccgaggctggcgtacctggggcggccgtggaaggagcacgcgaggacgatcgtgatggagtcggtgatcggagggttcgtgcacgcgcaggggtacatgccgtgggaggggaaggacaacctgggcgaggcgttctacggggagtacggcaacagcgggcaaggcgccaactcgacggggaggatggagatgcgggggttccacgtgctggacagggagaaggccatgcagttcacggtgggccgcttcctgcacggcgccgactggatcccggagaccggcacgcccgtcacgataggcctcttcggtggctagctcgctcatccatgcgtacgtgtgtatgttgatgcgtgctaggtggggggttgtggggttaaattcgtatgtacaaaatggttacatgtggagcaagcagaagagagagatgcatttttttttctttgagaaacatagtactatcgcaggagctcaccacgcgcggcactcaccctatctttatgagcacctctgaaaaactagcggcactcaccctatccttatgagcacctctgaaaaactaggtatacacctcaaaaagactggaccgacatatcttgagatgcacctcaaaaagattaggactgacatatcttgaaattgatgaaatcatcacagacgcatcgttgtcgagggatacacgtcgtctatcactaaaaaaataattagccgtaaatacgagtactcttgtcaagtttaggacttaaatccaggtatgttagttccaacacaaaaacctaaacagttaagctatgctcacttcgtgaagagagatacgcatttgatccaacgtgctcgtagtctgacgtcattacaaaatatacaaatataacattagtgctagtgctaattacaaaactagtgcgcgacagaacaacattacaaataaataaatatagagacgaaatatttgacaaagtgcttattgtttcgttttgcatgtcaccaatttgctcagccaaaatgctactagtaggtccaacggagaagcctcagaccggcggcagtcggtactcggcagggcaagagggctcgctggagtggaagaaacggccctgtaaactactatagtactagtgtgctgggcttctctcctggcgtggacgggcctcaggtcgatttgatggtcaaccaaccagaggacgaggaagtgaaaagtacaccgaaggtcccttaacttgttagcgagataaaaaacgtcctcgaaccgcaaaatatgcggggtcccttaactatacaaaaccggtcaccctcgacggttttgacgccggatttatcctacgtggcggctgagtcagcgtggaacccacgtgggtcccacatgtcaggatgccacgtcatctctctttcccccttctctcctttcctctctttctttcactttgctccttgtctggtggagcgatgacgggcgatgcggcgacgacgatggagaggcgggagaggagaagaggtccggcggccggcggccggcgaccggcaggggagaagaacagcggcgaggcgggagcaggctgggaagaagaatgacgacggccaggggagagtgggaggcgcatggggagtggcggcgctcggccggcaggggagatgccgcctcctgctcccgcatcgccgcgccgccatgtcctcctcccacgggacgccaccgcggatggagagtggcggcgctcggcctcgtcggcggcggcgcacccctccctcgatgaggcagcggcagcaacggacatggcggagaggtggcttgggcgcgggaggaaggcggcacggcggcgctggtggtgggaggacaggcggatgagcgccgccacgacgcgacagatgtggtcaccgccctccaccgccgcgatgcgccccagggaattcgccatcgccgacctcctcgtgtcctcgtgcagctcgccgcacgccgacgtggagggacgtgacggcgaagcagtgctccggcgagcaggccacctcgacactgccgccgccgactccccgctgctcggcctcgcccgtcggccggcggcgccagcctgcccaaagccagccgccgccatgccccgccatcgccatggctcgcctcctcctcctcctctcccactctagccgccaccacccccagccgcatcgtctcctctcgctcctccgcttctcctctaacgccagctccggctctagcccaacgccgccgcccatcaagcccttgtcctacacggggagagggggagcggatcgagatggacgccacgcgggccaggaggagcttcttcgggatgcaggtagagggacgcgatggcgaagcagcgctccggcgagcatgccaccttgacaccgccaccgccgactccccgccgctcggcctcgccccgtcggccggcagcgccgacctgcccaaagccgcagagagaagattgagagagagatagagaggaggaagggagagaagaggggaaagggagaggagggtgaggtgtacacgttgacatatggggcccacgtgggtcccacgctgactcagccgccgatgatcgtggtaaaagtgccacgtaggataaaaccgggatcaaaactgccgagaaatcttgggtgaccagttttacatagttaagagaccccgtatatctggttttgcggtttgaggacgattttgtaactcgatgacaaattgagggaccttcggtgtactttttccggacgaggaaccgtcctccgggctgccggagacagctcgcaggaacagccatagcccgctggaccatgttcaaggttcaagcacatactgctgcgttcgtttcagccacttcccaaccctctccctcgttttccgcacacacgtttttcaaattgctaaacgatactttttaaaaaaaaattctatacgaaagttactaaaacaattaaactaatacatttttttaaaaaaaaatagcaaatacttaattaatcatgcgctaatataatgccacgtttttcgtgcagaaaaaatgggttcccaaccgacttagagcaaggctaataatatagccgacctattggctataaggttatttgtagccttctatcagcctacccatataatagttagctcttcacaattaatatatagtccacttgtctctctcccagagtttattggttcttgcgttcaagccggctgtaagtttacaacccgcttctcctctctctcttctcttctctcctccacctcagcatttagccggcttatagcctactactatacttgctcttaaaggaacaaagctggaagtagatcaatactctctctctccctctcttatctagtcatctctatgagcatcagattgacgataaacaacgtgaaatctgtatcaagtctagcacttaaattcggctaagtcggtcagtgtcatcacgaggaattttaaccagtatagctaggtttcatcacttatttcacaagattcaccatgtttcttactccgtagagttcctacgaaatgtaatcctaacgactcgtgtcgctgccacttggaaagaaaaaaaaaagcgagtaaatttcacccatgcaaggatatttcgataagattattggtatatctgtctgaggcatgactgtgtaaaaatacatacgtatttgataatattgttggttatgaaattgcaaacttataaagctgaagttatgcctctaagacattaattgtacacatttgaaagtagcttttttagaaagaaaaaaaaaatccatttcactccctcataactattttgccccagcgtttaatatactacaatttacttattttatgccctaaactattttaaagcggttcacttcagctcctaacacgtagttctattttctgtttcttgctacataagtcatattttgttctaaaatttggtaggattggtatatgagttacaacttaccactaaacaatattttaaaaatttaatcattgcttggctttgaagcacttaagtttgattaaaacatcgagattttgaattaagctcaagcaaacaatcatcataaaatctgaaaatattttaaaacattgataatggtgtcatatatagttgtaaaaagtttcagcttaaaatactacctgcattttctaatatatgatgttgttatatatgatgttgttgatattttttacatcatgtttgattattcgtcttatttaaaaaatttaaataaatacttttttgtttgatttagcactaagggagctttaagcattacttctatttttaatacttgcacggttttttttaataaggcaaataatcaaatgttgtaataaaatttaacggtgtcatatattaaaaaaaataaaaatagagcgagcactaacataaaaaataaaagattaagataaatgtataaaatggtcagtggagcggttttaatagtttatcgagaaaatgtagggggaaaaaatccttaggcttaagtgatccgataaaaatagtaaaggacggatctcgtcgagagattctggtacgtcctgggctcctggcttttgtccaatggtcttctgtagcgacgattgggcacgacggacctcaccgtcagtcacccggtgaggcgtcgagcgaaagggaatgggcccaaagatagttcagcctgcgtacgtcttcctggcccatctctgctctgcggaacacaacgtaggcccgcggtcgccgtctgccgggctcacacaaccatctgtccaactcaactgctccactacgttttagaaaaggaaaaagtacatcgaaggtccctcaacttgtcatcgagttacaaaatcgtcctcgaaccatatatatgacatccctcaacttataaaaccgttccctttaggtcctctagtggttttgactccggttttatctgacgtggcggctgagtcagcatgggacccacgcaggtcccatatgtcagccccggcttcctcttccctctcctcttcctctcttccacgggcggtggcggcaaagagcagctgggcacaacaggccgatgcggcgggcgcgggtggcgcggggcatggcggcggggatgtgggcgacgggtggagctccgtgaggaggttcttcgccgcggcgacagagcggtggtgggcgacctcgtcggcgccatgacgcgctctacgcgccataccacctcaccggccattccccgccgcccgcatccagcacgcgaggtagggcttcctgcctccgggccggccgccgcgaggagccctgccctagctctccaagctcgccgctgtgttagtgacaatgcactggatcgaacacctcgcgtgcaaactgtgcacgtccggcacggcaacagacagagaaacaaagaaattcagagcgggattcagaacagagaaaagcagagtttcagagtagcgaaagtgagagaggaattgttgggcaattttctggtttctttcattgaaatgaactgtaaacttacaaaacggaaactgtagctactctcctaaatatactcaacagaaaaaaaacgaatcctatgtccaaaaatcgtgccatcccacgatccggttcttcaggactctggaacacacatgcacaccgcgcactccacgcaactctcgcaacctgcattgcgtctgttatttctgtttatttgatccgaagaaaatggcgtcctcctggcatctcgctccgctccatgtgcccatcacgacggagccaaacttctgaagcaagccaggactaacgtcaacaatctcccccttaggcctggcgttctccaagatcacgaactctaagcagaaaccttgccgtcactagctttgccgccggcaacccttttgtcagcgcatctgcacgctgttcttctgaacgaacaaattcgaccaaaatctgtcttctttcgatgcactcacgaatgaattgataccgagtatctatatgcttgctcctcccacgaaaaacaggattcttcatcaaagcaatagctgatttgttgtcaacaaacaactttaccaattttgcctcctcaccgagtagctctcccagcaatgcccttagccaaagtgcatgacaggcagctgcagtggctgccatgaattctgcttcacaagaagaaagagttactgtcttctgcttctgcgagctccatgccaccaaactgttgttgatatagaacgccatacctcctgtactccgacgatcatcaacatctccggctagatcgctgtcagtgtaccccgtgattgtgatctcaccaattcctgcggtatacacaaggccacagtcgattgtccccttcaaatacctgagaatttgcttcactgccttcaagtgcgtcatggtgggatgctccatgaatctgctcgccactccaacagcatatgacaggtccggtcttgtatgcagcaaataccgaaggcaaccgatcacacgccgatattcaatagcatcaacagggtgtccatctgcatccttttgaagctgtgtctttggatcaacaggaactgaggtcgaattgcagtccaacatcctgaactatgacagaaccttctttgcataggcagtttgtttaagtgtgattccattcacaccttgtccaacctcaattcccagataataactcaagagccctagatcattcatctcgaactcccccatcatttgtttcttgaatgcttctaccctggcaggattctcccctgtcacaattaaatcatcgacgtaaacgccaacaatcatagcttctgctcctctgcctcgagtgtatacggcttgttcttgcttgcaccgcataaacccaagttccttcagactcttgtccaagcaaatgttccaggcccgtggcgcctgcctcaagccatatagtgccttgctcaatttcagcacaaggtgctcttgtcccttcttaatgaacccctccagttgggcaacatacacctcttcttctagctccccgttgagaaaagctgacttgacatcaaggtgatgcacccgccaacctcggtccgctgcgacagcaagtatggtacgcaccgtatccaacctcgccaccggggcgaacacttcttcaaagtctacaccgtgcctctgcacatagccctttgcgaccagccatgccttgtgcttgattacttccccggtagtgtttttctttaactcgaacacccacttgagtccgattgctttgtggcccaccggcaatgtgcacagcgaccacgttgagttcttctcgatggcctccagctccttctgcattgcgtcgacccacgccggctcccctgcggcctcgcggtacgatgacggctcctccgtctctgcgagcaatgcttcaccatcctcttcatccaccaagtctacgcgtggcgcctctagcatgatgtccgccagactcctgtaccgcagcgggccgtcgtcgctgccggccgtgctcagtgacgcctccacctcggcagagtgtgttgatgttgagccaggcgtgggcgtgctgggcaatgtgggtgagaacctcaccgggcttgccggagaagttcctcgctattccgccacttctggctcattgccggctcgcctccctgccagcagcgcccggtacaacggtaccgtggtagactgttctgccagcgccggctgctgctcgccaacaggttcctctaccacaaactcggtggaattctcctctcctgcagcagcactccactgccaaggtgtgttttcatcaaatacaacgtcgcgacttacatggattccgcggcgtcatggatcaaacagccggtgagccttgctcccttcctcgacgccaaggtacacgaactgctcactccgatcatccaatttcttcagatttggagttgtcaccttggtgtgcgcagtacacccgaacacttgcaagtgtcctaagtgtggcttcttccccgtccatgcctcgaacggagtgtgttcacccatcgacttggttggcagccggttgagcaggaacacggcgtgccgcaccgcctccccccacatcctgccgggaacagacattcccttcaggagggagcgcgccatcgccatcaccgatctgttgcggtgttcaacaacgccgttctgctgcggtgagtacggcgccgtcagatgtcgctcgatgccggcctcatcgcacacccgcgcgaactcgccggacaagaactcgccactgtggtctgtccggagtgttttgatggagtgatcggccgtgttctcggccagcggcttgaattttgcgaacatctccagtgcttgatccttcgtcttgataacaaacacccacatccaacgcgaaaaatcatcaacaatcaacagaaaataacgattaacggcaaacgtcgacggtgtgattgggccacataggtccatgtgcagtagctcgagtggcgcttctgctcgataattcgccatcgcagggaatggctgcctgatctgcttcgccatgaggcaagcctggcaaagctggttgggatgatgtacttgaggaactcccgctgccatctccttgtccaccaagagtttcagcgtctggaagtttacatgtccgagccgcgcgtgccacagccacgccggatcgccgagactggtcagcaagcacacaggggacgctagttgcaactcaatccggtacaaacgattcgaggttctcctcacctttatcaccaggcgccagggatttttgtcgaacacctcaaggtcatcattatccatcacaactcggtggccagtttcagtgagttgccctaagctcaccatgttgcagcagaggctggggatgtagtagacgtcatcaagcagccactggtcaccattcttgcatgcgaaaaggattaaacccttccccataatctgtactgatgaggcgtcgccgaatctgaccacccctgtaacggtctcgtccagctcccggaacttccgtcgatccccagtcatatggttgctagcaccattatccaagtaccatagatcaccagcagctgctcccttctctgccagcatcaggcgaggccatacacgctcctcgtgcacgaccagcccacagtccatgccctgccccggcgcgttctgcaccgccttcgtcaccgcgaggagcagagctggaccggcatcgtccgtctgcacaagatgggcttcggctttctttttcttcggatgtgggcactgcgttgagtagtggccgaactcttcgtagttgaaacatttgatgtggctcttgtcgcggccaccgccgccggagccgccaccgctgctctgcgttccgccgcgtccgcgacccctgccacgactgcgcctggcctggccgcggttcgccccctcaccagagggcttgttcttttgtggcgacgaggtttctcccctgcctttcttgaagcgcgcttcccactcggccttagtaaggagcacctgaccgtcggcggtcactccgctagccgccgctttcttcttgcgcacccgctcatcgtacgccttgaggcggcccactgcctcctcgaacggcatgtcatcgacgttgtagaattgctcgatccctacgacgaggctgacgaacttctccgggacggtgtcgaacagcttcttcaccatggcggcgtcgttcaacgtcgcgccgagagcagagtgccggacccccatcatggtgatccggccagcgtactggtcaagcgactccccggcctccatcaccatgctggcgaattctcctttcagagtctgcaggcgcgcgtcgcgcaccttgtctgccccgacgaacctcgtcttgagacagtcccaaacctcctttgccgtccgcttctttgccacctgcatcaagagatcttccggcagtgactggagaagatgggatttcaccttcttgtccttcctcgggtcgacagccgctccggctgccggctcgatcgcctcccatacgccttgatcttccatcattgcctgcacccgtatcacccaactagtgtagttggttgatgtgagttgagggtaaaggaacgcgcttcccgagctccccctcgctggatccgccatcgccggaaccaacgccatagtgtcagatccgcccccccccccaacctgagaagctatgataccacttgttagtgacaatgcactggatcaaacacctcgcgtgcaaactgtgcgcgtccggcacggcaacagacaaagaaacaaagaaattcagagcgggattcagaacagagaaaagcagagtttcagagtagcgaaagtgagagaggaattgttgggcaattttctggtttctttcattgaactgatctgtaaacttacaaaacggaaactggagctactctcctaaatatactcaacagaaaaaaaacgaatcctatgcccaaaaatcgcgtcatcccacgatccggttcttcaggactctggaacacacacacaccgcgcactccacgcaactctcgcaacctgcattgcgtctgttatttctgtttatttgatccgaagaaaatggcgtcctcctggcatctcgctccgctccatgcgcccatcacgacggagccaaacttctgaagcaagccaggactaacgtcaacacgctgcttcagatgtagaaatctacaggcgcttcattctgcagtatgatatcctctcccggcgcgaagtactcggtattcatctctaaaaccttcacttaaattacaccacagaagatatcaactactcatgaacatccaacaagaattgaaaagaaacaaaaatcacatgatcacattgagatcaaatatgatcatgtgattaaaaccacgtacacacgccaagaaaccatcatgtgatgtgacttgtgagtactagagtatactgaaccaagctagaacaccaaagaattgctgctgatcaacaaatagcaagggatcaatcaaagaaagtgactactgacgaatttcctggtgcggctggtgccgtggacgacagggttggtcatgttgccgatgatgtaggcggtgaggccgaggttgaagagcatgtaggcggtggtgtagaccatctcgccggtgttctcggcgtgcatgtcgccgtagccgacggtggaaagggtggtgatgaaccagtacatggaggcgacgtagaactgcgaacatcgactaggccgcctcctgcgagcgatgagacggcccaaagtggcgacgaagaggatctacctacgcgctcaccgctggcttccttgtctcctctttctccacgcactctcgccgccggtcgccgtccttcccactccctccactcttccccttccccttccccacttccgcctccccccacctcgccggcggcgacgacgatgaccgcatcgatgcgagcacctctttccgcgtcgcccgtcgccgggtgcctctctcgcctcaccccaccggtcgcctcgccctgcggacctcctccccacctggccacccgccggccgggggttggtccacacagagaggagaggtgagagagataggaagagagagaagaggggaaagtgagaggaagggaaataacgttgttagcctgacatgtggggcccgcatggatcccacgctgactcagctgccacgtcagataaaactggtgtcaaaaccacggaaagaccaaaagtgaatggtttttgtaagttaagggatggcatatatctggttttgtggttgggggatgattttgcaactcgatgacaagttgaggaacctttagtgaaaaaggaaaaagtaacagaggagaggagtagtagcaggggcggacgcagaaaaaaaaatgactgggggcatgcatctataactcatagaacaatttgaaagccgagtgagactcacctcattgcaacttataaaaactctgagatattacattatcttaaatagtaatatatagatatgtcttccaaaatcctaaataatgttattttccaaaatcctaaataatgttattgcctgtaaaaacaacataagttattagttaacacaaaccaataaaaatattactgaaagtaatatatatatatatatatatatatatatatataaggaataaggtttagaacatacatggcatcctgtgtatccttttcacgacctatacatgattgaaccatctcttcttattcccaatcaacctataccgatattgaaaatcaccacgtggctgatatggtccccaaactaaatactttctcatcttcatgttgattgggatgataatttaccattctcttccttttactaggatcccgaggaagttgtccaaatcaattggttgcggcactgcagaattctcttggtattggtctagatgcatttgcactagaacttcctcttgtggtgttcatagctgttggatatctaataaaaaacttgtccattatctttcatataaaatcatgagaaggttgattagatagagcacatgaagagggagacctaggactagggatccatccactatatctattcacagggaagaggagtacttaccatgggaggcagagaggacagaccgagcaacagctgcagcaccgctgaggtgctgattatgaagagtgatcgcgaggaagggaggaagcagcgataggagcgaagatgaaccgatgcgggggaagcgtgatggatgggcggagtccgcagagaagaggagcggacgttcgacgacccctcgactcatgcgcgcgtgcgatggaaggaacgaaaacaagggggtgtggggtccttttttccaattggagtggggtccataggttatactactatgaatatagcgaggagcgtaaattttgactggggtccagggcccccatcgtgtgtacgctaaatccgcccctgagtagtagtagattacagttgaaacatcagctaatgctgtctcagctggcatttggcaggcgatcctcatcttctcccatatactcttttcagttccacagtctggatttcttacattctagcttatttattaaaaaaaaacttcttttacaaatatacctcctttgagaaaagcctaggggttttctgtttagctccacgaggtggtgggctaggcgacctaggttcaaagcctcactcttctaattatttgatattaggttattccctaatattcatgttttaatatacctcctgaaaaacttgtccaacaaaatttctcgggcagtaaccatggcattttcagggtgtgttcgaaccaaggtgttggaagcctctcctttcctgcatgaaaaaatgatgtaattatctagcgcataattaattaaatattagctaaaaataaattattattattttataaaataactttgctatagaatacttcatgtatctacttttgatagtcatatttcatcttggcacacagaccaaggataagtgattctacttatcacccatttaaacgtgctactagtcattcctcgtaaacaagcgattcattgatatttgcatttctcgatgctcatgtagacaatcttgtgtggaagaatgaagagtcacgcattaaatccaagaaaggcattaagatgataagttgttgtattgaaatatgcctatcaaaaataaattttttagatttggaaatatgactatcaaaagtagatggagggagtttttttttttttggaaaaaacacatcgtttactagtttgcactagtatagaaatgcacctatgtgtcgggtgggaaccaaccataagtaccgaatttcctgaccagtatcaagcaggcagcccctttgagtctcctcaaagatgtcggtttaggaaccgatacctttaaggttacttggataaaaaaaaaaagccagctccgagcacatccaccttgtgtcgcccccaaaatcaaccaagctttgccctccgaaatcaatcacaacgaactcccaacagtcaacatcaccatcacagatcctagtcatcgtcacaaaaccatactccctccgtcccattttaagtgcagccatggttttctctgcccaattttgattgtccgtcttatttgaaatttttttaaaaaaaattaaaaaataagtcccgagtaaagtactatttatgttttatcatctcataacaacaaaaatactaattataaaaaaaatttaaataagacggacgatcaaagttgagcgcggaaactcatggttgcacttaaaataggacggagggagtagattacaagtcacggtatcgacaccatggaacaataacaacaacaacaacaacaacaacaacaacaacaacaccatcttaaaaaaagatgaaagaagaacaacaacatcatca

SEQ ID NO: 57725 - DNA, 1749 bp, Oryza sativa
tttgcgttcctgtagtagtgtttgaaagcgcatgcgtgaaatacaatagagtagaagtttggaagagggagtaaagaacacactattttttttttgaaacctaaggcggaactttgttccactttcatatttagaagaagagaattgacccaatttataaggaaaaccgggtccgaaaaccatataattgcacgattaattacaggaaaaccggctgaaaaccaccggtacacaactaacaactacggcggagcccaaacgcaggatgtcgccgccaagctaaacacaaaagcgactaaacagctcccatatcacataagaggtgttattgttgccgagctagccgcccaagcgacccagcagcgccgacttcacaaccacagtgacactgaagccacgaaagtcaccaaagcgaaaagcagctccggcatccaacaatggacatcagcctgaccatcgaggagccacttccttcacacggccagcaccagaactccactattgggatcaaattaaaaacgggagataaaacaaatttagcaccccctccgttccataatactacctccttgcacaaatgtatgaccttggttagctcataaaaaaaatacggagggagtattatattgcattctggcaacgtatgcgtagattacagtttatacagtggtactatctagtacatgggctctgcgaatcaaagataccgttaataagcacgtcgcacgaaaagttgaggacaatgtagctttttctctgcgaaaatggtggcagatgatcatagataggataggatatgatatgatcccaaacaaacaggcatcgatcaagcattcgcgagcgaaatggcgatgattgcgagggaattctgttatcgccgtgtcaaccgctgccatcattccatctccctcgcgccgacgcccatcatttctcacacccctctccctcccctcctgccaaacctttcgatccaacaccaacatgctgcatgccatcatcttgccgccggcacagtcgccattgcctctctccctcttttattatccccatcaccagctgtagctgtaacagcacaacaccctttcttcacatctactacgtagtatgtaatcaccatgcttattgctccctccgcttcagattatattaagctgtgtttgagagagagggaattgagaagatggggaagatacgcaaaacgaggtgaaccattagcgcatgattaattgagtattaactattttaaattttaaaaatggactaatatgattttttaaagcaactttcatatagaaattttttgcacaaaatacaccgtttagtagtttgggaagcgtgcgcgcggaaaacgagtgacaatctccccaatctcctttgaaagaacgcagcctaagtcatgttgatttcgatcaaatttaaattgttccaagtttaatcaactttgtagaaaaaaagtaatattttcaatacaggataaatatattataaaaatatattcaattatagattcaataattggtgttataaatattactatatttatctacaaacttaatcaaacttagagtaatttaactttgaccaaagtcaaaatgacttataatctgaaactaagtgagtacacatttagttgagatgtatatgccggttaagttactaacgtcttatagtatgtgttgctacatccgtccttaaatatagtaacacacgtactaagtatcaaatgtgacgtatttttgtacggttaaa

SEQ ID NO: 57726 - DNA, 1835 bp, Oryza sativa
ctactgcaagtaatagtagatcactctttggctgctgcgctgcactgcaagtctgcaactactaaagcggtaagcacgctttaaataccttgtttgcactcgctaaagcggcatatgcatctgcaaagatcaaagcaaacaaattttaaagaaagaaagcaccacacgcgcatgctcgcacatacatctctctctctctctctctctcaaaggctcagagcacttgcaaataactagcttcaatttctctgtctcttcaccacaaatgcagcagcagcagcacaccatcacattagctttccctttcgactgcaggacagaagaagaagaagaagaagaaggtgaagaagaggaggaaggaagaagggtagtagagaggagcatgcagtacatggcatgattctgcctgtggcttttagtagagaagagtaattgagctcttctgcatctcctctctctgtctgtctctcctccatccaaagtctgcatgcaagaacatcttcttatgatggctctttccctcagtggaagccacactgcctccttccaaagcaaaggtcccaacttttgctgttgcatgggcaagctaaggagtactgtgtagcttagctatagctagctctgccttgcatttgcattgcattgcacttgtgggaaaagaaagggagaaagttatactccttcctagtacaatggtgctgtgtgtgtgtgtgtgttttctctctttattcctctccttttgtaattttgttttgctcttcttggatcagcctgaagcatgtatgcatgcacatgagatgtgtgagtgagatctactgctagtagtagcaaacaagatagagagaaagaacctcctgttccatgaagaatttttatcttcaaatgttggtgcacatttttgtaagatggtgctttgacaagtcttgccagtggctaaaaaacaaggggcttacataggtatactgcctgtgggattagatgctctgttccaccaaagcaatttttaatcaaaagaaagaagggggcatcttggtaaatgccatcctcaagaacaaaatcaagaatttgccaaaaatgccttgatgctctgttccttcccttcttgatgccctgatgcgacctcagtctcctggcttttcattgaaggcaatatgcattctttcccttttgtttctgaagagatggtcctcacttgttaattctctatattttcctcatataattcatgtttaatttgtagtataagattatactaatgtagttctccaagaagaataaaaagaagagagagagagagaacataaaaagaaaatccaaactaaccaaccatgcacagttgacagtacaaaaggactcaatttgatatccatgaaacaaatctgaaatcacataattggatcactcaaaaaagaaacagtgatcactagatgtctaatgcacatcaagtaatcaagcaagcaaacaaggagcaacacaaaacagagctccttaattaacacacaagaactaatcacacgcgcttaattagacgctaatctctagcctaggctcgaaggagaaagcggccaagaagtcgttgacctctccatcgccattgacgcacttggggagctcctcccactggttgctgccgacgtcgcacatgaagcagccgttggcctcgccggagctcacgcagaccatgaggcggccgccgtggccgacgcagttgatgtcggccttcttgccgtggaacgcgtgcgacatggccggcggcatggcggccacctgcctccacgcgccgcggcgaacccccacacccgcaggctcgccgtgtcgaggtactcccccagcac

SEQ ID NO: 57727 - DNA, 2237 bp, Oryza sativa
tcggacgacgcggcgaccaccaccgaggagtactgcttcgacgggctgcgctgcatgttggtggccaccacgtcgccggactgctgaggaagtagaccgtgtcgtcggcgccgccctgggacggcgcgtcgtcggggagcagcgcggcggcgtcgggcctccgggagagcgcgacagggccctcccacgagcccctggacgagtcgaacaccgacatggacaggtcggggagctcgtccgcgaagagcgccacgcggtagggggagccgtacatggcaatggcgtggagccgcggcgcgccgccgtgggcccccggcggcgaggggagggcacggctcgcgccggtgagcgggttcgcgacgaggagctcgcccgtgcccggcgcgcggtagaggacgaggccgccggacgacgccaccgggacggcggcgtcggcgccgccgtcgctgccgcccggcgcggcgcggcaagggatccaggagcggccggcggcgtcgaaggcgagcggcgggcgggggcgggcgccggagagcatgaggaaccacgggtcccgcgacgggacgcgggcgcaggcgcggaggaacgtgggcgacgcggcggcggcgctccagcggcggcagacggcgcggaggcggaagaaggtggccggcgggaggcgcgccaggacgcgctccagaacgtcgtcgtggaggtccccgagcccacgcggcggcgggctcctgcgcttcctgctacttctcgccgccatggacgccatggaggaggaggaggaagctgtttgtgtaggcgttgacacgcagacgcgaggagagagagagagtgtgtgtgtgtgtgtgtgtgaatctgtgaagtgaaaggcagcagcacggctggctccgctatttatatgacgacgactagtataatgatgcatgtatgcatgtcttaaaaaatatgtagtataatgatgtaaaatagtattatactatactccgtttcataatgtaacactttctagcattacttatattcatataaattttaataaacctaggtatatatatgtgtctagattcattaatatttatatgaatgtggataatgctagaaagtcttacattataaaatggagaaagtagttttttagataatgaatagtattatacttcatccgtttcataatgtaagtctttcaagtattgctcatatttatagagatattaatgaaagacttacatgaatatgagcaatgctagaaattcttatattatgaaacggagggagtagttaattattgtataatattacgttcgacgagtataagggtgcatgtatgcatgtccacccagctcaaaaaaatactactgcatttcagacagcagaaaatttaagtactccctccgtttcatattataagacggtagatttattaacttatatgtgaatataagcaatactagaaagtcttataaatatgaaacagaggaagtactccctccatatttttttttgtttgacattggttagctaaaaagaactaaccaacgtcatacatttgtacaaagaggtagtagtatttaagtatttcccggtattttagactgcaaaaaaattatgtgctcagttggatgtacaaatgtgcaatttacaggtccatattatttttagatgctttatcggattattgtcgcatattatttactgtgtaccattaaaaatattgttttttaaaaaattactgtattggttaaatcccttgttcccatgtaatcttttgttaaaaaatactgaatttcgaagaaccaaaaaggttttgaagagaaaaacaaaggtctcttttgggtattccggagttcactctttaaaaatgttgagaaaaatcactcgtcaaattaaattcaacattttttttggaacgtgagaagaaaattcaattgttcaaaccattgagttgtagacgtacggtagatcctgtttagaggggttctagcatctgtagtctaaattcttgtctacgttctacaaatacaatatacatagttatagaatctaaaaaggtaaactaaatatccatcaattgcagtcaaatacagtgacgtagatatggtcgttgtagcgcagcgtgcgcgagttttgatggaagaccgtgaaccgtttgcttaaaaatgcggggaggtgcacgcacattcgaacgcagcgtttggctcgtagcatgtctacgcatcgttccacgtggtgtgacctgccgcactgcactg

SEQ ID NO: 57728 - DNA, 7164 bp, Oryza sativa
ttattcctggccacgaatttaagcaggtatcagtaaatacgcaaatttctaaataactattcctgaagaaataacattatattttttccgatcgatttcatcgtatatgcagaaaatatccaggaaaatatatagtgtaaacccatcacgagagtgaaaatttagaacttaccgttggataaaaatgaacgttcgagattcgtctacgttccatgagttctagtaaaatttttactcatgaatgaatccgcgagtaaaattttatccgtgatgacgtagacgaatatcaaatgtctattttttgatttaacggtagttttcagatttatagatacgtgccccgtatatttttcccatatgttgtgtgctcgtaagcacagatggatagcaacaaggaaaagatgcaggatgatggagagggggtttgacctctgctgctgcaggaatctgcacgaattccaaggtgactaaaatacaagtgtcattggcatgtgaaaggtgaaaaaaaaaagcttggagagggagggaagaggaacacacatgctcgtcgtctccccatgcatgtcgctgctctgctaggagtagataatctaattagatagacgtactactatttttttttgttgggagtactactattttataaacctaatctctccggggggctcaggctagctggaacttttgcttttggcctagacgtgcaaccagctgctggtccctgtgtagtggtactagtatacgtacgagattttcctttagttaattaattactcagatcaattcaacgcaatagatgtgtaaagtttaattactggggtttagtactactggtctactgctgctatgaaagtgtcaactgggcgcgcgtgtgacgtagtactgttttactgctacagtggtaacgtacgtggagcctataatataattgcggggacaagcatgcgtacatcttgcttttcttaggaaaaaatacataacgcaatccacgtataataaatacttgagaattatcgttggatttaaaaatagacgtatgaaatttgttcacatcattttgagtaaacattttactcgcgaattcaatcatgtgtactcttgatgtggataaatctcgtgcgtttatttttaaatcaacgatagtttcaggttttccgctacatatttttctcttttttttctgcacgtatattcatctgcgaagtgaccaaaccgaccaccgaagcctgcagtgtgttgtgtaaaaaacaatttactcactgattgatgatctctcttttcgccggggatcgcatgcaggctgtacgtactcgatccctacaccccgtaactaccactaactcaaatactcaacgggattaggaattttgagggcgggtgatttaataaaatgaattaaagcggaggagaaggtgaaagttaattgcatgtatatatgcgtgcgcgccatgtactttctccgtttcatattataaaactttctagcattgccgacatatatatatatatatatatgtatatatatatatatatatatatgtatgttaacgaatctagatatatatgtgtgcctagatttattaacatctatatgaatatgggcaatgctaaaaaatcttatagtctgaaacggaggtactatagataacataaaaggaatggttgcatgttatattttagaatgtagagagtataactagtcaattattatattaattctcacgttcttatcaattatattattaaaaccacctttttaagacaatacatttgttgtggaaactagaaattctcacattaatcggagaaaattttttaagtagaaatacaatttagaaataactgaaattcgaaaaaaggaatattgaacaaacaatccatttataacacaattacataatacgagattgattaaaattagcaataaaagataaaataaattataaaattacaatgataaaaatacagagtttaagtaggtatacaatttagttttaactgaaattcaaaataaaaataagacatattgaaagaataatccacctagaacatatatagcatgaattaattaaatctcagaataaaagtaaaataaatgctgaaaattaaaaaaaataaaaataagagttgaagtaggaatataatttggaaataataaaaaataagaaacattgaaaaaacacacaatctatctagaacaaaatacgagattaattaaaaattagaattaaaaaaataaatgctgaaattaaaaaaaatgaaaatgagagctcaactaggaatacaatttagaaatactgaaattcagaataaaagaataagaattattaaaagaactgtttacatagagttctattaattgtttatattcatagtactggtaattatcatatcacatccaattttatgttcttatattttgaaacggatggagtagataagttgttgcagagctaacagcatggagaattgggacacttccaattttgcaaataagctcgtcgtgaatggacaaattacactttttcttaacattttgtagaaaagaacttagaaagaatagaaaaaaagcaatcgaagaaatctctttctttggccttcgtcaccaatggaaaagatttgaggctcactttcacgtggagggtgaaaccaggtgagcttcatgaggtggcaccattgctcaatccctaaaggggcctcccacacatggaggttgaggtgttggcgagcaaaatgaaattcaataacaccactctagatttccaccattgttcttgagaagaatcggtacaaagaccataactattccaaagatcacaactagatgtatttcatcggtgaagaaagtagaagaagcatggcgtgttgcataagaagccaagaggtgtacttaattggggcctcaatgagtgggatgttgaggcctccttggcacaacttgaaaacttcagccacctagtgaaaatttgtcgccggaaatatagcatgaggttgtctgccttggaaagacctcatgggagatgttgatgtaggccggcataaatttgtttgcccagatctagaggcaccctgatagcacccgggagaagaagcctagcaatggagtgaatcacctccagggagaaggccagtgctcacccaaacgctaggacgagaccgaccgacgccaacgaccacctcaagaaccaaaagggtaaagaccacggtaaaaacctgaaccaacgggagaatccgactactgctactactaatactggaggaacctgacccctcttccagccttcactagtagagccattggaggggagagagaggggtaggaaggaatacattttactgtagcgaatagccgtggttgctgtttctccccttggccttggttaattttgagcggtaatggcatcgtcatctttagtggagtagggtgtgtttagttcacaccaaaattagaagtttggttgaaattaaaacgatgtgacggaaaagttgaaagtttatgtgagtagaaaagtttaatgtgatgaaaaaagttagaagttcgaagaaaaagttaggatctaaacacggtgtaagttactagtactgaagaccgccttatctagaattaccaatctaaattacgcctgctcaattgcactccatagcctccaacatggaattgatcacagagggtatagcaacaccggtgttgtaaatcctctttcttttttttttcaagattttcccacgggacccatcggtagatcttgccatatggggagcaaaagagagaaaaaaaattacgtagagtagaaagcgagagaagggggaaaaaaatgcaggtgcagggtccgggcccggggtgacagctagcgcacgtagtgtagggcggggtggtgcaggtgcaggaacatggtgattcgcgcgtgcatcggatgtcaaaggcgagagagaatagacggagtagtgtccacggctgaccatcgcctactctagtagtagtagtccagaggggagtagtatacgcaccgcaaaggcaaaaggcaaaacaaaagcagcgagagagagagagagagaggagacgacacgcgctgcctgcctcgccgtgccggtccctttctctgtctcggatcggtctcaccatggagtccgtccgtccgtccgtcctcgtaggggaatctctcctcctcaatttctctctacaaacactagcagcagtagatcaggctatttttagttcttttttatcacatcaacacattaacaactaaaatctaaactttacgttgatctaaacacagcctagagtagtctctcctctctgccattgccagttgatcagtagagtgggttgcaaacggccaagcaactgtgggttgggttgtcgtggatggatggatggatgcttttgctttacgcaagtcaaatgggggacgacatcacatcgctgcccctgccctgtccgtcctgccacccggccggggacccctccctctgcacaacaacgacgactcgctcgcgttgcactccatccaaccacccacagccaccgtctcgtctcatgcatgctggagtggagtagtagcagcagcagcagcagtagatgcgaggagtactacgagacggctactgtactacagtgtgctattgctaccgcccacatctcatgctcgttgattggagggtactgtagcaaagtcaccgtctacagtccgtacatacctagtgtaccgtgtacgcgaccccttccgtcgcaacatgcccattcttgtgtcctccctctaccagtactcgcatttgcagatttgctagtatgctgtacctctagcacaaataccactcttactaagggcatgttaagttccccaaaaagaaaatttttaggtgccacatcgcatatttgaccgaatgttggaagagttttcgaatttcataactcgcctagaaaccaggagacgaatcttttgagcctaattaatccatcattagcacatgtgggctaccgtagcacttatagctaatcatggactaattaggctaaaaaagattcgtctcgcgattttctccctaactgtgcaattagttttttttaatctatatttaatgctctatgcatgtgtctaaagattcgatgtgatgtttttgagaaaaaaaatttagggaactaaaccaagcctaccaaattcacagctactcctatctatttttcatagtaatactatctatatgccctaatatatgatgctggttatatttttgctcgccatcatgtaaaaagaatcagagagtgtatttttgctcggcgttcgtatgctttttgttacaacttacttcacatgctttgctttggtgttattccatctcgcggggagttctgtttctttttttttcttttttaaaaagggctggaagccccacatttccattaccagaaattaggtaattttacaaaacaacatgaccttacatcaaacacaactatcacatgttttttggcattaacaaggtgccatcccacaatattctgccaaaattaaccttcagctaagaaaccacacgctgcacggcaaggactcagaaccaagattggcttaaggcaaggacatagaacacccaaggatcgattggaagcagaatttccaacaaggatatacaaactcttctgatcttcatcgtcttctattccagtcttcttgcacaagtcctccatccaaacctcaagttgaagatctcatttaccacatgtttcataagacccgtcccaacgattgcaaaatacgtacctagcattaagtgaaaacgtgggttgattagctttgatttattatgcaactttggttaatatacataggctacagtgaaatccactattttgttttttatttaattttttttaatgtgaggcctcattttgtgtttcacatcggggacttgaatttttaggtatatgactgtgggaaaatatacctaccaatctctttagacaaatctatctaaataatttagccttgtcccgtttgtcttttgtcttatcagctacaaccaaaaattgaattttaaaacccaatatttaagttgattgtgagattttttttcattatagtctattaattatattaatttttaaatcactaaaaacataaatataaaagttttacttataaattactatttttggttaattcattcgattttttttcatggcttatcagctgtagaggtatcgacgagttacttaatttctaaaatcaaacaacctattacatatctacataaacacccacaagtacatgtaaaaaaacatacgaggttatgcctcggtttgttccaaaaaaagcaggaactggaagcataggggtaagctctttatcttgcaccatctatatattgctggcaagaataaatgtatatatatttttactatttattgcatagtaaaaaaataaatttatagacaccacatatgtgcatttgcatgcatgcggtggctgctgcggttcgtcttcccttttgtttttctccgtcttttccttttgcagagtttcagtgcgagcaggagatgctactagtgcctgctgctgcaggctccatctatctttcttggtctcgggtaaatcctggccggatgcgtctgtcttcttccttcaccagatcgatcttcatcgcggtatattgtggtaatattgccgcctgctgcaactccccaaccaatggcgaagcctagtcaaatattactgtatacattactccatatttatatttcagtgggatcatttctctagctaacgatgttattactatgtatagaaaaaatatgccaattagtaccactataattttcttgataagatgaaataatactgtgttattattaataaataatgcatatatgaggaaatagatatcgtaccacagcgaaattcttgccaaatacatctgcaaacattgtaaccaacaatgcagggctctgcaatccccagaagcctcatggcccaagtgtgtttttttaagaaaatgatgccccaaacccaaatacagatttccatccgctgttcaatattttgacagtcccatccaaggtacgcgggaattacccaccataaaattatgttaaacatggataaacaagagggtaaaattttttttgcaccggcaaaaatggatgttctattttcttatacattg

SEQ ID NO: 57729 - DNA, 1611 bp, Oryza sativa
atatttaacaatcgaaagtagaaaactgtcaagatgaggcaccaccaactgtaagcaaacattgcatcaatgctgaccatttccttttttttatgcatagaattcatctgcataaaagaattgcgctgctggtacaaggcaagccccctatgttttagaaacggattgcattgggtccaacaggttctcatatttcatattgtgatcacatatttccaacaggttctctactagtgcttttcttctattttttcagtcaagaattcaagataatactagactcctttaccaacatgaagaatgtgtaattaattaataaaagcagagaagaagagtcttaaggagaaacaaaaacaagaggcacatttaaaatttgaatgagttggcgaatatcttgagctagattacaataatacttacacaagccagccgatctgttccaatatcaattgtatcctgatgcatacatagcattacctgccagagagtcacacctccctagcataatttggactatttttgttattatcataaactttatatgtttctcacaaaataattgtggttaatgttaaaaaggcatggtgtaatgggtatgattttctaagaatgtcaccttaaagggttacagcagaaacaaccttaacgagaactactaagttctatagtttctccatccaaaagagcctctttctactttaagctctatatttctagacattctggtagttcgaccgtgattttttttggtttcggtatctctggaatatgagtgggtgacttgttagaatttgctcctattgataatacatagaaagggcctgttatctctatcaagatgattctaattcgtcggatattatttattctagtatttggaacacgaaatagatagaatggatcaagaaaaaaaatgaaactatgattcatattaactattcagacctcacaaccagactgaaaaaaatcaagtagttcttaataaaaagaaaaaaagaaaaattcttccttccaattttgtttgcccaaaattgggattttgcatggatttgcttgatctagatgtaaactagaatgccttctcatggtaagtgcaaatcctcgaatgatgaatgtatatagtatctagaaaatacaaatgtcaacatgtaagcacttagcagtaaaagcccgatttatactcacagcaaggaatgcagtatcattccaaacggctctctctagcagccgctttgccttgttcccaacaaaaatgggggaggttggcatagcttcaagtaagttctgatcaagaagtactttattgctaccatttgagtcggggttatatcttgatcttgtagatccctttaaatcatacaatcttgtcacatgacgttcaaacagaagattttccatcactagaacatccatcttcatctcctttccacctttcaggctcttaacctatgtgacatcataggattagactcagtaaaaaaaatctcacaaaaggtactgaagattaaaacaaatgttatatacaaaatccaaaaacagcactttaacaagataactttaattctggatgcaatagtgagatgatgctttcaatcctttgaaatatatagg

SEQ ID NO: 57730 - DNA, 28091 bp, Oryza sativa
  unsure (1)..(28091): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatgtgccatacctcatctcaataatcttttgtttggctctccaggcctttgcatagcttatggtgtacttgaatttgttctcgatgtgcctaataattgattttggttcaaagccaatgttaccaacaacactgttgtacatctcacttgccacaaaagctgaagtgatgtttcggtgatacttctccaccccttgtaagtagcacttgtgctcggtcacaatgctaactttccaataatcatttcatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcacctttctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattaataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcttgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctagatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttatagggggaggcaaaaatcgccctcccccagggcggcaagggggccgcctgcaaatttcgttgacggccgtcgcccgagagcgaacggccgtctgccacgtcattttcgccgccctctgggatggcgatttttaaaaatcgccctcccagagggcggtaggcgaccacttccgtcaattttcaaaatggaaaattatttttgtaaaacttttaataaaaaaaattaaaaataaaaaaaattccgctctccgtgcccaagccacgccggtgacagccttcactcctacctcatcctcctccaatcaggcatgccaacgctctcaacttctccttcatggcagctagctaggcttcaagctggccactctagtcaccatggcgtcactcaccgagctcccctcctggccactgttcctcgaccccgagctcacggcctcaatggcgtcctgccatgctttgttcctgcacagttcttgtgggtccaatagctgctcactagcttcccattcgctcggccttggagcgcgtgtgtagtcggcgacaaattagtcgccggctcacactctctctcctctaatctttcttccagctcaccaaagaaatccaccgtggatgcattatcaccagtcagaatagcttattgtacctgctctaaagattcccacgaccagtccccacgatagttgaggcccaactgctccttctactgactctcacgcactaattactactccacttacatggttttctcctataccgaccgcaacgtacacaaacctccatgatgccgacgccgacgacgatcatctgcctcctcgccttcctcgccgtcctcgccgccgccacgggcgacggcacgacgacgacgacgcacctccacttctacatccacgagacgttcgcgggcgacaacgccaccacggcctccctggcgccgtccccgctcgccgtcgccggcagcaactcgtcgttcgggagcgtgggcgccctggacgacgagctccgggagggctcggacgcggcgtcgcggtacctgggccgggtggagggcctcgtcgtgcaggccgacctggggaacccggcggcggcgtggacgctgctgaccctcgccttcgccggcggggactacaacgggagcacgctggtgctggacggccgcgtcgacttcggcgccgccggcgacatggagcgcgccgtggtgggcggcacggggaggttccggcgggcgagggggtacagcctcatgaccaagttcggcaaccccacgcccaacaccggcgtcttcgagatggacgtctacgtcaccaccatggcctagctagctagcttagctgcattgcagcttaattactttattactcatcttgattgtaattaagtcgtcgttaagctcggccattctggcccgtcgatgctttcaactagttcgcaattgcattgcatgcgggctgtgaatttgtgatgtgttctgaggaaaaaataaaaattcgggattttgttttttgcgtccagtactcgtcttcgtcgaaagaataacgagaatgttgaagcaaaagtgtgtgaccatgcatggaaatttctttacatgatttcacctggttagtgtttgccgttggtggtcggaagcattttaagggcaacaggatatcgctagttagtgtttacatggaaatttctttacatgatttcacctggttaattagtgtggacgcctctcctcttatgtgaactgccactaaaatgtgggttcaagagctgtggagtccacatgtcagtcaccacgtccctctgactttacgtcaagggatcccaatccctctaacgtatacttcctcttcctctggttcgataattcttttaagttttaaatacggttgaagttaaagacactataacacggcaaaaaattatattataagactggctctgaaatcgatatcggtagctgaacacaaaataacaccatagaagatttaaacttgatgacgacaccagagtataatactaccatagtatttgttaatgaggttaagccaaatcttacgtccttgggaactgtttatgggtgttccttctcacctatctagcacagtgtattcaaatatcagacacacgacaaaaccattggccagctgtacccacacctatgctactatcaccatgctactacagtaggtgtgtctctctaagcaatggaaaatacagaataaaaattgagggtatgctagactgaaagtctaagtcggtaatgctaaaataagacacataacattatcaaatcaaatgtaacactttcatgattagatagaaaaacatatttaattataaaagacgtacgtaccttgactaaccagtagtcaagtacttcctccatctacttttgataggcatatttctaaatctgaaaaatttatttttgatagacatttcaatccaacaatctagatcttaatgactttctcggatttaatgtgtgactctctattcttccacacaaaattgtctacatgggcattgagaaatataaatattaatgaatcgcttgtttacgaggaataactagtaggatgtttaaatggatgataagtagaattgcttattcttagtctgtgtgccaagatgaaatattactatcaaaagtagatggagggagtaagatgctaattttcttagatctttggtaaagagcaaagtgaacagccacctggatatattaatgagcacatttagtaacgcatgaatggtagaagtaaacacacattaactaaaagaagcaacgtgtcattgcaatttattcttcaggtcgacaaagatactttgcgggttttcaaggcttagaattgcttcatgattgcatcataatcgatacttttgaatatctctagctcagtactcactcattcctaaattgatcatcatataataaaattttaaatttctcaaattgattatcatataaccacatgtacatggatttcattataatacaactaatgcagcacgtgagaatatgtgcatgctaacgtgtgattgatatggtgttttaatcgatacatatattgtgggagaatgtgtacatggtgtcttaattgatgtaatttaaattattcttagtcttggtatataaacatatatgatgatcaatttgggaaggagggagtatattatactttcaaactattaagccaattatctgatatcttatttgcgcagatctgcagtcttgataattttcattgctgaaaatatgcactcaacagagatacaccaatgggcaatggaagctcaatgaaacgatgcaccaatggaaattaatgttctatgcttagtggtcttaagtcttaaccgtcagctgagcaaggcttgagatattagtacattcattaaattcatcagttctcctaacattaataagaatgaaggtttgaagctgacttcttagcaataatcagtcagatgttgtgaaatctccagaatatatctttgcaagtggaacaagcttattaacattgaattttgaggaggagtttcttggatcaaggcaagacatgcataccacaagctcggaggagacttcattgaagtgatgattcatttcatgcaaagttgcatctaagcctgctaatggactgggtttaagtggatatagtgggttggatttcagtgtgggttagctttgggcgggtggaaatgggttgctgcacctgatggactggactggtttggatggagatgggaaatggtttggattggtttagttttggctgcaaaagtttggtcccagattggattcaacccatgggtatccactggattggccccaatcccatcgtctccttgagaagtcgacaaccacatcgccgccatcgctagctcgacttcgtcgccggtggcttgctaccttcctctccctcctctggcaaaccttctcccttcacaaagtccccaaaaaatcaaccctggctccggatcttctggctgcccgcggcaacagcgacggcatcgaaggccgtggccgcggccgccatcatgggggagaagggcggggcaacgtggggcttgtggcggacaatggtggtgcggtggtgcggacttgggggagaagtcctacggcggtgcagccgcggtggtcgcggctgtagtgctcacgagcctcgcgacggtgagtcggtgaacgcgctcgcggtggtcgcggcatcccagcgctggtgaggctccttccctgcggcggcgacgacgacgtggcgcacgggagcgccagatgctcccacgaccctgtacgagctctgcaagctgctcatcctccattgatgccctctgcaagctgctcatcctcccggagctgaccgaaggagggaggaggaagaagatgacgatgcctgttggtgttcagagtaatattgtgcatttcctttgggttggaaatgggttgagaatgggttgaatccatttgtctgcacttggtttggattggtttgggcttgctctgtgagtggattggattggtttggtttctgcaaactatgaattgaattggattggtttagaagtgtactatagatacaagtgaactggggcggttttggtctggatctcagtccattagcaggcttagttgcatcaataacgacatagaaaatgttaacattgtaataatgatattgagtcacttactcaccttgtactttctctgaacagagattaacccataactcaataagatcatccatgcatatttggcacatcaatcccatatcttgcaaacgctctttcacatccaagttcaaacccatagcttcaacggtatcatgatccttccgttgcatagcttttgatatagctcatttgtgatgctgaggtcttgttagggaaaaatttttagatttggttgtcacatagaacatacggacacacatttaaaataataaatatagtttaataaaaaaacaaactatagattttgctaggaaactacaagataaatttactaagcttaattaatccctcattagcaaatgtttactgtagcaccatattgtcaaatcatgacgcaattaggcttaaaagatccgtctcgcaatttacacgcaatatgtgtaattggttttttttactacatttaatacttcatatatgtgtccaaacattcgatatgatagcatgaaaatttttcttctggaagctaaacatgacctgagtaaagatattaagaaatgcatgatgaatataatacaaattcaaagcgctccatcttctttaccaaacctgcagctccaccatgatttgagtgctcacgagcatatccacttacagttaccagaacatccaccattgcctcccacaacattgttaaatttaactcgatgagttgtaccgtatgtccctaaaataccgatcaggtataatctgtctgtacatccctctttcttattgtcttgacagttttttttcataactcttctatttaataatcaatcctattttaaaaaataaaacaaatatattttgacgaggataccttgaaatattttaattggagagcactttatatgctaaaaataaatattctctcccttccaaactaaaactatttgtaccactcaagctttgtttcaaataagtggagctaactctctacacacctaccatttgatctcaccaattacaactatattcttcatttaatttcttaacatacatttctctctcaactaatcacaacttctcataattatttttacctactttgttaataaatacatccacatactctagctagtattttaggatggttggagtatatcaggccaatcccaacccaatgactagaatggtatccatagcattaaataagccgtcacttagaatgaaaaatgatgtggcaaatgaatgaatgaggaaagggaaggaaaccggttcttgcgtgagacatggtttcaacacaacatccaaaacattacgtgagataagtagtattaaatttaagtatggaacaagggtgtttgcattgaaagagtagtgtctaatacttcctcggtttcacgatgtaagactttctagcattgtccacattcatttagatgttaatgaatctagacatatgtatatttttagattcattaacatctatatgtacgtgggcaatgctaaaaagtcttacattgtgaaacagagggagtactagtttcttcgtgacatggagtttatgaaaactatgtatagtgtcttggcttgggactggcctgagaataattgtagcttgtgttgactctgtatgattggcatttgactggtaccgaggttggtacatattccaaagtttccaacaatccaacaactacaaccacaattcaacccaacaaaatatatactggctggctgacggtgtgcagagtacagagactaacaagacgatgaccacggcgacgccgaagatgaccctctgcctcctcgccatcctcgccgccatggtgacggaggcggtggcggcggccgcgggcgatggcaccacgacgacgcacctccatttctacatccacgagactgtcagaaaaaactcacgcgaattggctctcagtctctctgaaacacacacactgacgcttgtaggtgcagctacagctaactgaagaagttcagaaaaacagagtcgaacagaacaactgacgaacagagttggcgctgcgtaatacagtgcagcttttccggttttatcttctatttattcatctccacacggagtttgttgcatgtataacggaaaaaatcacgacaatctcggatcaaccatactgaccgcgccatccctcgatccgagccgagtcatcgcagctaattaaagaaggaagcaaatatgctagaacagaaaatgctattctaccggccagaattcagactccaacggaactctaaatgcaacaaaacaaaagagaatataaatgctccgggagggctccagcgcggagtcccagtacctcggccgcgcggagggcctcctcgtgcaggccgacctcgggaacctggcggcgctgtggaccatgctgaccctcgccttctctctcggtctctccgacgacggggactacaaggggagcacgctggtgttggacggccgcgtcgatttcggcggcggcggcgcggcggagcgcgccgtggtgggcggcacggggaggttccggcgggcgagggggtacagcctgatgaccaagtttggcaaccccacgcccagcaccggcgtcttcgagatggacacgtctacgtcaccgccatggcctagagctagcttaattagtttaggtctgtttgattcagcttagaattattataatctatattattagaagtaagctgaaaaaaacaagtataaattattatgctagattattataatctacaaaccagattactataatccaataatctcctctagagaagctttttctagattattgagtggctaaagacctactacccttaaatgcctcaaataatccagagaaacaaacaactcgtagattattttatgtcagtttattataattcagtttagagtaatctgatttaataatctagattataataattttaaactgaaacaaatagagcctatcttattgaatgaattgcactcgggttgtgaatttgtgatccgttcatcgtaggggggaaaatgaatgtcaactagaggtgaacacgcgcttcgcgcactgcaccagtggtgccaggagagggaaatcattgattacatctgttggttctggtaggtaactgaaacaaatgctatttgcaaggtctgtgaaggtcaagtataagctaacgacatggtgtgagatttaggtttagtgtagtgcaaaaaatgaagttctgtgacgtgagcatttatattgatagttgtcatagaggctaaaagctaatcacaacatatatgcagattgtggacagtcctaaatagcaaaatgtgccacatgttcgatggcaggatagacagtacatagtagttttatagtggtagcattgaaatagttctgctagatgagcacataggagtataggactataaaactatattacacatggctaaattctactaatatggtttggatgccttcaccgaattcacacaggggcccttttgttgatgtgcaaatggaagtggcacaaaaaggtaccaaccaaaagcaaagtaatgatcatccatactaaaaaaacaaacaggtaaacaatccaaactgttttcagtaattttctaataatcaggtatgtgaaccaaataatgcacacagcagcatatttattcaacaaagaaagttggaatggacggtattgtaggattgtaaaggtcaatctgtcaagttaacctattggtttctggttgtacatcttttacatagattataaaaggtatgtgattttaatacctaaatcatagcaagcacaataattttatgagcagatactatcagtatgtttaaaggaagagggtgaaagtgcaagctagtcaaataatacataacttagttaaaatgggattttaacctacagggcaacgctcatcgtcctaaactgaagctttatcatcccaaaccaatagttatattatcaagagtcctgaaaaaccacttctatggcaagagcaaataataacattagtcgtttcaaagaaaacttcaattttagaaccctaatcaagccaatcttttatatgctagtctaagcattacctaatcatcacatattaaataaaaaagggcataaatattagaagcattaggtagaagattcaaagtgagctgcaataaaaactggatgcatccaatgtagaacatgagaagcatctgaaggacaagtcagttacatttgtaaaatatcataggcattactgaatgcaaattagaaaacaatgtaacatcatatattttttatatcaagttaaattctgttgcacatcgtggggatgtcatgataatttaatatgttcagagttaatgtctattatgtcatgataattaattttttttatagagttaccaatcttcagctataacttgcaacagaattcttgttcacaaacaaccaaattatagaactaatatatgcctatttggtaaacaaataatcaactaaattttcacttccgtaaagaacatgtcaaatataatttaaacagtgaactcaaggtaggcaacaaacaacgatcagccaaactggttgccagtggtgccatttctcctcctggaggatggcaccaatgcaggcatcctttgttctgatctactatgttgtgtgcacctggagtcttggcgtgttaaggcaggcatcagcctatcatagcctagttttgctactgaaaccattgcaccagctaaagcctacaagaataagagaagtggacagctatgccagtcctttgatcttgcaccaatccatcatgttttctttggttcttctaatattattcgcaaagcaataatgtaatccattgtaatgcagcagctgattggcgttgggaagattagatagcttagaatagaattgaagctatagatggattgtgcaacaaattgagataaattgattttctatagtgcaaaagagcagacacatagcgagctttagtaatcacatccaaaaataatacagagaaaattacagttcattaatttatttttggtgcaacagtaatatacagttctgattcagacctgtacaacctttatcaaatgcacttgtatatttttggtacaacagtaatatatagcagcagtagtagtgattagtgtgattagtgtataagtttagtctcagattctgcatgtaaaaggtcatctaatgtcaagttacaaacatgctcgttataaattaattttatagaagtcactaccttcaaggggcataattagtaatgaacaaactaaaaatgcaaagccacaatctattttgatgaagatgcatgactacgtttggatggagcattatcaaattatccacaaaaaatattgtacattgctatattttgctggaacaaatcagcatactcatacttcaacaaaagatatatcaatttcttatacttggaaacaaagaatcttatgcattaactaatttgtaatttaaagtcatcagcatgctacaatggatcgtagatgaaccccttaaagaaatgcacagccaaattgacagcaacactaccaaagcaaagctcgccgccatcaaagtggggccacattcggtggagatgcaacctggttgtggtggcagatgaccttagatgctgtgccagaggaccagcagggcagcacggccgtgacgcaaggggatggaggtggcagcatcctctaggaaccccgcaccgatgcccttcactgctttgcgtaagctcaacaaagcttcactacaagctgcattcacacgctcacattcatagtgttacactgatttaaacttgcaaagaaaaattcaatacacatatcttcatcggtccaaattaatcacagtatcacactaagaccaccaacttggcaaagatataacatgcagtatgaaattccagaggaaactttcctctcctcacctccttccaaaaaggcagaagaagaggtaggatggagctgacgaggagccctccatgcggcagatccagcagcacccgccgtactggagaccgccgctgtccggaacgggacaccaatgccacagatcatgcagctccctctccaaatcggttcaccgacctcctggatccagtgattccccgtctcctcgacgtcccacacgcacgtccgtggccgcctaatcgcaggcatccgctgatccggaaatgaacaggatggagagggagagggagagggagagaggggcagtgccgggcatagaggtagaagagtagaaggcggctcctggcttcccctcgcttcagggcggccggatctgccggcgaggaggccggagtcaccggatccgacagtcccggcctcctcgatggcggatgcggcgcgggagcgagaggatggcgatggcaggacgacggcgcggcgacagcaacagctcgcagtagggagtgcgcgggggaggtcgccaactgcgggaagaagaggatgaggggacggcacgcggcggcggcggcggccgtcgctagggcaggagagagagcggagcgagaggagaggaggcagaggaatggtggcggctagggtttggggaaaggggtgagggttgtttttgttttgcaaaaacacccctaaacttctagttttcagagcgcggttcaattttccgttttttcgcttcttcatatagaatattgttttcttaagaggtcctctaagtaagaacgcacaacattagaactaaggaccagggatctataattatcaagtaaatgaagggtgtttttgcaaaatcactaacgacgacacgggtgtgcgagagctcacgaaaaccacccgccatccagcgcctcgctgacgcgtcggcacgcgcaggtggccacgccagctcaaaaatctccaggagtcgcaaatctcggcaggtttgtatataagcgatatttcaagtggtaaataagaaaaccgtcctggttacagtggtatatatataaagaattctctcctaatattaataatagtaggcctgatcatattttctcttttgaataccccggtacttggtttagcattggattctttgctagcagtcgtgctaatttgtgtatacaacgtactctaaagtctaaacatgaggaattcgactcatgcagttactagtgtgaccgtaagttaagcagtgctagtatattcttcttggcactataactgtatcattgtagcagccgatttgaacctttgactgagaaatggatggtgtaaattgtgcgcagttacaatagtaactgaaagggattgaaagaagatcgatggaaatggagatttctctgaaccaaatgactgtggtctagagaaaaactatcagtttacgtactgtatttcagttcccgctgttattattggagtatgatcccatcagttcaggatgcaaatgatgtaatgtagagtttattttttctaatcaagcctttggtactgctctttaagttcacttggcacgggcagcctggattggtctggtctccagccacatttgtacgccagtgtgggctgggcaaggattgtaacggggcaacgggcctctatgttcacctgcgatgggttttaacattaacaccactctcgggcccatcgaagcatttccacagacatgcggatgttgttacgcgaacaatatatatggagataagattcttttatgtggtccaatccgaatcagttttagagataaatccgttttaagtatctctctacctataaataaagcaacagaaatatccattgtacaaaaaatcattgataataaagataaaacttcactcctacatctgagttcattgtctcatgtgatgtgattgttcgagaagagatacgggtttctacatcctctcagcgccttattttttgcaagagagaagggagcggatcttcacagggcctcatgttttttaaggctatgtttggttaatccccaatagggagggggattggaggggatttattcaacaactattgtagtatgaaattattccccctagaacccctccaatccccttcaaccccctctaaactgaataaggcctaagagagaagagagcggatcttctcgacgccttattttctacaagagagaagggagcggatctgaggatctatcgatgtagctattctacaacatgttatcaacatgattctagttctactactggtactatgaaagtcctactgaaattgccggagtatctcggcaggatggtgagggttgcattcattgtagctcaaagaagcattggacatgcgactgcgtacatagaacctcacctcatcgagatgtaccaggagaaatatcataagacttctacttttagattcaccttaagaaatatctcataacatataattcacatgttattaatttacatgattttttagaaattatatatatctatataaaaactttggacaaatctaaacggcgggagtataatgagaagaggggaggtaataaaatgaaaacaatatttaagaaaaaaagacttaaaatacatattcatatatttatgctaataaaatttataaaaacaataaataatgaccgtttgaataaaacttactagaattaaatattcacaatatatgaaagtaatagatgcccacaagttataacacagatggcccccgaatagtgctagacaaagatgaaaaccaggaaaacgaaatcttgagacatgtacaataacttataaattatatattcgacacttactgtaatagtgtaagtaaaatagtgctaacaagaaaaataggcttcaaatattagaactggtacgctgtacgtttctaacctacccttagaatattatatagtgtgcctaaatatgtgattacttgtaggggtaaacttggaaaacttacttgcaatgcaccccaattcccttaattatcgatattcttgcatttcagatgacaaattaatagacggcaaaagaatacaatcgatcgaagaagtcccttccatgaatcataatcgaaagcaataatataaattaaaaaggaaaaccacagatccacagctactgaaattgggatgccgcggaccgatcgattggaatttggaaatcgaatcgaaagatggatatgatgctgcgtgttcgtcctggatcagaactcaaaatggatggacgtagatgccgatggactcgaggtagggccccgcgcgggcgaagaagccgacgacgctgccgttgttgaggacggggacggcgaagggcgtgccggcgccgttgccgaacggcccgatggtgcgttggctggtgacgagcttgagcgaggtgacgacgtgggtgtagtccccgatgggccccacgagccgtgcacctccttcacgtactccgatggctcgaacgtgatctgcgtcacgttaatcgagttaaggttgctatattttaaaacggatctgcagatactcttttcgttaaaaaaagaatcttaggttccatattgattcttttttgaacctagagtgtagttacgtacggtctactcggagaggccgccttggccgccccaggggccgatggtgtggaggttcttgtccttgtcgaggtaggagaagagatgcagtcgatgaccttgccgtagcggagccagaagccctccagccgctgcggcgccaccgtcacgtcgtactccttcccgccgtggtcgccgccccacgcacccagcttcaccagcgagccggcctgcgcatgcaaagatatatacaaatcgatcagacagtacagatcagctacaactgtacaaatagctgtgtattatttggccatggatgcaaatgcagaagagatcaggatcatgctgagcaagcatggaccgaccatttctcgtttgcagctgcaacccaacccccaaccacgacacaaagatggatatatagatcgattggcggctggtttaattagcttggttgctttgggtcgtcgtgtccaactgcgaggtggagagagctatatagcctccaatttatacaacactctagagctagtatgtttaactgctagcttcaaattatttatttaaattatttatagttaatctaatagctaattcatataataagttaactataaatatatactacattattaataataaaacctttagcgttttagagtacgtactgctggctataaatatgtagcacgtttctcttctctcttctcttttatctcctccacatatgtttatggctgatttatagtatattcttgtacctgctcttcttggttgcagtgggccgtgcaaacaaaagtgagatttgtgtgcaaactattggttgcatatccgtgcaaatttatctagactcgatcgtgtgcgaggaccgacggcctaacctttgcatcaggggtagctgcgttccgtggccagcgtgacgccacgccggtgcggcacgccgtgactcgtccatcaatgcctgcacggccgtactgcaggccccggctactgatttttattttctttcttttcttttcttttcttgctacaagtagtgaacatattttgatgctttggtcgactggagtggatgaaaacggtaggaaatggtcggaaacagtattatattattttattattttttcgaaaacaaatggaaatagtcagaaaatttctatatttatgaatttatctatttagtatcaacttcaatgccacgccgacagaaattaaaaaaactaaattttaaaaacggtaaccatcggtaaaaatattattattatattagttttgtggaaacggtatcggtacggttgggaaatttccataccgttttcacccctagactggacactgtcgattctgtggagtaaatttcagaaaatacaaatgatcgaatctatcactttgtgctacagtttttactaggttcataaaactgcttcatatcaaaaaaaaatacgggttggttcactttatcatcactttcaaccttattaaattttggtggtacttttggtagttccgaaacttccacccatgcatactaccaaattttataaagacgtcaactaaatatatctaacaatataaaaaatttgataatatcaaaacttaaaaaaaatagatcaaattggcaacaaagtgaacaagcactacaactccatcactattggttctaaccaaaccgacagtaatgagctgagagtggttgctctttgtgggttagtgaagggagctagagtatgggcgtacgatttggaggataaaaggtcgaaaaacgtagaaacatgattcccataaaaatgaacactattcatccatgtaatttgtaggattttagcataagaaattttcatatgtctatgattcctaagaaatttcataggacaatttacatccactcaggctatgttcttttggggatgttgagaacctttccttcctatacataaaacggagtagtggattagtgtttgattaaaaaagaattaactatataaatagattaatattttataaaaaacaacattcaaagttctgcataaaatggaccgtttagcaattcagtaagcatgcatgcatgcgaaaaatgaaggaggagaagttgagaaaagtgaagtataaaacacaactttaaagctcttttttctattcctacacttaggttcgagacaaagcctcacgaggtcataaaaatacttcctccgttttattataatattgagtaaatttcacaaaaccacatatactttggtcaaattatcacaaaactacaaatttaagatgatgtaaaaaaaccacatatttaataataaaattattataaaacaacagattttagggttgaagtctttagcactgatattatgtttgagttataatatttatgttttgtgattaaattgatctaaaacatgtagttctgtgataactttgttactaaatttatagttttgcgatagtgcaccctatatgtgtagttctatggtaaatttactgttaaatatgttgttttgtgatacatcatgttaaatatatagttttgtgataatttgactaaagtacatgtagttttgtggaatttactctataatattactcaagtcactttgtttttttaattaaatttttttaagcttggccaagcttatataataatataacaatacttttaatacaaaacaaacatattatcaaaatatattaaatattagttttagtaaaatattataaatgttgctaaatttttctttagaattagtcgaacttaaaaaaattgacgatgaaaaaaaatcaaagccacctatgatatgaaaataaagggagtatgaaacagttcagaacattcaagcatggcgaagcggctggctagccgtgtgcgtgtagcaattgatttgtaatactagcatatgtcacatcatatgctaagttggtttatctcaagatagtgggagtataatcctacctccatcgtaaaatgttgctacctagtacatagtagaacatcatctaatactgcgaatctgaaaagtctagattcgtaatactataatatatcacattcgattaaaattttctatactttagaacggaagaaacaataatttagaacggatatagtactctctctatttaaagatgcgaaggtaggagctcccgtgccactattttcatggcagcatccacaggttatatatgtactagccatcagcccatcatttccttgtttctccgtactagccataatgagtacagcacttggtggttgatccagatgacactcaacctaccgttattccaaactactccatccatccaagaaataaataaatttagtttaagataggttaggatattatattacgtagatcaacaaatcttaacataagataatactccctcgtctcataatataagaagtttaatttagagttggacacgattattaagaaagtgggtaaaagtgaatggtggagagttgtaattgaatgagcagtggagcaatgtgggaaaagtgaatggtagagggttatgattagttgagaagagaatgttggtggagaagttgttatattttaggacaaatcttgagggctaaaagttgttatattttaggacggaggaagtgtcttattttattttagatttatttattttgaaacagaaggagcttggatcaatgaatacttaatttatttgttgaagcatggtgaacagatgaagtgatgacacctagctagttaaatgtaaaaccaaattgctgagaacatatgccgtggtttttctttcgtgtggttttcatttgtggacaagaacttagtgcatcgtgctagattgattcatcggcttaattccttcgttaccacgcaccggcaaggagagtgagcgcgccctgggcagtatacaagccacattgcttatgattatgattataaatcaaactttaaattttaaaattaattttgtgtttttattattttataatacttgcttctaaactgttattccataaactatttttattgttaataaatcgtacacataagcatgaggataattaaaatgagtctttgtcaccacactattgctgttgtggaaacttgcatggcgcagtaataatgtttttgggagagtgtttgtgcggccgcttatacggctgcgtttagaaattcttccctccacacgtaaaacgggatgactcattagcacataattaattaaaatattagctctaaaaacttaaaaactgaattaatatgattttttaaataactttcatatagacttttttaaagaaaaaacacacaccgtctagcaattcagaaggcatgggtgcggaaaaagagggaatagaagttgagaaactaggggggaagaacacaaccatctatcgtttctcaattatgtgttttgcaatgaatctacaacatttttaaggctacatatttgtcaccaagcctaaagtaggatatgttaaaaatggatttcatgttaatttgctgctgctaatacattgatctgctatttcctagtaataaaaggaagaaccggtgatgtggtagggtccgcccaccataatttaaattacgatgcctataaatatttcacacatgctgatttgtttttaatagaaaattagtgagacttgtaagttgccgctatttttcaccatctctttggattatatgttagggagggtacattcgcgaatcgccactgtatgtatgcttgggtgtcttcctaaaatcttacggaattactccattagtcatccaaattaataatatttaagtaaaatatggtgattactactagaaaagaaactattgtcaatgacaaggggatgcagcaaaagagccctttaattctgtgagcacataatactgcactgttattattcttgaatgcaccatagtttgagaaacattaggccataaatcaaaaaaaatatgaaacagttgagaacacattcaaattaagcacggccgggtggtaactggatggatcatatcatatcggtggtgttgatcaaattcaattcaattcatttctcggaggggatgcacgggttgacgtagacgccgatggcctccaggtaggcgccggcgcggacgaagaagccgacgacgccgccgtcgccgcgcacggggacgctgaagggcgtcccggcgccgtagccgaagggcccgatggtgcggcggtcggtgacgagcttgagcgaggtgacgaggctgtcccggtcgccgaacggccccaccgtgccgtgcacctccgtgacgcgctcgccggcgtcgaacgtgaactccgccaccgtggcgccggggggccgctccccggcggcgagcttcctcgccaccgcctcggggagctcggcgccgtcgccgccccacggcccgacggagtggagctcgccgtcgccgtcgccgccgtcgtaggtgaaggcgatggagtcgatgatcttgccgtggcggagggacacgctccgcagccgccgcggcgccaccgtcacgtcgtggtcgcggccgccgtagtcgccgccccacggcccgatcttcgccaccgtcgacccggcctgcagttgcacccacacaaattgtaattcattagttgctgccgccattgacgccgatcgatcgagcaaacattgcattgcttgtgtaatcacagaccatttcgtcgatgaagctagctagcagaacgagaaaaaccaagaagagggcgagatgagatgggatgggctcgcggagtacacgcacgaaatcgggctcgatttatagggtgcaaaatctgaaaattatctcgtgctcgtcacctgcgcagctgcacctaacggaatcgagagaccatcgcgtagcatacacgggagtacgggacaggacaaggggcaggggtagatgagttccatggctagttttggtgccacgttatgtggttctgcgtcacctcctgccataacatactgcaatcatcacgtcgtacattcggtatactctaacaatgggccattagtgctgggaagaacgatattgccttcatccttagaacgtaaaatggttttaagctggaatatggatattaagaaaaatcgtgaaattaaatataagaatgttataattggttgcgaatagtgtagaatttaaatggtacaagttttgtgggtgattgggaatagaaatgtaggtaaagaaattgttatatctatctcttatatactatctcttatatactataagtccataaaactttctacaaatgctcctataccgccacgtggacttttaaaagtactccaaaacagccatgtggcactctaattaaccagtggacctactattttagattttcatctattagatttacacttatatggtggacccgacattatatgtcattagatccatttttcaaaaaaaaaaaaatcacatcccctcccgtgtcgcttatgtacgtctccgtgtacgccctccccccttttttttttgaccgggtgtacgccctcccctttgttcattttctctcctatttttatgctattttagttagatggaaatcacaattatttataatatgtttttagaaaataaaactaaatcattgtcctatacacgtacatatagtacgtcctcttccccatgttccttggccggtgtccaccctccttttttaattatattatttaaattcaaattagaccaaacatttttgaccattaaattattagttttcactattagttcttatcttcgagaaaagaaatatgtatgtttccctctccctgtgcacgtatttctatacctaattaaaaaataagcaaagcttccggtaaaaaaaatttcatccgtcctttcctttttcaccgttttcctctttttttccgatccgtttgcttttcgttttccccttttttttttggttttccgttttttcctttccttccgtctactttttttcccatttgttctcgccccttttttccttttttttctctgcctgcttttttttccgtttctctccgtccgtctattttttccttccattttttttacattttccctcttttttcgtttttttatccgttattttatttttactttttttttggtaggatttttttatctgccatattttttcgtcattggatcaaaccctagcgctgtcgtcacgtcgacaaaaatcaattagtttcccatgctttccctcattcaattagttgcaaaaatcaattccccactactctctcatcattttctcatgattttccacattcaattctactttaattcaccgaatttaatctctaattgaaagtcattttttatcaagttttgcggattcactccgattttgataaaaacaaaaagaggagatcgagtgtatcaaaagtcctcaaccaattttagaagatcgagacagattcgaccgaatttgatggggaggatcggttttggcatcgtatggacacaagactgtcttctagaggttgaagacggcagttgactatgtgagctggaattgcagctacacttgtgggttaggtcttagagaggcaggagaggtaggcccagcagagggaggtagaggactgggctaggactataaaggaaataaggaatgagtatttgtccaaaaccaaagaaaaatgtacagcgatccaaaaataattttacccgttgcaacgcacgggtattttttctagtaagtttcaaaaagacaaaaaaaaaaaaagcatcccttccgtctgaggggggatcccatctccctgctgtctctcctatttctcttctattctttagctatcaaccaaatatataaaaaaaatactccctccatattatgacgccgttgtctttttatcaatgtttgactattcgtcttattcaaaatttttgtacaaatataaaattatttatgtcatgcttaaagaacatttgatgataaatcaaatcacaataaaataaatgataattacataaactttttgaataagacgaatggtcaaacgttggtcaaagagttaacggctttatacattaaaatacagagggagtaataattagatagataaacaatcataactctcgagtacatatccaatttttaatttgtttaaactattatttatttaaatgttatcatatgtttctcttaaaaaattataatacgtcacctggatacggcgaacccaagaaagaattattagggcatcgcatagatatataccctttctttcagtggcgaggctagcaaaaaattatcagggtactacacatataaattatgcaattgttgattgatatatattgattaatatgaaatgaatatagctagaatcgaataatctacgcaggaaggtgaatgtagttaggccgatgtatcttttgcatatcaatcaaacaaaaacaagctattataaaaaaatgtacatatattttgtcatcttaaaccatttaacgaacatacgccgtgaataaattttcaaataaaagaaacattaaaaataaaataaacatgtattatgtgatcttaagttattccacaaaattgcatagctatatcagattgacggtgttaaaataaaaattataaatgcaaccatgaaaataaatttatgcataaatttaatttatctagggaccacactcctacactttgaatgtcatccaaattgtcataaaaaattgtaaaataatttaacaacatatattacatcatcatacattactttgcaagcatgcatagaaaaaatagatatataatatgtaagtgaaaagaacaaatttaactatgaataacataaaaattataaaaaaaaattgtacctttagttggatgcaataatatctaattaattatgtcttttgaaatatgctcaaccgacgagataaattaaatcggctgatttgtacgtaagtgttctaaaatatagtatacattaccatttaatggacttagaggtaaaaaacaaaagaatattactatggcttccatatcttttagatataaagataaattagtctattttatatgcatagaccattaaaaatgtgaatactcctatatatgaatattaataggctacgagcatgtccgttgtttgtacgcacgcataaccaactttaaaattcatttcgattttctgatatattttactatgtatgaatattaatattatttagattgactatagtttttcttttaactattatacgggtctcacgtatcatagagaaacaatgtttacggtaagtatatttcttccatatttactaattcacatgcaagcatataacaaattatatgcatatgaaccaattaaagtgatgacgatggtacaaataatatacatttgtcagtagtaaatgtttcgcgaggtttcttaagaaaatagaaacaatggatcgaacatccattattatatattaaaagcacattaaatttcctacaaacgctctcaaaccgccacatgtgactcctataaacgttcctaagtcaccacgtggcgctctaataaattagaggaatttctaataattcttagaaaaagaaaaacatctaaccattgattttactttaaactcagttgtcggtgatatgggcccgggggtatcacgttgagagggaggaggccgcccccaatcccacgtggcaccccccgaggggggtcgagcccggggtggagcggcagctgccccctcccagcttggggttgggccgccccgaaccccatgtggctcccctcgagggggtcgagcctgggccgcagcggcagctgccccctcatagcttggggtcgggccgttcccgaacccacgtggctccccccgaggggggtcgagcctggggtggagcggcggctgccccctcccagcttggggtcgggctgccccgaccccctccacgtatcagcccacgtgtacagggttaggtgggcgtgcctaacgcccaccttgctacatttaaagcggtccatgcagccgcgccaagctgcatttaatgcggcgtgctgcgcatcagaccggtctgtgactggtcgaatgaccgatgggactacgactgtatacccctgccctgtcagtgtgtcaagcggcgtgcggcgtgctccgtcccatcccatcataatgatgaggggcttcacagcctcttatcccggtcagagctggtccaaccactctgaactgatccgggttcccgtttcctggtacgaacgggaacccggaagtcctcatccattaaacggtgaatgacaagggcgccccgcatgatttgatgggccccgcgcagcagccgacgtgcagatagcttctgggctaaggcacaagacatgtaattaatatagagaatattttttcttctccctaggtagcactcacagcacatgtggtatccccttagaatataaaaggaggaccatgcctagcgggaaagggggatcgaactctggatccctaagccaaagcttgtctagccctagcttgtacaccaaggattcagagactttctaagcacagaagaatcatgatacacacaggagtagggtgttacgcttcatagcggcccgaacctgtataatccctctctcactttctctctgatctccatcttgtgggcctagctcccgcaaattcaccgcagttgcgtcgaaagagacttcttaggatttcacccgctcccccggtcgaactcacaaaggggggcctcacagcctcccgctagagaggatcacccctcgacattagtagacccactattttcgaccattaaatttgctaacaaaaagtaaaagcccctaaggcccataggggctgtccatatcgtttacgcgtatggtgcacgtacatacgctacatcatcccctcttatatattcaagctcccctccactgtatagaaaatatattttgtgataatctaaatcatagagctaatattttatgtacatcattagattatttattacaaaatttataattcaagacccaaaccattggatttatctcaaaggaaactgaattcctcccctcctcatgtcgcacgtacatgtgcatgtctcccggaagaaaaatcaggatatatctactctatattcattgatgcatatgtaaatatgtataacaaattaatatgaacccattaaaaggagggctagcttgatggtacattattaacaataatagtttttcgagatttattaaaaaaaagccccaaaacattcaattaaaaaagaaaaaacatattaccttttaatttgaacttaatttgttacacatgttttctaaacgaactaagtctatctccattttaaatggtgaagaagaaaatgataattacgtatacggatgcattaaatattacatagtagaaagttaacagatacctaacaaaagttatttaagcaaagtcggcaaataaatttatgaagaaaacatatttctgaagtttggcaagtatggttgatattcattcctggtaagtttttcaaatatagcctacgatatacatgcccgcgcaaatacgcgggctaccatcctagttttgaaataaattttgaaggttagaaattgttatatatttgaacgtctccgtctcgcagtttttaaaaacctgacagcgactactagttacttttaaatttgatcatttagctcttttttttaaaaaaaaatgcaaacgtcaaaaatatttttttgttattaaattactagaaaaaatgctcatgcgttgcaacgggtaaagacatttttttcgtgatgcctcaactattggaagccgaacaataaattgaaatattgggatcactatacattataattgaaaaaagccgaaacgttattttcgatacctccctacgctcggcttgaatctctacagcccagcacacaaaagggcccaagccacgagcacaagtagagttgcaggcccaactcacatagcctgcttcccttcattttcagccctagtctagttcaatacctccctacgctcggcctgtatctctgcagcacagcacacaaacgggcccaatccataagcacaagtggataaaaaaagcctaatcgaacataaaaaaacggtgaaaaaaaatagacgggccaaaaaatcatattcagttaaaactgattcttcaattaaaaccgaaaactgattcaaatatggatgacgtaccaaaataccagcaaaaacatgagaagtctggtgcctctgaagctagaataagatttggatgctttaaaggagtcaatgca

SEQ ID NO: 57731 - DNA, 1529 bp, Oryza sativa
ttgtcagagtgctgatgtaaagcccgtgatatttcatcaaagagaacctttgcacggtcaataacctgccaagatttggtgaaaaatgaaaatctcagcaatctaggaataacaaggagcagttttgccataaggaccaacttttggaccaagaatttgaaaagaagttcagctaacttaggaactttagatttattttccaaacctactattgctgcatgctacgcacctcatttgcttctttttgtatccaatccaaaggctggtgactgaaatcaagtttataaggcggtacatgaatagaatgaacattaattggcgcatatcggaagcatgccaccatttttccaaacctgcaagcataagtatgtgagaaaccaagtgctcacaacattgaattccagatgagattttaagccactcttcaataaactaactgagtttaatcaagaaaactatatgtagaccacttacccatagaaccgaaggcagtccctatggagagagtgaccacaactggctaccctacttgcagctgcatgatttgaaaagctaagttccaaaaatttaccaagtgacagaccccaagcagcatcagacatgacaatccttagagttgctggtggaaatccattgctccaagggcactttagacatctgtgccacatccaaatcttcccatccctttcccctggcaaaacgaattctgtatgttttctaactgatatcgttagacttccctgctgatgtgtgtagcaatggacatgagcttcaggtggtttgtcgcaggaaatgcactgataaccctgtatatatccatactaagtactgtaagacacgtgcagtacagtaagcaagaagttagaacaacaagtataagaaagaaaaaagggggaaacctgattaaataggcagtcacgcaaaaaccttccaagaggcttgtcaaagttaccataatactttatgcgtaacatatgtgaacgctcacaaatagttcctttccagacacatcgtatggataatgcgactaagatgctctgatgatcagaagccataatttcttccttatttgatgtgctctcatgtccttgattagtttctcattttgtacagcagtactaggcactggttgcaccatcaccacattgctgtttgtgacattttccacattagccaaatcaattgaaccatcaaaaggctcctttagattagcaaaattagtgatgttggtgctggcctcagatgtgccatgatgacaactaccatttgagttggctaaaactgtcgtcattgtgttaacatctgacatggttgaaccatactcatgataatcaccacaataccaatttttctctagagtagaatatgtgtatgaatgatccataagtacaccagatgttgtagctgaagttgcagttgccttctctattctatcaactgtcttgctgttcgaactaccgccgtagcagaccaagttccagaagaatgagagaaggtagttcgagtttgagtagtgcattcattggaca

SEQ ID NO: 57732 - DNA, 10777 bp, Oryza sativa
aatgaccaagcttctgagacggtaggagatcaatagaaggaacgatatgagcatttgtgcaacgagctattcgatccaaaaggggcctctttatatttaaaacgagtgatatgttcttttctagtagcaaatcctgagcatagcgagaaactgtatgttcaaccaaaagcaagttaggcttttgagcaacaatcttcgcgactgccattttaagatgatccgtttcctgtatattggagaaaacaagcataaggtcattgaaagcttgatattgtatacaaaaaatatgaaaaaggttcatgaacctgctggagcaacgtgtcaatgcttgatagctgattcgtgactcgctggtactcaagagcacctgctagtaggaggagacgaggcttctctattctggatgtcatgcgcctatgtgcaacattcttcttacagactactccttttacaacagtgctgaaaaagcaattggatgcaggcttcagataataagtaaactgattaaatgttacatgaagataaggaatttattgatcaaactaatactacctgatggtcaaacaatatgaagggaattatatgtaagtaggattaagataccaatagggatcaaacatttacattatgaactgtgaaaagacattcacctttcactacggtgcccacacgctaagcatttgaccttaacatatccaccaggatccatgccaccaccttggcttgtgtctggtctgagaaagtttgcagcttcccatgatactgaagtaacaatctccaaccaacctgtttcatcaccctcgtgtaatgaaatattctccacctgcaacagttgtgaaatcaaagccctgaaatgcccatcgacaacattcttcattactttcttatgttcttcacttgaccgatctctgtttcggaattcaccactaccaaagctactggatgatcgaatgcgacgctgctcactatcagctacaggctcatcgtcatcgtcatcatcaaacaatccaacttccatctcatcttcttcatcttctggttcaggaggaaaccaaaaaagttcattcttctcaaaatccaatggatttgtatcagtactttcaagagcataaatggacgaagcagccccacactcagaactattgtcaggatcaggttcatcatccatttttgtgacaggcaatgtgctggggaatccttggtcagtcgcatgagaggatacttctttagaaattacattttcttcaactgtcggagatattgttggattataggatgattcaagctcatcgaactcatctggaccataataatggtcattatgctgttgatgttgtacctgcctatcagagcagtaagcagaacactcttcttcttcatcatcactcctgaagaagactatcacacgatcagaaatccttgtaacttgccaattcatcaagtaacacataaggtaaaaaatcaatgaatattcagtgtcaaactcctgtgaagtaacaaagtaaataaaatatttttagccttctcaaccttctctaatataggtcatcatagaagatcgatacacttgtctcttgttttcgggtcatttgtccttgctgcttaaatgcgactatgctcatgaataatcaactcattttctcaatgttagtctaaataatttaactactttctcaattcttgtacacaaatctaaaacaacctatattttgagccgcaataagtattctttgaaggaagcaaagcatattctacaattcaaaatgggtttcatcatacatgtcatttcatagtaatacctgtttgtgtaatagccaaaatgaactgaagaagtctcatctttgtttgaaacagcggacatacttttctcaggcacatgggtgtctagcatatcatgacacactttgtcttgggaacttttgggtggactaatgctggaagcacgagccacatgttgatagtgtccagtagagtaagatccagctgttgtactaacactatttatggtgatagctgacttggtgctaaacagacttgcctcagacaaggaaggactaagcaatggcatcatctgcttgttagcagcggctctctcttgctcccattgcttaaagcaaaagttgcagacacgaattttgtccccttcatcgatatttctgtcagggccacttgaagctgggatggaatttgtggtgcacttgccacaaaaaatgcgaccacaacgccgacagtgatgcctgcggttgaatatggtgaactgtgtgtcacaatcataacagactctgcaactgtgatcaggcatccagaagtccctagagacattgtctgggtttgaccgacgtggcaaccacgacgtcaaaagctttactacatcagcaaaagttttatcagaggcatccatgggttgctgcaatggtaccacctaaaagagcaattcatacttgcatcctcatctgctgcaacaaaaatctaagaaattaagacgtacattagaacgtattaatgcaaaaactatccagaatttaatgcattacatacaagattatagacccacaagaaagcagttttgctatttatcagttgcctggcttttcttatctatcagtcatctaaacttgtgcaatatttttttttgttgttgtttgatactggtaacaaccaacatcaaagcttttttttttggtaaaatttagattagaaattcactacaataaaaaaacacataaatttgatttgttggatattaatctagtgttgaaaagtgttattgatagataagaaaaagccagacacttgacaaataaatagatggcccataaaattattattaataataatgaaaaagttagcaggagcataatggaactctaacaaatgtaagttttatatatactgacaaatctaacaaggtaatcgcctagactattactgtacacaaatatatctctccatgtttgcaagaaagcaacatatatctttctgtgtaaatgaagaacaaaatggaaaacggattaatgagcattcaagagccattgtgacatgacaatacctaaaagtgataatgaacaacaacacaacaatccctaaacaatctacaaacttaattcctgagttacgtgattccatcaggaaaggcgatagaaaaaaccgtgaattacatatttacacacactccttcagtgtggcaacatggcaacagcccgacggaatcaaataatgccaagcaatatacctaagaaatatcaggagatcgatcaggccaaccaccatctacagacctcgcccccacattgcgtcgggttccgcgggagcgggagatcgagcgagaagatggccgccaccgatggccaacacacacacaccccaccttacggaggcgacgcgagagctcccctcccctcccgaacacacccaaggcaccgtctcagcgtcctgtaccgccccccgcgcccgtgtcgcagcgaggcggcgggggcggggcggcggctcggagcgtgccgctgggcattcgtcgtcgtcggcggcggcggcgccaacacgcccgcgcgcgcggcctacgcggtgcagcgcgccgcgaccgccggcgggagaatcttccgggggggatcgaaattccgcgccgcgaatccggcgagaggaggagagcgacgaacttggaggagagagggaggagttttggtttctgttttgatttttttttggggggttaaattaaatgttttgttttggtgggcgtgggggcgcgagggtgacatgtggggccagggaggcgagcaagtcgcggaggggcccacaatgcgcgcccttttggaagcaaatgaggagctgcggttctcctcttcctcattttataacacaaggaatatttttaagatacttcgaggaggtggtaagtatacttaattagtcaaatggtgtgggtttaataatgctcgaggagcgagagacatgccagaatcctggaacatgcaattttgtttttattataactcttctgtcagtaatcatgttatgtacccattttagtaattctttttttctaacatacttcttccttcccaaaataagtgcagtcatggttttccgcgcccaactttgaccgttcgttttatttgaaaattttttgaaaaatttaaaaacataagttatgagtaaaatactattcatattttatcatctcataacaacaaaaatgctaattataaaaaaaatttaaataagacggacgattaaaattgggcgcggaaacttatggctgcacttattatgggacggaggcagtagattgcatgacaatttttgttgacacaaatcctacgggaaaaaaaagagatgttttaccttgaaccagaagacagcatggattacggtttaatgctactcctaattgcattgcataggagaggcgtgcgcaatggtggtggtgaggtgattgcgaatgcgatggggccgcagcgcgctacctcagcggcggctgtgggctcgtgtggtggggaagggagatagctcaagttgtgggcccgacaacgcgtgcgccgcggccgggctgagttgggaataagtccattttggctcccttacctagtgaccggatctaaatcgtatcgttaatccgtaataccggatatctcgacccctaactatatgaatttaaccggtgtaatttgactttctcggtggttttagagggcagttttgctaactggacacctacatgacggtgttgacccggttttcgtcccacatggcgttttttttaattctaatgccacgtaagcgtcacgtcaacactacgtgggatgaataccaagtcgacaccgccatgtaggtgccatatcaacgaaaccgtcctccaaaaccgttgagggattcaaagcgggcttattcccgctgagttgttggtcgggaagggcatcaatatgggccggtcaaagggagaaggatggtgatgggccattagtccatgaaggaagaggttggcccgtcaggctacactcatgggccagaagaaatggaggaggacagcctgattttggattctctggattttcatatgtggtaagtcagaggctaacagttaggggtggcaatttcttccgtgggccgggtcccctgcccccacctgcccctataggggtgggtgcgggtgacgatttaaccgtgggtgcgccagggccagggccctgcatttgtgtgggtgagggacggggggcggggggacataccacctgcgggcccggggggtatattacctcttaaaacatagcccattagaggctcaaaaaacacatctcagtgaaagtcatatataaccaaccagcagacctaaccctagccgacacacggaagctgagagcttgagatgcacgtcgagcggaggattcacgcgctaagactctgagaggtatttcttgatctatatttgtggaatgatggatcatgaaaatatttctgtttttgctgaattttgatgatgctattcaagtattcatgtattcatgctcttttcgatgatgtgtcacatgtgtgaagtatgtacaatttttttccttgctaaattgacgatcgtcttactttttcgtagatttgatagagtagctactcactgcagggtattggtcaggttgcggggccacgcaggggccgggttcgggggtggggcagggccgttccagcccaacctgccccgttgccatccctacaaacttagcacaaagcagaaaacacagtgagagaaagagagacgcaactatgaactgctcctctggtagtctggtacacttcgcttctaccgtagcgagcaaatcagtctttatctttcgtcatgtagtttggacagcacgatttatatatagtgatattcccgcgttttcttaatgagttggtagtttggtacacacattttctgtttatatccgtatcacatagtacatactccctcggtccctaaatatttgatgccgttgacttttttaaacatgtttgaccgttcgttttattaaaaaacttttgtgaaatatataaaactctatgtatacataaaagtatatttaacaatgaatccaatgataaaaaaatgtcggtgatatgggcccgggggtacgcacagtagagggaagtcgccttcccgtttggccacgtggctgcgcggcttggccttcccccgccccctcggggggcgatcaggtagcgctgaggtggccagggggcctcggggtgccgcgtcacggcccttgggccctcggcgcgcgctgccctgaggccctcacccagccaccacgtggcagggagagtgggtggagcaggaggctctgctccgcgccttcaatgcgcagcaccccaaccgtcccacgccgcatttaatgtggcgtgggcggacgtgcggcgccgctcgattgatctatgtcaatcgagcttgacctgtctgtgaccggtcaaaagcgattggacgggtggcagtgccctcacgttccgccctgtgtcaggcggagtgggggcaggtatgccccatcccatcggcacactgccaggagcgcccccgcgcatggtgagccgccaaagtctccatacaattaatggggaatgacaagggcgtcccccgtgtcatgcggaggacggtgctggccttacctagagacgcacaaccaccttgcttccggttgaaggcacggatggaggtctgatccaggcttggtggatccccctcccatggaggggtaggtatagacggtgcatgtggtatccccttgaactataaaaggaggacttcgcccaccgagaaaagggacgactctcagtaactcgagctctagaggaagaacagttaggtttccccaggagctcaagaccccttgtaagaactcatcataatcccacgcacaggagtagggtgttacacttcccagcggcccgaacctatataatcccctgttctcgtacacaaattcgcagcgatctaatagttagaccgcaagcgaaagtacgctcttgatcatcacgccatctcctccggccgaactcacaaaggggggtcttacgaccacccgctagagagggttactcctcgacagaaaataattcataattacttaaattttttaaataagataaatggtcgaacatgtttaaaaaagtcaatggcgtcaaatatttagggacagagggagtatatcatttctcaatttattatttataggagtgtagttattaacccttttcatattgatgcttgtgtagtttatttatttatcaagttgtttttttagataaaagtttttacgctcagctttactaaaagcatctaccctataattcactcagtattacacctacatactcattcatcaaatttaacggacgagaatcatccaccgcttcagatccaacgaaccatacctccctcacctcccaccgcacaccgctcccacccacgaaaaccgcatggcgctatcattgccggctcgccgctccctcgctctccccgcgccgcgccatcatcgctgccgcccacgattcgccaccgtccccgcaccacgccgccgcccctcgcctctccaccgcgccgcccctccaccagcagccgtccctcacaaatcgtcaccgccgtcatcagcgccgcctcgccgatctcctctgcgccgccgcccacgattcgccgccgtccccacaccgcgccgccgccgtccacgattagccgcctctccaccgcgccgccgcccctccaccagcagccgtccctgacaaatcgtcgccgccgtccccacaccgcgccggcgcccctcgcctctccaccgcgccgccgccgtccccactgcgccgcatcggcctccaagtctccgccgactccaccgagcacgacgagctcaacacgaagagctccaagagaggcccctctccttcctgctcgggtcggccggatctaggaggagcagaggcttcaccgtgggcttggtagggataccggtgagctctcccccgtgactcctgcctcctctggtacagcgaaatcagttcttcctcctctagggcttagcttgttccttctattctgattacatgattaggttagggcgaattttgtgagggctttgctgtctaagattatgcgagtaaccaagaaccgatggtgattcaaaataagaaaaacgatggatgctttgttttttttatcttcgacttggggacttggggttgctattactcgtgagcttgccctaaaataattgaattcaactaatctacactttagagcatctcaaatatcatgtcttttgtcaatccaaatagcacatatactgcaatggttgagaacaaattggatggtgctggtataatttaaatgtttagaaaaaaaaagtaatgcagtaaacacaatgattcatggaataaaatcaacaaatggcgacgatcgccatctctgaatcaatggtagtttacccctgctatggatatatttcctgtatagaaaatggtttattggataatgtattggatgtcatattgccaattctccattgattttatagtaattagaacttcacataaaaatgctgatgtcatgcaatttcaattttgtatacaactagcaaattgcctcgaatatcattggagtagtgggtatggtggcactgattgcattgatggtctcttgaagactttcttttttcatcacttagctgtccatgttcattgatatttttttttggcagtagtaatcatattaagactatagtgcagtttccagttaatcagaagcaatcaattgagggaaattgagactcccaagacttccattttcagtcaatcaaaaggttattttttgttctcattgacaatttctaactcaaattctggacagtccagcacgacctcggccaagaaggcagcaggtctacgccaccttcttcccgtgctgatgccgtgtctgagccctacctcaccacaagtactgctccatttctctttttgaatcaccaccggttcttgatttctttgtgatctaaatattaaagatgtttattccattgattaaagatgcttgccattaggaaatatatatatattagctgcacgttgtgtagaactcaagaatgcttagaggcactccatgcatgggttgttttagctgcacatgtactgtccggctgttcaaatttgagctattttccagttaattatttaattaactcttaattatctgattcctcaaatattttccaatatagttattccttcaacaaaataattgacatatcagttacttcttgcgggtaacaaacccaccgccggagagcaccttttgttttcttattttcttatttgtctgccctatcaagtagcacgccatttcaatactctttattcttccagcagtgcacattattgtgccatttcatatgttagctctaaattcacatgtgttagctctaaattgacattattatacaacttccagcagtatatgtcttgctctgaatttgcatgtgttagctctaaatttaagatgcttgatatagattgtccttatgatgctagctgcaatgaccccattatttcaatgtaaaggggggggggggggcactttactattattgttttttgatgtatttaagacgatcaaatcctgtgcactgaatgttagggtcattcagtattattctttatcttggtgataatctgaaattccgaactgtgatcttctcccaaacaatatgcttacatgttccctcactttcatttggcactatgcttaaattattatatcgtctcaaacatgatctaataaatcattgcatttagcattcgatcagaatgaaagttcttgattaacttgcatgtttgatcgatgaagccaacaagctggtgaacaatttgatccttcgtcaaattgatgcgagggcccaaccaataaacccactaaagctaactctccgattgtgtaagagacttacaaagaaacttatggagcgtatgtgttcccagtaaacaccataaacttatggagcgtatgcgagggccacagcttacagcacccccaccacattaggattatcaccattgaaaacacaatcattatggtgtttccaaatctcctaggctactaaaataatcaaagaattcaatctcatccataccccttttggagcaaccttagtgactttgctccaccatcctaaaaacatgttgtagaagactaaggtgcagccaaaaccaaacccaattttgtgaagattaaagtccatacttgtcggatcatgtactttttgctggcttgagttaccagattgatatccatctggaggcaatccacatgattgggaggattcttgtcttatctaatctttggtttggtcctgaaaaccaactatttataaggaattcttgaagaaatttctgacaaatctttcagaagtaagaattgctacaattaatgcagaaaaaatctgttacatggctgtgtcttctggtagtgaaacgaaaggtattattagcaagactgctacttttatctgttcttttattcagagttttgtattaccatctttttcacactaatatttggttttatttggcatcatcacttaaggggatgttgtttgattttgatgacaaaattaggatccaagctatttctgcgatttagcctaatcaaatttaagaccatgcctttctgagttgatatttcaagcagcagacatgctatgcgataaaggtcagcacattgctatttttcattgctgaagggtctataaggggcttcgtgtaaatttacgccatg

SEQ ID NO: 57733 - DNA, 1185 bp, Oryza sativa
ctctttcttcttacccttccctctctcactttgctgcaacactgacaaaaagcaatgcacagacgctaggagctcgtgtgcgctggcgactaatttaccgtccgctcgcaccctctttcctcccttctctcgtccatgtcatcatccaatctgacgtgtagctcatatcgccagctcaatctaccttattaaacctgctcttagtatttgcatggctattatattcgtctgggacaagttatatattgatcgagcatgcgtgcgtgcgactctgccggccgttgccaagacaaatttcacggcgtccgcggctgcatacaccgtgctactactactttcgtctagtgcatcatcatagtcactcgagctgtgtgctgtgccaatgtgcagaggacggagtatactacaattatggtttagtaccggagaaattttatgatccttcgtaaagtatccataggtatctaaagtttacttttaaaattttaataactcgagatacctagcatctctagcatctaaagataccaaattttacgatagaaaatatggtatctcgcaaaattttattaagaatggtaaaattatccttactattgcgcaaagctttggttacctctcatcgtgtgtccctagcctgttaaaatttcaaacttgatatattcaatgtttagttttggcttttcatacagtttttttattgtttttaaattgctaagagcaaatataaaagttctacatatattttttgtatggttttttttagcggacgagggaagaagctttggttaccacataattctcaaggaataaaggaatgtaatgtctgtttagatgataggagtgatatctctgtcctctacagcaaacagggctgaatataacacgctaaaattggcaaaaacaaaaaaaaagctttaagaaagaggaaaatccagatcagatcgaccaatatcaccttactaggaaaactctggcccatgcgatgtcgcccaacaattctaccgaggaacaagatctggccagttcttttcaaccgaatggaccgattatctaattttatgataatatttaagaggatacagatacattaattattacaaaattggaaagtcttatatatatatatatatatatatatatatatatatatatatatatatatatatgattttgcaataattt

SEQ ID NO: 57734 - DNA, 4272 bp, Oryza sativa
ataggtaaaagcaattaagaaacaatccaaaacgccaaaataaagaagggtcaaaatcaaaccacatttttgcatcatctgctactgttaacatcctagagatgagttacaacttacaagattgagcaggtttacctaatgccgagcaactaattaaaactagatattgttggtaaaacttctatatacaggtcattaacgatttaaaaggtaatcttaaaaataaactgtaataaaaaattaataatcagcttcaaaagtagatttcaaaatttaaattttgacagcgatggaagcgttagtctagaaatctcgtgaacgacaggtgcacattacgtttgcaatcgcaagaggaaggaggagaagaagacgaactcgttctcatccgcggtcaaaatatattttggcatagcaagaacagaagaagcgcccccatcgtctcaaggaataagccaaacggcatatttaaacgaaagataatttgtgaataaaacttttatatacgtgtttttagcgatttgaaaacaaagattaaaaaaacttcgataaaaaaccccaaaatattaacttcaaattaaaaatttaaagttaactaataataaatataagtataaacgaaaatatacggttagagaagagagcaggttgaggaagagaggggaagcaaaccgagctgaaccatgcggcgatggcgattgctctctgctcggaccccgcgtagagagggcgatatttatttaattaatgagtaatcatccggacagcgatggatttgtagccttgtgattatggggggcttatggcgatgaggaggatgacacggccaatgcctatccaaatccaatccataacgcatttccggttcagattcagaatttcagacacaaacagcgatccatcgtccatgtagtattatacccttttgatttgattactcattcctccttaatccttgccacgtgtgcagtccggccaactaactacccggagtgtccagtcagcctgctttgtttgttcaaacttgatccaatctgattggatctgattaacatgcactgctcgtactaggagcaatataattattacaccagaccccctctcctgcttggttcagttcagttcagttgctactaactgctttcttcagttgtgtttgttacaacagtgcttcaaattattcactcgagcacctaactttgaatttgctcagatcgtcctaccagtgagctctaacaatctcattcgtggaatgcggcctaagctttgtacgtactcccaatcttaataaaatttggtcggtctaatagcatgtcacagaaccgtgtcaatgttcaaaatcttaatgaaatttggtcggcctaacagcgtatcgatgttcagaacgacgagcgtcggtcggagtcactgtacagttgcggagagcaaggggaagtaactcgcattggctgacaggattggtcatttggtccatgggagaagaagatgccaaggaggaggtgagagctaggacaaagagtagtacataagctgatgcatttactgcattagggtaaagtacaggttttacttaagctgagcttagcagagacagagcagctgttgttggtttctgtaacagggccggcagggtttagtgttagtgtactcagatatttgtcaggtaggactggagtagtagttagtaggagtaactggtttttgcttttagtcaaatcttttgctttcgtgtccaacatgaccacatgtgcctacacaggacacagatgatgctgctctcaacagagagatgattgagatcacgaatttgacattttgcactaatatatactactgggttaaagatgtgtttttttttttacttcttccactcaaaaaaagaagtgatttttactcttccaagcactggagatgagtagatattttattatgcaaaatagtagcaggagtaattggatcatccataagctatggcaatcaacagcaagaagagatttgacaaaattcatccaaatcttgtaactatattatagatttatatatagttggttatacatattggggatctgtacacttgcttcctttcgatgcctcaatggctcaaaaggagaagagtggaacaagaagaagaagaggaggaggattgggagttgatggaggagaaatctcgcaatcaagaacctggctgcggcttcgtcgccggccgcgacgcgctgctctcgccgccggggaggcccatctccacgtcgcggtcgccctgcgccggcgccggcgggggcgggggagtcgcgccgccgcagcccagcagccgccgcagggccgctatcctcgccgcttccaccacggcggcgactccggcgatgggtcccgccgacggctgcggcgggaaggccggttgctgctgatgatgggacgacggaggcggcggcggcggcgttgccgcggcggcgccgcctgtcctgacggcgtcctgggagccgaagaagagcacgttggtggggaagttgggcgactccgcgtcagcctccggcgggcgcacggcgggcggcggcggcagcgcctcgtcgatgacggcgcagcggcagagcgggcaggtggagtttgaccggagccacatgtcgacgcactcgacgtggaacccgtggccgcaccgcggcagcacgcgggcggactccccggcggcgagctccgtgatgcagacggcgcagtccgccgcggggtcgccgccgtcgcccccctcggccgccgccgccaccaccttcgtcggcagcgccgcgatggccgcctcgtcaagcccctcccgcctccgcacccgccgtccccggggcccccgaacacgaaccgcgcgcgtcccctccctcccccaccgctgtcgccgccgatcgtgggcgcggcgccgcggtacctcttggcgcagaggaagaggtagaagcacacgacgaacgtgatgaagatcgccgccgccgccgccagcatcgtcgccgcggccgccaccgacgtccccgtcaccgccatcgatccctcgtcgccaccgagtccgcccctctcctcgcgttcttggccgccgccgccgccgcaagaagaaatctgagtgtgaattggggagtggaaatggaatggaatcgagccgctgtgtacaggagagggggtgttatatacgggcaagtggtgaaggatttggaattggaatttggaatttggggagaggataagaagaggatttgagttgagttgaggtgaattaaatttggacggggaggtgggtttagagggagggagggaggaggggaaagtgagtgagggagggagggagggaggtgaggagacaaggggaagggatatagtggtgtgagtgccgactggtcaatgttggagggatagagacacatcaaaaacaaatttaaaaggtttttttgaaactgagtattagtaaaaagaaaatctatgtattttgggattaagaatatgtgaattgtggggtgatatgagtcactgagcgagggtgatggactacggaaccattcgaatttcttgtgtcatgatttggagggaaaagtttgttttactcgcacaattgattctgtttgatcacttttagtctcctaagactatttctaactcattttatgtctaaactattaaagttgctaattgtttttagttacatgtaagatctcatatatccacagttccataccgccatacatttcatatctgatttaatacaaaaaaattgcaacatcatatctctcggaggttataatcaagacaatggccaaccacatcaagtgcctacaagctacaacataaacacccactactagaaatcaaacatgaacataacatccaaatgcactcaactttattcaggttaaggctgtgtttggagcattgggttcctaaccgctccctatcgtattccacgcgcacgctttttaaactgctaaacggtgcgttttttttaagggttaattggatctatgccacgtgaattgtggcaaatcaaaaaaatgccacacctattccggaatccggtgcatgtcactactatttcgtcaaattggaaccataccacaatgtacgccccgcgcgcgctttgccaccgttttagggtaccatattttcgtatggacgtttctgccctcgtgttcacgtgtgcttagaccagctccggtccggctcgaacagcccggtcaccattcgttccccacaccaaaaccctagcttcttggaggcggcgcaggcgacggcgccggcgcaatcgacggcggcgga

SEQ ID NO: 57735 - DNA, 15923 bp, Oryza sativa
  unsure (1)..(15923): unsure at all n locations
caaccattggcaattagcaaaatacttagagaggaggtagctggcattacagtcgaagataggtggataggctcctaactactctagttggtggtgcacttgaggatgctaggtctttcctcttctggggagtcttcttcttttttggtgtcttttttttcctaggtgtttttttcttctttggtgcagagcagcttgcttcacttgttgacactcctggatcatttccttgcctgcacacttgtctcttcctacaaaaaagtgagaatttttagaccatatggcaagcatacaagcctgaatcttagtgactacaacatagcacaatatatcaggagtgtaactaacaataattatcaagttgggtttttttatcaagttggagttaaagaatacaaaccgcttgcacaaagactaattaagaatagaagcacaatgacagcaatataccgtttttggggggtgcagtggctgctcatatcatctgcatctgcaggttcagccagcttgcatgttttctcaaaatgtccaaatcttttacatctcttgcatttcactctctttcttccaggctcaagaaatccccttattctctgtactctaggcctcccagcacctctcttctgcttagggacatgcaccttgaagcccaaatcaactactggccactgtgtcctgtcagtcataggtggtactctgcctgcataagctatcctgaacatttgcacactataatatgggctcacaaaatcttgtatccttcctccactgctgcatatccaggccaatgcatgcctgcatggcttccctgttatttgccaagccctacaagagcatttttggttgtctaggtcaacaatatgccttcttgtcttgttgtcagtatccacaagtgtgacctctgcaaacccatcatcacttctggcaatcttcaccactttaagaagagatgtggcatcattagctgtttcataacacctggaatgattccatcatccattttcttgccaacatctcttctagtggccatcttctccattattaactctcgtatgctgtcaacaagttcatgaggaagcagtcctttcagatttctgatctgagcattaaagctctcagaaacattgtttgtcagatagtcacatttgctgctttctccaaagccacatctgtaccaaattcttgaatgatgttgctcaagaaactctattgcatctggtttcactgcatatatttgctgcatatgttacttgaaaccctcctcggtgtagctcctagcagctggatacaaatgctcagtgataacagaaccatggtacttttttaagaagttaacatagaggtgcctaatgcattctctatgctcaaccaggatcactaaatgcagcactaacagccttttctaaccccttgcatgccatcggtgaaataacctacccttcaggacaaccaatagctctattcaattgtttcataaaccacaaccaattgtcctgagttgccaaatcaaaaattgcatatgatacataaaacagccagttgtgaccatctacagaggtggctgaagctaactgtccagtgtattttccagtcaacttagttgagtctacaccaacatatggcctacacccttgcaaaaagccatctatacatggttatagagctacaaaaaaatgcttgaagcacattttatttcctaacttctccaattcaatttcaactatactacctggacacttcctctcaatttcagccttccagttgaaaagcaactgaaaactttccttatatttaccatgtatctgttctagtgctaacttcatacctgaccatgcctttgaatacttcaacttgatctcatactgttcttgcagcttcccccttgcatccttagcacccttctttggattgttcttcaaccaatcaccaagcctatcagcaacccagccctgtgtagccatcttgccctctcttagtttggtagatgcacatttgtgttcaaagggaagaactgtaatctgcatgacatgacatggtgataaaaagttactaaaactaacactactttcaggagatgaaaaaataaattaactaaaataatacatttataccttaattgttttcttatcatggattagggaagcacgtattctccatggacagccttcagcgcgacaggttgcaatgaatcttgttttagctgtcttcaaatcagcaaactcaaaacctttcttaattgcataatgcctaactgcttttctaaaagatatcatgtcagggaatagagcattcttcactatatttggattctctggatcatgcaacactcgaacaacctgagggtcttcatcagtgacttctacctcaggagcttcaacccctgtggcagcagtctgagaggattggccaccaacccctatggcagcaggctgagaggattggccagaggtgtcaggtggctaagtaggttttggaggcagatacaactgctcatcattaacaccaacatattcttcctcattatcaaacatgtcaggctctctaacatctgcttccactgttgtaggctgtgcagaacctccaacattagtagcagcttgtccagaaccatcattgtgggaagggttctcaggtgggatgatagcaatgggctcatgcacacaacacacagaagcaacatccatgctttcctcaagaactgctacaagtaggtggaaactggcctcggttgcatacatctcgaaaatatctggcaaatcagtgtcccctatgagcctaacatcctcacccaaatttttgttaaaataccacactaagggagattggttcgagccccacttaaactcaaccctcaaactttccattaggaaatcaaacgaaaaactctctgaatcgattacccaatgcccagtgcctcctttactgatgattttcctaccatcagcatctactgtcgcatagggttgcaccctaacatcgactgaaaaccaatgcctaccaacgaatgacaaaacaataactcaaatcgcacatacaaagttcaaatcgaaactcaaatcgcaattttatctgcataaagagttcatgggggaaggtactcacggtttggaagcaacccgtacaagggatttgcctaaatacattgccaacgcggtgggggatgcaggcgtaggcccctgcgcactcatcctcccattggcagaggtcctccccttcggctgtcgtagcctccgccaccggcctgctccgccgccgccttgctccgccgccttcgcctgcgccgccgccctgctccggcgccgaagcctgcgccgccgcctgcgacgccgccctccatcgccgttgcctgcgtcgccgccctgctccgccgccttccgccgccgtcgattgcgccggcgccgttgcctgcgccgcctccaagaagctagggtttcggtgtggggaacgaatggcgaccgggctgttcgagccagaccggagctggtctaagcacacgtgaacacgagggcaaaaacgtccatacgaaaatacggtaccctaaaacggtggcaaagcgcgcgcggggcgtacattgtggcatggttccaatttgacgaaatagtagtggcatgcacccggattccagaataggtgtggcatttttttgatttgccacaattcgcgtggcatggatccaattaaccttttttttaaagtttctatacgaaagttgcttaaaaaaatcatattgatccatttttttaaaaaatagctaatacttaattaatcacgcactaatgaaccgctccattttccgtgcacaccgtgcatgttgggaacggatgattccatgtgtatatgctcgcacacatgcctatgagtactcaccctctaataaacttatcatgaagaagataaaaacacacccacaaaacataattatagttatcgaaatttaaactctaataaatggagtcatatacacactactttgtcacattgaaagagttatgtaattatttatcacattgaaatgtaagaaactaatgggagtgctggtacgcactaaaatataataattattacaatatcaagataattgatgcatggtgtgcacactacactgatgtctttacgtgaattaaaaatatcatggagaggttttagtaaatggccagtggtaaagaaaagaaatgattagaaggagaacgtacacacctacatctaacatgcttgtacacacatcacaacgtatgcactcacgaatatacacttttacacttgtttaaaccgagaagagactcgtatcacattcggaatatttgtaagcactgagatttaaattaaacccttaatagtgaatacaacttcactgtctacttatgtcactcctatggtaagagtttcattcacattaaatagcatgacatgtcaacatttttattgatgtgataagaaattaataaagtgagagatgaaaaatcatgtctattcccagtacagtttatcttttatatgttacttatgagtatgtgtgagagcatgaaataaatacatggaaaaattacaaaatcatcccagaagtcatctgaggtttaacattacactccataagtcatcttgttgcaaatgctcatcactatactcggttttgttgcaaaaactaccccagtgcacacgtgcttaaccatcatcagcgattctatttatgcaatctccaaaaactgttaagattatattcttagaagtatttaattttgttaaataccacgtagacgcatcacaatttatgaaaacatatcgattcggttaagcacacatatactaggacgattttttaacaaaattaagtaggggtggggatttacaataaaaataacttatgttgtggaatgccaaacttcaattgaattataggatatatttttaattttcccaaaatacattgtataagctaatttaattatcaattaaataccaattacttatgggacaattgcttatttctaccccgttttgaacccctaagtaccaatttgaccctactttttggtgtttgcttatttgaccctcatttttaaaaaggaagctcccgtataaccctgttctgttaagggcaactaacggtgttaactaaagcacaaaatatctcttctgccttactcatttgacctattacatgtgggacccacccatcagttctctcttctccacccctcctctcctctctactctcttatcttctcttctccatggatcggcaagacgacgagccggcaccggtcctggtgacgacgaggagtggcggcggtgagtctgggtggtggagctcgagctgcggtcagtggatctggagccgccgccttcgtctcctccctccttccgcgcgcctgcgcctttgccaccgccacctccgtcattacgcgccgaagccaccttcttctttcctccacgcaccggctgcgctgccgctccctccctccacgaggcgctggcagcgtgggtcttctccctcagctgctaccgccgtcgctccctccctccctcaacgagccggcgaggccgctcaccccctccatgcgccgccgccgcaaggagagagagagagagaaatgtggatagggttgggtggatggatagggttttctaagggtattctgggtattatgaatattagttgcatttcttttttttatttaaatcaaaacttaacgggctagtggaaacagggttagacgggagtttcgttttttaaaaaaagggtcaaataagcaaacactaaaaaatagaatcaaattggtagttaggattcaaaacatggttaaataagcaattgcccccttacttatttgtcaccattaggacacacacctcaaatggagtggccttaacaaaaaaaatattggccttaatgcatgtcaaattttttatttaaattctataggatatatatactcggagagcgtgccataataaaagatgttttctcaaggcaccgtacataatagccattgatgagttaagtgtagggcctagatgggccgtatctatggcaaatgaatgccctagatgaggagcaataatggaaggatggggggcactgccttctctgttcgcgataattaaaagcctatgtgtccaaattcataatccgttctgtcattttgctgtagttacaggaccaggtacagtgtctcctttgcaccgttcgatcgacaagctttgtttccaagctgaggtgacccattttatttgctcctcagcgcgtatgtacaaacaatatgattatatacaggtactactcgtaattaataatcgacgaccacggttggtgcttaattgtgcgtgaattcgtaaacataaagcttgttcccgccgtagtagatatcgagtgatactctctctctctcttaactttttatttacacagtttgactattcgtcttattcaaaaaaatttaaaattattatttattttatttgtgacttatttttattatccaaagtactttaatcacaaatttttatttttttatatttatacaattttttttaataaaacgagtggttaaagagtgcaaataaaaaatcaaaatcctttatattgtaaggatggagggagtagatagcatgattggttgtggtaacttggttcgtacctacacacacaatgtgaccagttcctaaccagaagtactgactggtgtgaagctttgttaaaaagaatatactgaaaaatgccaaattttatagtaaaaaatggtaagtatgtccttaaaattcgattttcaaaagaagtaaaagaaagtttgttctaaaaatatctcccactagagtttagtttggtaaggttaaaaatgtcaataaatcaaacatgatttgttatgttttgcagtatctggactgcagaggctggagatgtatttcctatctttcatcgtcttaaagagaaaaacgatatgttcatttttgcctatgataagatttgtttaagctatactagcaaattcattcagtgggatttgcctaatttggaacctggtggtgcacaattaattaattaattaattaaaatccggcggaggcagatcggaatctccggcgggacggacgcctggagtcgcgcggtgggccgtacggaggcaggcatacaggagcttttcccggtctcctccctttcatttcactgattaggttctgttgattgtcctaataagttaaaacagattaaaaattgaattttcaaagttatttctcgagttgattttaaaatattttcaacgcagtttttttttcaagttatttttaggtttctaagaacagatatataaaaatcttatctacaaattaaattttattctataataaactgatgacaccggttcacaccacaaagatagaaaatattcgtctcatgagtacgtcttttaaactactaaacactatatttttattaaaaaatagagaaaaaaacattttaaaaatgtattattaatcagcttattaaatttaaataattaagacttaattatgtgttaatgacccatcatttaacatatttcttcatttttttcttctcccagacacagatcagcaggaggacgaaccaaagacgaaagaaaaggccaggcagcgagtgggccgccgctagctgctcgtctcgccgccgattgctgccggaaacttattcatttccccactttaattagttgtccatggtggatggatggactcgtccctgtggggctctgcttgctgccttttgctgctcatctttttctcattccaaacagccgaacctgccgactatatggcgattaattctactaccttttcttttcttttttggccggttttcctctgggggataatggggccaagatatgtgaaaccaaaccaacccagtgttattgctctcagatttgtgccactattatctttaatttcttgtttttttctttacaccttaattatgtatttaccgactatcgcgatctcgctaccaaccggtggcacccaacttccttcttgaccacgtacttcctccatactcataaaggaagttgtttaggataatgtttaagttaaaccttgggaatataaatcataaataactcttaaattaatgagtttgaaaacgtaaaaattatatgaatagatttgtcttgaaaaatatttttataaaagtaagtatatatatatatcactttacaataattttttttatagaaacaagaagttaaaattgtgttttggagaacgtgtcgctgcaggtccaaaacggttttctttacgagtacggagggagtacgtatctactgttggcaatctttgtctatacatagcgatggcactgtttcaaatgtactgactgggtttgtatttgttttgtcacgtacgttgttttggctgtataacagtgtactagtaaaaggctagtttctcggagagaaatacatgagcaataatttgcggttagtgactagtaactctgagacaactcaatttattgataagataagtgtcatttgcacatactattagagcaggtacaatagcaggctataaactagttataaacatatttcgagaagataaagggctattttggtttgatgccaaaatatgccctacaaaattgttggcattttaaatagtagtttggctagtgtttggtttgatatcaaaatatactactaagagacataagttgtcaaaaacatttggaactatcaaaatttgcctatggtttggtattgctagtattttggcatgatagcaaaccaaacaagcccaaaagagaagagagaaaaacagcgggctagagatgatttgtagccagctgcagtacggactctaagatgcaatgtgtgtacaacaggtgagaccaaatattaatagtgtattatatgcttatactccctccgtccccatatgtagcaacctaggatgggattcgaatgtgtgtagtccccatatgtctattctcatcctagattgctacgtctatatcagctattaaattgactatagatgatttggagctagttgttggctatattattaaatttgcccttagcaataaaaagagagagagagagaaaaaaaagtagtgctaatgtttaaccctcaggtgatgtgcagcatgtgctagcgtagcatgtacaaagtttttaaccggtactgaagggagtatatgacaagctgtagttgatgtgattttcttttccaaaacacagcgtgaacgtatacgctgatcatatacgaccacgcgaaatgatcaaccctgtttgcgcacgcgtatatggacgctctatccttacgagcactttcgagtgattgagtttttacattgataaagttaccacattctcccttcgtttcatattactataagttatttaacttttttcttagcctaacaaattaagtttgataaattttatataaaaatttagtaacatctaaaatagattatagtttaattaaatataacattgaatgtattttgataatatatttgttttgcgttgaaaatactactatattttttttttataaatttgattaatctttaaaaaatttgactaagaaaagattcaaactgacttatagtatagaacgaattacatatgagtatatctttctagttacccgtaaatcaaagcattcatattaaatttagaacttaaaactcgcgcgaatatgttctatcacaggaaatctaaaagttagctttcgctcgatcgattcgagaaatttgacctgccgaccaaacagggcgatatgtactcccgcaccatatgtgattggcagcttggcacattgtacagtacttctgcctcactgcctcaggatcttcactctctggcaactgcaactgcaaagcaacaacacaggcacagcctcctctgatatgtagcctgcaactactctctccgtttcataatgtaagtcattttagcatttttcacattcatatttaactataaaaaaatatgaatgtggcgcgcagttaaatatgaatgtggaaaataccaaaataacttatattgtgaaacggaggaagtaatatttaactgcgtggctatcctttcacgacaagggcgagccacatatttgcatgggctttatcaccgacatttgctccaattatgagcggaccaaaggtcggtcgtggagctctcacggctacaccatccaatttcatcgctgtagtgcacgaggcccaccgtacaggcaaacatggtaggccaggtttatatcaagttcaataatatagttaattaactgatatcacataatttaccaccaatctaatagtcctttgctgttgatatacactagaatatcattaatatatatagctcacctctctagctctcacaaaagtactccatctgttttagaatattggatgtatttattttgtaggggaaaagtcttaggccctctttatttaggcttataagccaacttataagtcgaaaaatttaagccaaaacaaacaagcagctttttcatttggcttttttgaagccataagccactctaacactattaagccaaaagctaggttggagaagcttttttggcttatatgagacagatgtatgactccaccactaaacttaggacattaaatccactgccttataaatcatataagctaataagctaacttaaaagtctaggccaataaaactaagcctaaacaaagagggcctttagaccaacaattactttacgaggatataatttttgttacacaaaaataaataaataaaattcatatttaagaatacttagttatgattatatttttatattatctaaaaaatgattatatttttatattaaataaaagatatcttattaaataattgttggttgaagtcttatcctaacaaaacaaaatgtgtaatatattttgaaatggagtgagtagtttattagagcttatgatacaactgactataaatgctcactttttatctctcttcttcatataattacaaatataatgttaaaacttacatcttaactttcgaattaactattgttacgatcttcacttttggactacttacgtcagaatgtaaagtcttaccgtaaaacatgataaaaagaagtcttaccataaaactatattccattacattggtagtatatctgtggcttataagctgtaactaataataaatacagtcttgatcctaaaataaacaaacttagtatgagatatcacacagtgtgttttgttctgggactaggtgagatggaatgaaaccatccctgatttttggggttgggatgattccacgcgcgtgtttggtttgtaggataagctaatttggtttcacttggctccacaatgggccgaactgaagcaacgtatatttggtgggaataagttcacttaggtttcttaatttgtcgcaaagtctaaaattcttccttgaaccgaaataccagcccatccgccaacctataataccgtgtcaattttgctcccttggcagtacagtggccggtttttgcaaatgtggtaagtgggacccatgtgggccccacatgttaatggccctctctctcccccgcgtgagccttggagaggggcagctgacccgagggggcgggggagggggggtgcactgatgggagggcgcatgacgaggacacacaacctgctggtgatcttcatcaaacaccacaagttgaggagatccccgacgtctccgacatggtgacgctctacggcgcgccggagctcttgtaccggtccttctacttcgactcggaccgcctggagcacatccgcgcgctcgccatcgctaacaatgacaacgagaatctcctcagtaggcggcgcaccacatttgaggcactgtctgggctttggaccttgcgtcggagcaacagatgaagctacggttcatcatggacaggcgacgttgccgctcccgagggcggtactccggtacgagtacatgaggtcagtagtggactacttcaacgtgatgcgggcgtggccatcgctggcgtcgacactgttgatcatgatgtggtcctagcttgtcttccatgatgccgacttcaggtggggggagccaatgatatccgaccccgtcacgctgttggagaaggaggtgatccctcttcctaatgcacggcaaggagagaaagagcatcaatgtcttgcttggccttccaacatctttcatggatgtcttccaagtgctcatggacgggggagggcgcgtgacacgggggagggggagggggatggggaggggggagaggagggagaagagttggccgctagcatgcatatgcatgtctcacatgagtccaactcatcacgtcagccaaacctggccactatgctgctgaaagattaaagttgatacagtattgtgagttaggggatggtctaaacctggtatttcagtttagaggtgaattttagactcggcgacaaaatggatgacctaaagtcaacttattcctatctggtggagcaatggcttttgtctgtttcaacgtttatagtgctaatgtggtgacaattgtgaagacatattcagttaattaaacacttgaatctagaacgactttgctactagaggaccggccaggccagctgaccatgccttttagggtttattcggttcgtggaatttccaaattaaaggaaaaggaaaaaaaaataaagaaataggatgtgcactttatttcttaggaattttttcaagaggtctcacctcgagctaagaatcatatgaaaataataagcttgtaatactacaagtctacaacccttaacaatttggtaagaggtctcacatcgtgctaagattccaaaatttgtccgttgaaattctttttgagatacctgctatccgttgaataaaatgcaaaatatttttgttgataacgtataatatgctattgctgagaaatgtgcatatgtacatgagtgttttgttataaatttctgttagcgtactgtttgccttcaagattactattactatactttaataataggtaaaatataatttagaaatgtcgttgcgttatcaactgatgaatgataaattacaaacctagacctaggatagtcactctcccagaagaataatagataataattcaattaacagtaaataaggaagaaatgacgttatgctccaatgaaaaataaacaaaaaccaaggaagaacatccaaaacacaggattttacacttcaatggagatttgccagtacttccggcaaaaacaacaaacaaacgtatttttcaatcacggaccaattaatgaaaagctgaagaatttagggctttaaagttacaaatgaaagctctatatattttaacaaggcactggagcgtatatgtaagcatcagatgtgtacagctagaaagcagcaagaactaaaaaggacctatctgtaagatgttgcaaagtaagaggatgcaaaaaagagaggcggtggggcgtatatgtaatggagaaactgcgagggaaaaactgcaaagatgtaagggcctggatgtaagaaataagaataggcgagggcgcataaagaaggcccaggggcatatctgtaacaaaatgtatggcctccagggacctggacagaattctcaaaaaaatttggaccatttctcgatttgtgcgtgtcatccttgcgcaggggccatgctaatcttctctgtatcgttccaattttatcggatgtctccgaagagacgccagggcagttggcgcgcgggtttataagttggtctcatcgtccctaggattctgatgtggtactaacctctctcgcagcgccaccgcacaagccatcggatctccatccaacggtccagagtggccagcgccacccgcgcggtaggatgcgcgtgggctgcaccttccgccgcggcccaaatcagcgtacggaccatggtatttcgattctccccctcccggcccacatcacatgcatgctgtaatcaagtttgagcattatccgcccgaactgatcgtcaatttcaacacgtttaggttaattaagaatttgagccactgatttgatttggttaatggtttaaatttgattatttcatctagtgatttcggtgttcagtgttgccctgtatataatatcttgccatgtaatactgctaattgctatctgaacaattttggcagaagaatttgtagctttacgttaatactgcagtagttttgctcctcgataattcagtcgtaatccttgacagccaaaacttgacgttattgctaatcaattgccaaatgaatattatgaattactccatatgctcaacctcaattgattactgaactttattcttgtaattagaaaacctgctctcttcattagaaatttatgaacagaaaattcttgccaggccggaaaaaaagtcggaaactgatattatttgcagatattgcaggaactgcaaagccctctgaacttgccaacaaaagtttgtgcgtataattaagtagtagaaacagagccatttattaaacggttttgctatacttccggcgacataattttcacaagattacagaccatttttagctctttgattttagtctagcaagaatcgtgccgctaaattacttcctccgtttcatattataagactttgtagtattgcccacattcatatagcaacatgcatgaccatttaattacccatcctatcaagctttggccatcatgagcaagaaaagagtgatatacgcgtagagtaaatactgctagctcattttggttaaaattacattttagttacatactacttacactataactttacataattgcattatagttacacactactttaactagaaatttggataattacaatgaaattacagtaactgttgtaatttttaaatcttttgtaagcatttaaaatttatctggaacacattcatatgaattttttgaagttcgttggtcatacactcatacataagggcatgcaacatattttgtggcccaactggaaaccaagccagaccatgatcgtgcggaggttgtatgggcctgtcgatcatggtgaaatttgattgtattttgcctctgttttgtgacaacattattatagatattataatagtccctttatcaagaccgtgtttagttttctccatattcctaactttctatcacatcatatcacatcaaaaactttcctacacacataaatttccaactttatttccaaactcctaactttcttcaaacttccaacttttttcagaaactaaacacatcccaaattatgctccgattctagtctccgagaagaccggatgctccgtcacctgctccgcccgcaacatttgttgcctctcctccccaaccgaaatcgatggtgatggagacgaaggattcctggcaatctgtaatagatagagccaagagctacctaatcgaggcttccaccatagtggaggttgaagtttccatggcagcacaagtgaaatagaattttcccttgatgattcgctatcgatgcataaggagaaggccataatctcatagatttgcttgctacaggtgtgaaaggcggtttgcgcagactctgtgcacagatctagagcgctcctacctactctttgtgcactaactcatgcaaaaccgagaaaagttcgattaataactaacctgaaagaacccctagaaaagacccgacaaaaaaaaacccaactaaaagctaaaacctattgaaagaaagtgacgactcccttcaattgttagggttgaacagctagaatcatgtagcaggacgagcgattgagagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57736 - DNA, 707 bp, Oryza sativa
ctgatgggcagcatattctcctcaaagcatcaaattgttttgcatagtaacaaattacagtatacttcacttgtcctaaaggaccttcatctccaaaattcacctttatgtgacttgcttttctgtatgcgagtggatctgaaggggatggattcttgcctcctgacaaatagaggatattgtcctctgtagaaacaaaacttcttagaagttcagaagcagtttcatccactgattcagttaatgaagcacctctcaaatcagttactgagagtgaattatctgttgtgtcgctttccagttcatctgatagctgaagatgatattcatgggaagcaagcgcataggagatgatgctagtaggttcatcatcataaatcccaacaacagtgtcattaacaccaattggaaagagaaatttgggcccaacctggcgctccaccgtcctaagaaaagaaacatgaacaggagtatattcattgagagcatcaaacctgtttgagcgacaccactgcttgtttagagcacggtaaagttgtaagaaaggcatcccaagccagttggactggtcctctgcactatcgcctagcttgttcaggaagacagaggcatatgaaggtgtatcagtcacatgttcttctgaatcctctgaggatgccacacaatctggtactatcgcactgctagggacaggatcattttacctg

SEQ ID NO: 57737 - DNA, 16201 bp, Oryza sativa
tgtactagtgcaggtagcgaatcgagcgaatccccatcggtctgggcgatgagttcagcgcggtagatgcaacagcctcccgagcagggggaaatcgcagcggcgaccctaggggaggtaggaaaatgcagggacgccggctcaactactactcgacctccttggctcctcctcccttagaggcggtgatcgtcggagtggacgatgacaacggagacctattagatgacggcggcgacggactgtagtcagtgccatgctcctcccaccttcctcatccttcggtgcccaactcccctcagcgcctccactcaggtcgggtcgtcgggagatgttgaaaatgattaacccgcccattgattagttcaatcggattttttccttttccgatataggtgtatatgtttgtttgcacaagcagtatcgcagagggcaagatctggtttgggaggtattcatgtgtttccctcgaatccctacccattcaatttttcttttgttttttctcctctttctctcgtgctcatgagaagacacatgtcgcagtccatggcgatggagattcctggcctcgatgcgcgacggcggcgcgatagcggcaacggcctccatgcgtgacgacggcgcgacggcctcgatacgatggcgtggcgggctcgatgctcgacagcggtggcgggctccctgcgcgacagcggcgcgacgcagacggctggcatggacggccgtagatggaagagatgagaccttatttttgttagcccgatcatacccctgataaactaacagttagattaaattgatatctcgtacctcatattacctcgtggtacctcctcaaggattggaaagatgctcctcccacaaaggacgcgacgtgaaacgttgcttttttttttttttttttttttttgcaaatatgccgttttggccattggtcggttagcttatttcttctcgcgaacataatcttttatcgagcattatagaggttcaaatcagggctggcatttctaccactccaaccatcatagacaggatattcaagtttgttactactatacattgtttttccctcagcatcccaccaaatcggcacccgaggaaagttttacaagtgcgcgatgatgtatccacacgagtacaatatatatcaattaaccagtgcgaacaaggtgatagtaataataactcaggctcgcatcaacacttcgcatcgtgtgcttgcaactcacggctcatatcatgggaggcatttaaaaactcacgctgccaaaatgctcagtggcccagtgctgaacttatcacttgttgctcgtccttgttcgtagctcatggcttcaatcactgcgaggccgaggcctacgctaattcctcatagatctcgcatgcaggcagcagcgtgtcccaattaccatcgcgcacagcggcgccatgcacgcacgcacgctctccccacaatccccgccccttcacgcgctggcgagtggcgccttttgatctaacctgcccgagtttgcctgattgcttctctgttcccattccctttctacgcacactgctgcgaaaccagtgctcctcactgcaattgtaccacaccgctagtgggcacagatcggcccggctatatatcagtgagtgcgcacggaaacaatagacagtagtagtacgagctgcagcgctgtaggctagctagctgccaacccaccgacgcttccatggcttccacctcctcccctcctcgccacctcttcttccttttcgcgctcgcgttcctcgcagctggcgccgccgacgcgtggccggcgtggggcaatggccgcatgttcttcagcaaggcgacgcgccccgaagccgtcgagcttgacaaggtggcggtagcgacaccggcagcggcagcggcgccggatgccaccaactccaaccgcgcgtcggatgagttttctcggccgtccagcggcggaagccacaaccgcgggtacggcctctacggccgcccggaggagagctacccggaggcctacttccgccgcggcgtgcaccacgacgccgataagctgacgaccaccagcgcggcggcggccacggccgagcaagaaaaagaggaggaagcgacaccggcaggcgacgacgacgcctggcttgggtaccccgcagacggcagcggcagggggcggccgcggccgtacccgcgcggacagcagcagcaaacgaccaccaccaatgcggcggtggccacggccgagcaggaggacgcggcgccggcacgcgacggcaccgggcttgggtacagcgaagaccgcagcggcagggggcggccgatgtcgtacgcgcgcatgcgcggcggacagcagcagcagcaacagccgcagcagcaatactggatgagcgacacgaggctgtaccagaacgggcggtacggctacgacgtgaacaccggcaagtacggctacggccgcgagtccaacccggtgcggacgcggcccgaggagttcaacggcgggaggaagtttggcggcaatgcggccggcgggcaagagtacgcgaacggcaactatcaggaggagttcggcgtcggccaccgtgccggcgagcaggtgaggaggtatggcaatggcaatgtggccgggcaagagtacgaaaacggcaacgatcacgaggagtttggcatcgggcagcgcgccggcgtgcagacggggaggaggtatgacaatgcggcggcagggtactacgacgcgaacgggcagtacattccatgagtatctcaatgatgttatactgcgaagcgtttgtagtacagtggtagtatactcgcgttcacctccttgtgtgctggaagtaagttatgttaggttacttcgaaggtagatcgagctggtcgctcgcccgctctcgtacgtgcgcttgttatggggtgattgaagggatgaatcacttttgtcggataactagtggaatgtactcgtctcactgtacaagaaataatgcatgctacagtactatatgtcactacaacttttttgccattgccgttcatcgtcggtgcaagaggcgcttctgcctgctactatgggtaaagagtaaaaattaggccccactacgcaaacgatgattgattaggagcatcttgtttgtctctgttttgttgggttacacagacagccctgcttgtagcacgtgattgctctttcagtagcaatgccatttttgctggtaacatctctgcagtaaactgggagaaataggagttgtgccatttttgccgaacattactggagtcagtattctatcgtggactcccgctggatagtgcacagttgcacactataatttgggccattttgacgaactaactctatgtaggccatgatttgttctccccgatcgaggcgcatgcataacgaaagtcacggaagtattgcccccacttggatttggatgatccggatcctgctgtctgcaccaaacaacgaaccgaaaccacgtacctaccggggcattgcaaacgctgcgtacgatacaaccaaccccgtcggtcattaatgaacgtagcggccattgagttatatttccagactcggctgaaaaatgcttccaaggtagagagaattggagcacggggcaacgggcgcagtgtcccagcggcatctcgtacacgagtacagtaataatgaatcggcaggctgtatgtaccacggtgtaccaatgaatcggcaggctgtagtgaccaccgtgtaccgctacataagagcaggtgctatagcagattataaaaaacggagcgatagattaagatgtgattaattaggtattaattataaaaaaaaattaaaaaatagattaatatgattttttaaagcaacttccctatataaattttatacaaaacttgtaccatttagtggtttgaaaagcgtacacgtgaaatacgtgaaaaacgagggaggtgggatggaaacccatggggaagaacacagcctaagagcatgtacaatagcaggctataagccaactataaatatattttaatgagataatagaggagagaagagcaacgagctatagatttgtagccagctgtagcacggacttcaagacacaatgtgtatacaacaggtgggaccatgtattaataatatagtatgtaactattgtatgaattgactattaaattaactatagatgatttggagctagtagttggctatactattaaccttgctataaaagagtagagagaataatagtggactaaagatttgtagccagctgtagcacggattccaagatgtaatatgtgtatgacaggtgggaccatgtattaatagtgtagtatatgtttaaaggtaactattgtatgaattggctattaaattgactttagataatttggagctagtagttagctatactatatattaaacttgctctaaggctgcgttcgttcccatcccagccattcccaacactccctcctcgtttttcgcgcgcaagcttttcaaattgctaaatagtgcggattttctgcaaaaagtttctatacaaaagttgcttaaaaatcatattaatctattttttaaaaaatagctaaaacttaattaatcacgcgctaaacactgcttcgttttacgtgccaggtctaagagcaaatataatacatagtagactactcactactccctccttcaaaaaaatctgagacctatttcctttttgcatcaataccaagaaacaattaacttactcatcatgtggcaaaaccaatgaacatgcaaccaataagtactccctctgtactcgtaaagaaagtcgtttatgacaatgtttaagtcaaacattagaaatataaatcatgaataactctcaagttgtggagtttgaaaatataaaaattatataaatagatttgtcttgaaaaatacttttataaagtatacatatatcacttttcaataaatatttttatagaaaaaagaagtcaaagttatgttttggagaccgtgtcactgtctaaaacgacttcctttatgagtatggagggagtcctagaataacttcttggttttcgattaacaatttaatttagcacgtagtaactacaaataggacttagatttctggaaaaatcaaagaatgaaatatgtctcagatctttggaaggagggagtataagccaactatagtcttatgtggaggaaagataatttgaaaaatggagagagttggccctcatgcaagagctagttaggccattcccaacccaaaacactagacataatttccataaattccacatcatcaagaaactagtactagacactactcttccaatgcaaacaccactattccatacttaaatttaatactacttacctcacacgatgtcttggatattgtgtagaaaccatgtctcatgcaatatatggtttcattctctttcctcatttattcactggccatattattttttatcctaggtgacagcttatttaatactatggacaccatcctagtcattgggttgggaatggccttattctagtcattgagttgggaatgaccttattcacatccttcaaaataaatacattaaatgtataggtgagaaatagagagacgaggagaaaaaaaaaagataaccttatacttatggatggctctattattaaacttgctctaaattgaccgtgcgcctccgtaggaaaagcccaccaaacctcttttgttccgcgcccgctagcattaacgaccccgcctttttgttaggacgctgattggcattggctggaccgcaaggtaggtggctagcgggtgccactgccgcgcttctccttccccacttatcctgtatcatccactaatcccccgcgcgccagcgcgtctctcccagataattgctgcccgttcttgctcgcaccgtcgcacgcacgcacgccgagtcacgcgtatcacggagcggaaaaagtgcacccaaggtgacatcgaattacaaaatcgttcctcaaccacaaaaccggatatacggcgtcccccaactaaccaaaaccggtcataataggtccctcggcggttttaacactggttttgtcctatgtggcagctgactcaacatgggacccacgtgggccccatatgtcaggctgccacattagcacatactctatttccccctcttgtctctccgtgttctctccttccttcctcctcctcgctctctgctctcacacgagcggcaacgcgcgcggccggcgatggtggctcccgagtggctgcgcgcgggctcgctagcctccccattcccctagtgcggtcggcgatggccgcgtgcggctgctgccatcatgcggagattgactcgacgacgccgccatcaagtcgctgccgtcgggcgtcggcgatggtggcgcgcggctgcggccggcgggggaggcggacgaggtatgcacggacgccctcgccctcgtcgtcgatgtcgccaccgatgaagaggtccgcgccgctcaccagttcgtaggcctcgtcgtcgtcgacgctcgccactccgttccggccgcggcccagcggacaactgacgagaagccggcggcgcggcgcccccgtcacggacgagcgacaagaagccggtggcgtggtgcccccactcgaagccgccgccgacgatgagccaagcggcgcggagtcgtcggcgccgccgctccccatccgtagccgcgctcgcctgttgctgctgcggccgctgcctctccgccaccgcgaacgcccgccgacactgccttttccctgccgctgccctcctcttccccgccgctcattccccgtcggccgcgccgaccctcttcgctgctccttctcctctccgcctctccttccccgtcggccgcgccgtccctcttccccgccgaatcggtgacgccaccgccaccacatctgccctcctctttgccgcgctccttcctcgccagccgccagccgcctcaccccaacgatgatgcacggtcacggcaatggcgccgcgcggcacgtgggggaggagggaaggcagacgaccaccacggtcctccccgcgtgacggcaaccatcggcggcgctccccttcccgtcccggtctcccgcgccgccctcgatttgctcccctccccttcccccgctgaccaccgttcccatccccaccctcgccgctgctgccgccgccgtcgccgccgcccacctcgctgtctccacgcccgacttcgacgccgcggcgggggccctcttcgcgcgccgcgcggtcgaggagggtggggccgccgcgctcacctccgacgaggccgatgcggtgccatcgcccgccgctgttcctctgcctcgtgggcctcgtgggcggcggtcggcggaggagtccgcgcgccgctccttcccccacgtcgcccatcgtcagctgccgccgccctcctcctcccgctggctgagttagagaagggagagagagatgaggaagggagagagaggagggaggagagagaaggttgatgtggcagcctgacatgtggggcccacgtgggtctcacgctgagtctaccgccacataggacaaaaccggggttaaaaccgtcgagggacctattatgactggttttggttagttgggtgacgccggatatccgattttgtggttgggggacgattttgtaattcgatgacaagttgagggaccctgggtgcactttttcctcacggagcacggcgcggaccggcgggctgagacactcgcgggccgtggcgatgcttacccaagctggacgctgtgaaatgggccgcgggttacaaaaacgaagtacgcgttcacgtttcccaggcccatctaaccgtagggttttagcgtctcgcccccgtcctctgccggcgtagcgccaccgcactgcgcacccgccccgacgcaatggccaccgccgccgccgcgagatcgttccttcgatcgggagtcgcctcctcctcgtccatccgcggcgccgccgcgagagccgcatcccgagccgggccggctccgctcccgaggaggctgcccgccgctgctccccgtctcatcttgaggtacgcgcgagatctcggagttgaggacttctggttcactaggaatttttgtttgctttccttgatctggatggggagtttagtgcttgtgtttttttttgtttccttttggattctgcaggtcgccggtggagatgagcagcgtctgcttggagacgctgatgcccatgcacagcgccacggcgtcggcgctcatgacgtcgctcctcgctgcccctgcgtgcaggagctttggctggctctccgaaggtaataatttctccctgatctcaatcccgttaactgcttttccaatggcggtacattggctttgagttatggagcgcatttgtttgttgctggactgtagagtggaatagattaggtgctggtttggacagatcagaaagacatcaagcactattaagtggtaataggatgagatgtttgttagttgtagctgtgctaccaagagatgtattattgttcatcaacacctaagtataataagttgaggaccaggctctaatttagagtcctacatgaaaacaatcggttcaactgtaattatgaattcgcattcctttgtctaccaaatggactgtcccacattatttatttcaattcatctttgctgcagtgggcattccgcttacagctttaatccatgtttattgcagacttgtagtccttgtttccaactcctttagagcatatttttcattgttccctggtcattttggacacttgtttgttagatgaacaattccaaacatgttggatttcttatgtttcaactcctttacattctatacggacaaagccttgctaatataacgtgacacattccttaggcttttggcattatgtttgttaagtgtcttcagtgcacaaaattaatagccccatcctataataacatcaaggaatgagtgtgatgacaaaccttatgcaaactatatagcactctcctagattaaagttaaaatgtaatagtcctgaagtttgtcatgttgaaaccaatcttatattttcgcatggcccttgttgtagggaatgagtgtgatgacaaaccttatgcaaactatatagcactctcctagattaaagttaaaatgtagtagtcctgaagtttgtcatgttgaaaccaatcttatattttcgcatggcccttgttgtaggtcaagacgaaactagatgaacaccaagcaccaaaggtgaataaaccttaaggattcacatactaataactgttgatggatagttcccatcactaatttatggctctgaaggatttacggagacaagatacctttatttaaaggaatgcattgtacgcttcatcattaataagtaaacatgtagctggagtgcaggaaatgaaaaccaaactatgtttcatcgtgctattccacagtccggataatttagagttatccttttgttgttttttctcgtgttatgtcacaagcatacatttagaccttttgtgttgccggatcaaaactctcccaagagcgacattttcaaatcatagaccattttagttcgatcgtttacccccttaggttttattgaaactgtttgtaatttgtaggtttaatattgaagtagagtttcaatttataataatgtgctaatcatcatgaattacaaatttgaggcaaaagggacactgattcttttgtattggcccagctggcaatgatgacgtgtgacaaactctaggtggaatgtagcagattatagtcccgtcaactcaaatctacaggtctggcaaggttttaaggagcatccatgttagcatatattcatagtcatgttctattaattttcctgccatggtttgcacaaaaaatgaaagatgaagacgcatataaatctctgccagggtacttgtttctccttttaattaactaggaactacatgattatgtttgttctttgtgatcattcgggaccatgctattcgatgtccttggaccttacctaatgatgtatgcagtttatttgtcctgctatcatgctattggaattataataagctacaatgaaaccatgattatgtttttagttcttgtatatacttgttttttgacacattatatatctctataggtctgtgattagtgacaatggagggtgtctgagatgaacacatgctagtatttactttgtcattgctgtgcttcatgttttatcactttgtaattcgtggaattaaaacaaaaaagaaaatttatttctttggctgtaactttttacgctgtcagttaaaaattggatcttagattgttgcgtttctatttgtagatggatgatttgttgttatcggagcctgatgtgacgatagctgctacgagatacctcctattcaatttaaagtactttccgtcggcgtcttctgagcgacatgttcagtattctgggattttggtctgtgtaagcgtctacaagattgttacctgatcgttgcgacgcttacctccggttgtccaactgattttactattgatggcctactactgattaagtcccgctgagaaaataatgctgagttggaaattttctaattctacattgttttgcttctatctgcactgttactgtattatgtacagcgacagtttcgtaccttattactacagcagtacagtattatcgtgttgtattaagctggagacgccgttactctctgttccgttgacgagcagtatcagaggcctctatctccatggtggccatcgcgtcccaactgttagagcattgtaattcaagctagcttctttctagaggggaaggtggtgccatatataacaaacaacgatgtagggaaacactcagcatccaagaaacaatttttgcccatatggaccagaggttcaaacataagattactacggttcgaatcagaagcactgcagacaatttatctcctagaaatcatatccttttagaggctcaaaatgcagcagcaaattgactgatcatctcacatcacatttgttcttacaaccacaactgctgcagcacctaataggctaatacccatccgtacatagaaatgctcgataggaggacatgaagcagttcagaccaactgctacaacctaacctcagaatctccttcatctttcactttcttgagccaactcaaaaggtagaatttgaccaaataggcttggaacacataacttctgaataacaacgaaaccaacacgatctcacccttcaacattgacaagttcatactccacaagtgagagattgttatcctcctttacgttgaaacttgccggttcagtcacttcaatgcggccccatttgtccacagcaagcctcattgatcctttgaacatatcaatttttgcattgcggataataacagtgctgtcagccttcatcaggtcaactgtaaatagaatacaattgttagacatcacccaagtaaaaacttgttcactacataagttaggaagatattcttgaattacgtttgtactataatacgcaaaaggtcagggactgggcatgttatgaatctaattgtccattcatgtgaataatcatgcataggacatgtacttatcattttggagtaatcatttatgaattacacttacgataataagcaaagtaaaattagatatgtgcatatacgagcaaggcatgttaaaatctatcaccgataaaaaaaaaagacaatcatccaaccagcttcagaaatgatgtgctcaaaagcatatactgtcatgcatatatgaactaatccaaaacactaattaggcagagggtgaacttgcgcaactcaagaataatctatcaaatgccattgcagtttcatgcacccagagttttcaagcaaatatttctacagagattaagaactaaacagaaggcaatcaactaaaacatgcaatgatgcacagttcacaagtacagacgtacaggtacttacataaccttacacagataaatatagaaagtgacacctgtaccatttgggttacacaaatagcctcaatcttaccaactggatacaccagccagcagccaagcatattttacatttaaatccaaattttcggaaccaaacgttaatcttagtttggttgtgctaaaaaccacatgctgcattacatggaacacagtagtatactcttgcctgatatcagataaacacctacaagtacatactatcgcacattattgtaccaatttaacactaagcatgcgacttcaaaaccagcctcgtcaaaggaagcaaacgtggtaacggaaactgaatactatgcacagaatggggacacagatcgtaccctgctcgttgcgggcggtgaacaggatgcagccggtctcgtcgccgatgaggcactcggcgatcctcgtgggacgcgccgccgggcccgctcccgcggcggcgcggcccttctggaccacggtcttggagctgagcaccttggcgacgagcgtgtggccgcccgtgccgggcttgagctggtccaccttgacgaacaccggcttcctcttcgccgccgccgccgccgccgccatgggtacggaaaaaagaacactggagagtagtaatggatagagataggaataggattacacggagggccaaaccctagatgaggcggggagagaatttaataggcgatcgaggaggaggccaccactagcgacgcgcgcggcggtgacttgttaaaaccagacgctatcattaccgggtccagtaggatggatcaaaaggagtattatccgcttctcctttgccaaaaggtcaagaaaaaaaaaaggaagaggttcagttcggtgggaatttggccgccatgagtgataccctatgctatgctactatgcccctgagtagagtagtagttatttagggaataacctgagtatttgttattaaaaaaaataaaaaaaagacactcacatacgccaccgtgtacatgagcatcgttgaaatattagacctatcaataactcgatataaatactcctttatccatctcattttaagtgcagccataatttttcgtgccaaactttaatcgtccgttttatttaaaaaatattaaaaacataagtcacacataaagcactaacaaaaatactaattaaagaaaaatatgacgaataatcaaaattagatacagaaacttatggttaaaatgagatggaaagagcagttatgttccaccggataaaaacaaactgagctacgctcatctcgcgaataatgatgtgattatttgattcgagttggatatgataggacgacactttcgaatagagttttcgagcatcacttctaaaagcatccatcagataaacttatcttcatagccatcattaactcttattagcatctttgcgtgcaagggaagggcaatcaacctaaacccgtaccttacgtgttgttattatgctcgaccaaggcaccaagctgcaccgaaagtccaaggttgcccatcgaagcaccaattgtgcctctactaattttcatttaaagcaatacttcgaagcatttgtgcttacagttacagacgatagaatactcgctgcattctgccaatgaggcaaatctttcaggccaacgttggctaacaccaccaggcagcatcattccaacatcttcccaggaaatgagagaaatgacacccaaaggtgaaccttcagaaggagggcaattgcactttgattttccaggcgcaaaaaatggaacatccagccaggttaacaaacaagccattagagttcacgggtaatgctgcaacagaatcatctacatacaactagctctaagaaggtgcaaaactggagaggcctaaattactcagtacaaatctgaacatctagagtaagatgactgaagctaatcagccatctaaaaggttcaatatggatctaagctatatcagtaaacagaaagccttccacattgcataagaagctgtacagaggtgacggaggacggcctaactgcgataaccttgttagagcctggcaaaagaaaatcagcagtcagaatcatcggaagtaagactgaaaatgcacagtttgatctttacaattgcaagaaatatgaccaagttaagcccctgctatcgttatcttgtgttacagcagatggttagtgtactgccataaaacagaggtatacgttttacacaattttcataaaaatcacagttcagctttgattggtataggtatggtggtagtgctaagcaggtgtcatctgtgagtctgactataaccaataacagatggaaatacaagggcgagctgatttcttcattagaagcatcaaaaggtttcgtgcaagtacataaaaagcaggtagaggataaacatgagacttttatactccctccgtccctaaatatttgacgtcgttgacttttttaaatatgtttgaccgttcgtcttattaaaaacttttgtggaatatgtaaaactatatgtatacataaaagtatatttaacaataaatcaaatgatatgaaaagaattaataattacttaaattttttgaataagacgaacggtcaaacatgtttaaaaaagttaatggcgtcaatatttagggacggagggagtacctatgtaacgacagtattttgttaattttaataagtaaaattttatcaaagtgaccacactttctttgatgcacacttaggtttctgtttgacagggaaggtaagagctatttactgaaagctcttattggacaataggctcttttctcggatcgataagtttttgtccccccgcccgtaatgaaaggagatacaaccagatccaaatagaaactaaattttgttcttttagttcttatgtaagcatcaaatttccatagcaaaatgcgaacagtttaaaatataaagatatatctgttaatccaatttaatgctaaagaaaatctaaataggcttctcacaaaaaaaaaattctaaacaggccaaataattcatcaaggcttattgtactgtacctcaaactgcaattgttttcttgccagcaagaatgcgggatatctggaggcctctgctgaaagcttcattgaaaagtaccctcgtctgcatttcctgaaatccaggcaaccaggaaaagaatgcaactggcgccataacaaacaccccaagcagtatctcatacaaacgtgccacagaaacaacactggcccagaccacagtagactcaatgaatggtctaatcacttgagcaatggaaatcaagccccaaccagtaggaatgaatgccaaaaggcttgtgaagatgtcaatgatttgaaatttagtaaatttcagaaatattatcagcactagcactgcaagaataatgacaccagattggatgacccggtgtaaaggtgttgttttgcagcatacttgtctcgagcatatgacattaggacaaaaatgccgaaaatcacagccacacaaatccaggaaagcagataaacagcaatacttctgctttcatttgcgatcttcaactggtatacaaccccatactgaaaaaagaagtatctgagatctaacaatatttctaaaatctttccccaaagaccagttgttcgtagatgatcctgctcctcaaaccaccaaacttcccagctgtgttcagccttagaaaagatactaccagggtaccagatccagttcatgaaatcatcaaagtcatacactgttttcaaccaatcaaagccagatggattaaaagcaaatggagccatgatccatgataccactagaaaccagctagatatcatcatgattatgtaaacaagtgtatcccttgcaatcacactgtgagctgcatacacagtcaatactattccaagttctattgcctttatgaagtggctcctagcatacagcctgtaattttcagcaaaactcttatgctgcacaacaaaaccacggccagtagcacgatacttagcaccgccatgaagaattgtccggccatagtaatggcttttcgtccccatggaaaatgtgtagaacacggacgaaaacatcatttgcatagtgaaaaaatcccagacagcaggcagaaaaccctgttcaagagagttctctataatcattggcaaggcagtgaagaggccaagctgtatgacaaattgctgatt

SEQ ID NO: 57738 - DNA, 9135 bp, Oryza sativa
  unsure (1)..(9135): unsure at all n locations
gttgacctggcaacctaatacggtatatctcaacctctctctgtaagacaggatcaaatttaacaaggacagaatagtattgcgtatcaccaatctcaggatggacctcatcgacataagcaacacggagggcatcatttttcttcataagagttaggatatcttcagcacgttgatctttcgcctttttctggtttccatatatttggcaagcgaccacataggtgtacttcatgatagcagcaccatcttcctggcctttaaacaattgacttacagtacttgttcctctctctaacctccttcgaggtcgttgtgataaacccccgttcatgggatatacatcattctcatactgaactgaaccaaaagaagccagctggtttgttccctctgtaatttctacttcagatgcattatcaagaaaagcaagcatcttgagagccctgtagtagtacatcattcccctcacagtccgtgctaaggtctgccccctgtacgaggcccaaagtcggagatcctggaattttccagcccaaatgccatcatcactagccattccttccctttgcatgcgctctaaaaagtttttccaatcatcttcataaatcttttgaagataaaacaagattgagatgccatcttcattctcacgacgaagctggtccttgttgtacagaacatcttcattgtaatatggggttaaaacactgaatgccatcatcctctgaacggtgggagcacgaggcatgttcatgaacagggagttgctgaagaaagttatgcgccgacgagcctcggggttctttggaacatcgtccatagaatccctggatgtgagaatcgtatggagtcttctcacctgcttatagaagctaacatcattgtcatctgggcattttatggcatcctgaaaaagcagctgagattcggttggtcttgatagtgctagcccctctcgcctcagctgttcaaagtccttcttgatttttggaaaatcatgcactgcaagatcatacagatcctgcaaggtacgaactatcttgatctgatccttgtccttcaatagaagctgctccactaaggagattacatacttatgaatttgaggtaataaggttagcctatattcttcagtgaactttccatattccattgcaccatcaaatgcaaggaatagctgattgacaataatgtgttcattagttctctccttgattatttccagcagcaagtgacgtatgctgtcataagcttcaattactgcacatcgcctgtactcgttgttacatatcttgttccaatgtgtcctgtcatcagccaccagctctgctgcctgactgagagcaagaagaagctcattttttagcagcaaacaaggccaccgtaccacacgaattctccacacaactgccggcagctcaagaagcccaagctctttatcactaatgatgtcctcttccctaaatgtttgaatgatctcattccaaaccagtgcaaacctcttagcttccacctcgtttgcttcaatcttcctatatggacggccaaacccatatctcagcttcagccgattgattgcatcatagaacttgctgcggatgccaccatgaacggtatccaggtgctcctctggcattaaattgaactgcattgcacttgcaaagaactggaacctcaagcgcagctgctcaacactgcgaatctcccccagatgcgagaaaaggccgataagcgcccctgttagtgatgagaagactgcataccatatctggatatccatgaggtaaatgataataactgggagccacaggatgattactgcaaggcgctctgtgtgaggcatgaactcaaaccagttacgcttgatgtcatggagtttgaagattacctttgttggccccaccatcggcttaatctggagaaagtagctgaagctaaacttagaaacaaggaggcacacccagaatatggagtacttgatgttatcaatgagaccttccctcagaccacggccaacaaatgtacgtgtttggaaccaccaggtcagcacatatagaattttccaattggttttctccagaaaatttcgaatccaagggatgatgaagagcacaatcgcaagcacttgcgggatgacaaacacagcagctgcctcaaggtaattcagcactctggtattggcagcaaaggaccacctgcgatctcgccaccgctgatcccacattcgcttatagagcacactgaatgtgattgtccaccctgcagcaacaagcaccttgagcaccatccgaacagccactgtttttgtctccctcgacacgagactgtactgagtacccgcatcaagcattgcctgaacaaagcgcagtccaccccaagtgatgaacacagacagcacccggacctggatgtcccggaatctgaggctaacccatggggttttaccatcccatgcaacaatcatcgcagcttgaaagaacagaatatgcatcacccataccctatcgaaacttcggtagacattccagaatgaccgctgctcaacaaagccagtcttgccaatgcgcccagtctttccaggctccacaaagaagctcctcgatggatccagcggccaccggagccgcttgaaaactcgtcggctccagaagtactcgttgacatcgtcgtaattcctccacgccgagtgcggcttggtcccgttccggctggccttcacctcgttcttgaggacgttgtagatcggagtcaccacgcggatgaggaaggcgtcctcgccgcacacggcgggcatcgcaggccgccctgtctcgatgtcgatggactgctcgacgacgtggtggaggtcgagggccatgtagtggaagatgtagcagatgcactcctgcatgaacctcaggttggcggcctccccccagatgagcaggtacagcgccgtgtagaggaggtccatgcggacgtcgttgccggtggcggcgccggtgcggcggccgccgccgccgccgctgggcacgcggaagtggcgcttctggccgaggtaggcgcaccaggaggtgtagttcttgaggagcttcctgcggatgccgcgggcgacggtgaggtggaggacgtcgatggggtggtccttggggaatcccggcgcggcgcggagctgcgcgttggcgaggaggagcaccaggtgctcccgctggttccggacgttgtccgcctggaacccgaaggtggcgccgagccagtcgaagatgtcggcgcggtgcgggtcccagacgcgggccagcggcggcgccgggaagtccgacgcgtgcgacagcgcctccaccgccgcccgcacttccggcacctgcagcgacgggtggtccccgtgcatcaccacgtcctggatcgggatgatgttgtacgccgcctgcaccaccgtctgctcccccgaacccgccgccgccgcggcgcggcggttccgcagcaagctcatctccccgtctcacgcagccagctgcaaaaaaatcactcgacgagtgtgagccctttgaagcgaagaagtacacgggatgatgggaggaacctaggtgggaatcacatgctgcgcagctggtttattcgggctgccgcttttgttcgcttgtttgatttgcttgtctccttcggattaggcggaagcgaggcgtgcgtgatcgcttcaacagtttgcatcatagccgccgcctagtaggcgggtgtgggtttggggctcggtttggttgctttgcttgtggggtttctaaccatgccgctagtgtttctgtgcgctggattttccggtgggggcaaaatgaactaatgatgatggcgatgagaagatgtgactccttttttggaggagggatatgcaatggatttgtgatctactggtaggctacggattactgatgcactgtaagcaaaaaaaaggggaggtcagcaaagcaagtctacaagtgaatgggacagattggtgtaatggtctggagtaaatctcaccatccactcgcactcaggttttgttagcttgtgttgtatggcatctggtgtggtaggaatcgatgaaagaagataaaggtaagaccatactagtatatacaccctataaggctctgttcttttggttgagttgggaacccatccctccggtacggaaaacgaagcagtccattagcacgtgattaattaattatttgctaattttttttcaaaaatggatcaatataatttttttaagcaactttcgtatataaactttttgcaaaaaacacaccgtttaacagtttgaaaagcgtgcgcgcggaaaatgagatgggggagttgggaactccaggaaacgaacagagcctaagtaaagtgctcaagctacggaatttgggtgagagcaaaggtgttgatttgagaaaccaggagtgaattttgtgcagatgagtgtggtctagccttatattcactccattttcaggagatgaaacagaaagtggtcgatgcatgagaaacttttgaattagggagtgacaagagcataacttttaatgttggtggtcatatggcataagggtctctcactttttttaaacatcttttctacatttggaaaccttttcttttgagagagaaacaattggatactattgcttacatgctattcacgtgcgatgtccccctaaaaaactgaaagaactactaggcgtcagatatggataaaataacaggggaaaaaattacagcagttaagtaagtacaagtttcaaagatggtgaatggcgtatcagttcttgaacctcagacgggatcgataccttgaccacactgaataaatgttataaaacggtgattttattcttcttttgctaggagcatcaaatttttatgatgtcactgacagcaactatcatctttctttgaggacttgtcgttgtgacccaggaacacttgtcgtatggcatatttggtgctaaatccttctgtgttacgcctctaagacgcttttttggctaagcttttattgagcttgcactgccagctttcggtgcactagagtaggcactaatcacaaaagagcgacacctcacagcctatttctatcacaccgcaatctgaatctctctggatgtggatggagaattagaaatacggactatggagctcgtaaacggtaaggtctattcattcagaagcgaagataaaaaaaaaaactctatataaaatcggcggtagtaagaaaacaactaccactgggtgttcccggctatttctacccatgatttgaatttgatgaacccctaaacaaaccatatgttgctgccaaagtgccaattatttaagcgaccgcacacgctaaacgctattgctcgcgttttattatctgggttgagaggttgacgccagaagcaaaaaggctcaagcaaagcatgcaggaggagatccaccacactccactgcactgcactctgaataaagaacgggggacacttggtgtgcgggtagccgcacggctcgaggaaatccgccactggaaagtgggaccgggcagtttcgctactgagaccaaggggtttgacccgcgggactgtaacgtgggcccacctgtcaggcgcggcggaaaacggcagagagagagagagagagagagatggcgccggcatattcggggggagggggaggaggaggaacacgtcaatcgccgcagcggcggaggcagctgcgtgaaccgccactggcctcgtcgtcgtcggctcggaatcgaatcgaaatcgtcggttccggtggccgtgggagaggaaatcccctgagccggagaagctcgagctggcgaatctatggcagaggcagcggtgacgagctagcgaaacggagaggggaagggtctcaccggatgggttggccgccgccgccgccgccgccgcggcgtctcagcttggctcagctgctcctcgatctcttcctaaaacctggtcggaattgtaggagaatcgagatgctgagaaacaggaagaacagattcatacagtgagattgctatgcaatactaggtattagtagatatagtaggtagaaagagattaccctttattgagttttcgttcctccctgctcggcctcccaggtgtcagcgcatttgagatggtttcgccgtggaggtggagcacagataccacactcctcttttttctagccaggccgcgctcaggatcgtaggcccgtttattttactcgtgagctcaagttccaactcacacatgcgtcaatccgaattcaaaattctagcccgttcagtgcatatccgcacgcttgctgacgtgtggaaaatgctgtcacgacacccatactcgggtgttctcgtattttttttaagtaaatttcacaaaactacatgttttatggttcaagttgtagaaaaccacacacattttaacacttggcacttaagtatatatattttggtagtttagtttcacaaaaccacactatccatgaatggatttacccgcgagatgacgtggttgttccatctaggatggggacgtggcatcctgttaattttgtctgatggctggtaatataatgccatgtcctcgtcntatgtgnnncaaccacatcatctcgcgagtgaatccattcatcgatagtgtggttttgtgaaactacacgaccaaaatatatgtaattaaatgccaaatatcaaagtgtatgttgttttcttcaacttagaccataaaacatgtagttttataaaatttacttttttttttattagtcacatagtcacgcaacttgattgagcaaagtgaaaactgtaaaagaggaaatacccatatactatcagaaaataccgtctctgcacttctgcaggtaaaagatgctcgatcaagttggaacaatttacatgcaactttaaaaacacaagtagcaactggcaacaatcacctgacatttcacaccgcaaaatgacaatatacctggcaataatttggattagcacagatctgctgaaatggtccaattgcaaagaagttggtggtacacgtgcaggaagtacatgaagattaagatcaatgtataatatgtacatcgtacaaatacgcaacagtcaacagatggcatcacttcaaatcttatttattcaactactacacgatagtaccactctttgcacacgtatgagcgccgtgccgggatggagagaggtccaaacccaacccaggacgaaatcaccacgcacgagggggtgctccggaccctgcttcgttcaaccggtccagcaatgtgttgaaatccatcggctggccactctcggtcatcctctgaataacattcatcacctgctccctgggatatcccatggtgattgccttctcaatcatttccccataaggatggccgcgcatcatctgatgcgaacctgggtgactcataccaacattacctggagctggaggcatctgaggtgcctgggctgctgaaggaccacttggggggtagccatatgcagtgttgtagccatgtgagctgccctgcggcgcatattgtggcgggccggcatagccccccttacttggaggtccgaaagagccctggcttggaggaggtagctgctgcctttgcatgttgtgctgcggtggtggcatgccaggtcctccgtatgaatatggcacttcagaacggctccccgctgccggagcaaccgtgttgtatggtccttgcatagccatgctgccaggtagagtttcagggggagggttcaaggactggtggggttgataatgagggtagtttggtggagtttgaggcctcatctgattttgtacaggaggatgctgttgtggttgcattgcctgaggaggaagctgagtgttagattgctgcggttgcactggtggcggaggaaactgttgagcattaggctgctgcactggttgaggagcaaactgctgagtgttagatagttggggctgctgcattggttgtggaggaaactgctgagtgttagataattggggctgctgcacaggtggaggaaatggctgcgagaaagtcggctgtggctgggccactggtgcaggagccggctgggaagattgctggggccactgctgctggtagggagggaaagactgaggctgggtttgatttgctgcctgagactgttgagatgaagcatggacaggaacatcttgcgttgctgaaggccttactggcaagtactgcacctctggttgtacttgctgcccctgtgtatcctgaatgcctggagcttgacgctgtgggtagtaaacaatggcttggctaagaacataacggtcctgctgtggtacagaagagctaggtggctgctgcactgtctgatctttgtactgttggactggttgagaagctctaggtgcaagggatgagttcacctgatgaggcaaaacaatcgccagctgctgaccaggtgcatctgccttttcttcaagcgtcttttgctcagggaaagatggtgttggcatatcttccttctttttagatgtgtcatgtgtaagttgaaatttggctaattccttctgagtttcagctaactcttgcttgtccctaaggatttgaatagatctgtgcacctgcatcatttgaaaatttgattagagttgaaacttgaaaacttctcaacagagaattaatgctcaaagatataaaatacagtacataaacagtaaagaaattaaacatttggagattgaattgttggttaataataaattgtcacatcttctgaacttggatacggtcatgtgcccatcaacagctctgtgatagccaaaatgttttgcaacgtgcatgtcattttagactgcaggacaatctcgatgaataccaagaatgaactatacttaaatattctgtttgctagaaatactcgaagtttgtggtcaggccttaatctccaaattctaaataagtgtcatcttgaagctcgtggtagcacctaagactccaaatggccattatggctcaacagatgcatgtctggcatggaacatatgagatgatgtatacccttagcatttgtgcactctgaacttataagatgttagaacagatccatcacagggatcacttatttatcaaccacagttgccaatttaaggctgcaggaat

SEQ ID NO: 57739 - DNA, 1095 bp, Oryza sativa
ctggcttgtggcattacccatgggcgagtagtggaagttctgggcctggtcacctgcgaatgccatgacagccattggtggctggcatgaatcccctgctgagcccaatgtgaatgtcaggctgtactctttctgaggggttgtctcgaccattgtgagatgatgccttccttccctgatagaagctcaatggcgcgcttcccttggggaacggtgtattggtcagagtcgacaaagcggacagctcggtttgactcaatcatccagccaggcaaggcagacgtctgctcatcgaggttggttgggagaagcaccccaaagctcgtgtttggaaacatccatggaccctcctcaaagtctccatttgacaccacagtatctgttgaaagaagacaataccaagtgatgacttaagaaccatacaaactagagcacctctagctctcttaagacatcctgtaaggatatacactctaataggtatagagataagcagaactgtcataccctttggtttgtctggagtgaagagcttctttatggcaacgttgtcaaggataggtccacaagtcggatcatcctccataccagggttcctgaactcaaggctcgcctgctcatctgttgcctgaaaagccaatgcatatgcatcccagccttctatgttgtacaatgtctgcaggtccactgtctgtgatgcaccaccgagcacagacacattgagtgactctagctgtgcacacgttcgggcagcactgaacgtgatagcatactctgagcccttctcaacctgcaccacctgccctatacttgcgtcgtttccaagacgtacagcatgatcccctgaaatgaaaatccaaatattaaacatgtcgaatacaaatcagtggtgcaacttgattgatcagaggacagaaggagaaaagctctgtaggataccctgtggaacaataagaatcatgccaccctggtgctggcctgctgagatgagctcgactgtcccattgatcgtccagccagggatcgatgatgcaccttcagcaactgaagcagatttgacaaaaccaccagctggtgctgtctcaaagtcaccat

SEQ ID NO: 57740 - DNA, 12991 bp, Oryza sativa
cctctaattcagtactataggagagaaaacatgtccatgtttttctattgtacatccaatgcatttcattggggcactgcgggtaggccactttactgtgcttcaatgtccttacaaggacagccatgtgactatgcacgacgatattatgtggtgaaagtgaaacatccaccaaccctaccctatccaccatcccaccatggagagcctcatgcagtggtccagactccagagctgcccatgtccggaggaaatcaccacggcccgtagcgtaattctggggaggttaaggtacgaaaaattaaagagacaggcatggaccctcacggccatccttttaataagccatttgacctttttactggacggttcattgaacgcgtttgcaggacactggctcactggtttctgctgctgtgctgttcggcctggatccaagtttactactacgccacatttcattttgactttcatgcaacttcgtccttgcatagaggttcataatacctcctttggacaagataggaaactgaaactctttcagttacaagcctgaagattttctgaatctttcaagtggttttgttagcagcattctgcacccaacagaatgtctctctcatcatacaggacagctcacttgggggtttttagtcattttcaaacataaaattgcatgaatcatagaaaaggaataattttataaaggtatatacatgcagactaaactcaaaggcaagtaaggaagggggatgtgtattaagcaggtataaatatttttatccaattaatgtacttaaaagaagtggttacactggtcactgcaaaaaactacattcccaggaaagctttggcacaagtggcagtataactggtcagtttttggctgttcagacttcagtaacaggacaggtttggataattgggctgtgtctagttcagcgcaaaatttggattttgattgaaattgaagatgatgtgactgaaaagttgggtgtgtatgacaagttgatgtgatggaaaaggactaaagtttggatccaaactttggatctaaacacagccttggtaaatgttatctcagctatcaagggccaaggctccttcctactttctaggacctttactttgcaggtatactgaaccatatgctctacaaaaagagaaaaaaaaataaaggggggggggctatcacactccttcctcacgagtgcaaccacatctcttgattcctagggcacaaagctaacttcttggcatgctttaccacaccattttcctaggggattatttttctcttctcctacccacccttcaaatttctcctcagtgctatgtatatgtgctaatgaactccgcatttgttatacaaatgtgggatgcggagaggtactaaatcgcatgatttctctatttgctgagatctgtgatgcagaaaactacccatccccacaaactccaaccaaatattccacaaatatgtcaaaatactgccttggatcctccagcatcaaaagaacagcagcactactgatcctccagcaagggcaagaaacagaaacgatcgaagagacagcaaagcataccatcctccaccgcagcggccgaggccagatgggagggcgccagcagagcaggcccaggcacagccccagcaatgcgagcctcctcgccgaatctccctccatctcctcctcctagccgcctcgagctctcgcctcctccttcccccctcgccgaggaagaagaacagtggagagagtgagccgaagtgcagtgtgtgtgcagctgaccgagtgagcgagccgagccagtcctactctcactgggctggaggcagctctctgctcacgccctgcttttatgggatggcgattcccttttcctttggcactttgctggccacccccattattctatttttctcgcaggcgtggggtctgaaaggaaaggaaggaggagcagtgaccactggatggtgagaatggcgtcgatggtcaataaaatactctagaggtcaccctgctgccttttgcttttttcgcagcgttttggtagcactttgtcgagcaccaaaaaaaggcgccgctgcccacacgattgtagtacagtagaacttgcatgtgggtctgtttagtttatgctaaaattaaaagtttagttgaaattgaaacgatgtgatgaaaaagtttaaagtttatatgtataaaaaagttttgatgtgataaaaaaatttaaaaaggcctgtgtagtgcagttgcgttttgcccgcagtccctcaccagtcagggaagtcacgaggcaatgtggctgcgaagagcatcagatatttctttttttctaccagtaatatgctcatccgtgaatgtacgacaaacaccgggacaggatagaagcatgctacctctatctcgagatataactatttttagcacagtaatttatcttaaaatgaagccgtttttctacctaccctctcctatcaaccaattataactattctcttcacttactttatctaatccactaattacaaccctccttcaatcatctatacctattccatctgttccaaaatataaatatttatgttcagatttataaccaaaaattattatattttagaaagaaggtagtactttttaatatctgtgtctatcttaaaaatgattatattttaggactccagtgattactgattagcgatgaatgtacaggtacggagccacgggcacacagtgtctgttgtttgagacaagcatcaatggtaaagatagcgccagaatattgtttgtttacatttggtatcaccaatgtatatttacagaccagtaaataaggtagacccaacaaaaataaacatctttaaaagttccataatatctagccacaatgataatataaagtttaacaacaaccagtagcatgaagggagagagtgaagatcaatacatagcaaaaaaaaaaaaacaatgtcttttttatttcttacaaccgggttgtagtgctgagagctatttactgagtccacaatacttactactggtaggaatattaaattattgcttattacctgatttgggagcacaatgtggatgttctttaccaacctgaagagaaattgggtgtgcttaatgtataacagaagttggtcttaaggtgggtcccactataatatattgtcaccttcacaatgtaagagcggttattaaagtgagcccctcatttcaagatagagagcaaagtatgagcggaaagagatgaatgatatatttgtttattcctttatgtctaaaccttatgcacaatgctagctcataaaaatgggcaagctcaagtttgtggtgtggatgtatgttgtaaccttaggagtcggtccatgaataatggatcatagttaaagtaatcatgtctaggatttaaacacaagatgaccacatgagatgaaaaaaagaactgcttcggctcttgtccatcaggtgaataagagagaaatactttctttttgcttgtggtagattttaagcacaagatgcaccttaagttaatgttaatttacatgatgtatgtgattactttttaagtgtaatcattgttttaagatcactttcaaaatatactcctaagggtatcttagaggacttagtactctttctatttttacattgtgccttaatcctaaagcagtttcagagtccattctgttttgtttcctttatatacgcaccgtttctgggtacatatgattgtggagcacaatgaacggaagggaattcggcgacggctcaagtgagattgtacccgcgtatgctctcactttaggtaggtggttgcagacagagcggctcaaaaccatcaacgtctgccaaagtgagacccaattgagtaaacaagtgagcatgccggcgatacgggtttctataatccaaagtgtgttatccactatgctggtcagtggccagtggccactttcttctatgggcttcccggccttactgagaccatgtttgggtcattaagtttctggattaaaattagtatccggacaaaaaaaaatagtccgatccatagactaaaaaaattcaaaaaaatttcaaataagatgtacggtcaaagttgagcacggaaaaccatgactgtacttaaaatgggatggagagagtcccctaatataagtgattttgatttttttacttgcattatttaaccattagtcttattaaaaaaattagaattattatttattttttacttacttttttatccaaagtattttaagcacaatttttcgttttttatatttgcataattttttttaataagatgagtggacaaaaccaaaaaaaaaagatgagtggagaaacagtgtaagtaaaatgttaaaatatcttatattataggatggaggaagtaaaatggactaaaatagagggactaatggattaagacccacgaagcaaacagggtctgaatcttcggattaataaagtactgatcgtgtttgtctttgaggggctcgagcagtcgagtagcgttcacttttgggtgcgcaccatgacacgctgctaaccgacagtgaaattcagatatcgaagtgagggtgtgggacgaccgggcggggtggaacgctgctgcacagtgcacacagacacacacagctacacaccgacacattttctcggcgctcacattttcacagcggtcggtcaaacttggtcagtactacttcgcgtagagaacgcgtcgtcgattccacatttctactctactgagccaggcagatgatgcaaaatgccgtattaaatcaatcgcaagtcagcagatccgagcagtgaagttggtttatttgtgtggaccaacctatgcgtgtacatcatgctgtgcaggatacaagatatcatacactatcgaggatctcaggacacaccgtaggaaaaaaaaacttactcctggttccagtaagggcttattcggatcacgggattgtaaaaacgtaggaataggaaaatcgtaggaatatgataggaatgtatgtgtaaaacagaggattgaaaaacacaggaattctgtagataggattggtaaacatgtgttcggataggcaaagaaaaaacataggaaatggaaaaaatgaggtaggagtggatggaaattttcctttgtttctctattgattccacatgaaaggaatttttcctctgatttttctttgggtcgattcctatgaaccgaatgtcaggaaaggaaatatttcctatctacagtattcccttgaaaatcctacaaaaatccctcaatccgaagaggccctaaaatgagtagacttcacgccaatacaaaatgcaaaagggaactagtgttactcctacttcatgccaaattggcaatacaaattacaaaagtactgcaaaggtccagcagggtgagaatgaaagcgcgtaccgtaataaactgttacggtaaaacccaggcgtgattcgtgaaagcgcgatagacaagacaaagctagccggcagaaattcctggtagccgctaccgatgtgcaacgcatggacaaagatggccatgcgtcgagagttggcgtgtaccccatacccctgtacccatacgggccacacacgtaccacgccatgatacttaccatcgcaggcaggcaggcaggcaggtccactcgtgatctgcgacccgagagaccgagccctgtgcagatccaccgtcgtcatccggtggattttctgcaatgccgcgctctctccgaagttacgacgttacgtagtaccacgacgtaccgcggccgcgataaaggatcgccggctggttgggcggggagcctttacgagtggccgggccgacgcacgttgcggcggtgcacgctaccggagaattcggcgctcgtttgcgtcccaattgatttggtcggttttccctgcaccgtttttctgtcgtggtaggtgcccgtaccaccggcagccggagcccaatctgttccaggatcagatcgatcgagccccgagtcccgactagcgtgcggtgcggaactgctccgttgtaatgcttgctgcctctgaaacgaaacaagaccatcctgaaatgatgtgaaatgccccgtcaccttttgcgccaactttgtaggcctttttttttaggtttttctgtggaaaaggcagggatttctccggttttcccgacacaaaggtttcttcacttgcaagactacctcctgtctacgcaccggttccagcatactgattctgtctgttccatattgctcactagacaacactactatcagtcgagatggcatatgagcttgttaattaagaagtatacttttgccaaagaaacagaacaccggggtatccttcgacaggggaaaaaaaggaaaagcaaaactcaagtggaacatgatgctgcatctctctggtagttgagatttgagagtcgaattagagcagatacaatagcatgctacaaaccagctgcaaacatattttaagtagataaatgaggagagagaagagcagcgggctacagatttataaccagatgtagcacgaactccaagatacagtgtgtgtatgacaggtgggaccatgtattaatagtgtagtatgtaactattgtatgaatgagctattagattggctatagatgaaattggagctagtagttggctatactattgaacttgctcttagaggacatcaagcgtcgccgatggcgcgggcgctgggcgatgccgcgtcggattgcaatagtgcgcggggtggaatttttgcgaaaaagtccttcgcttttggtgtcattcgatacatgtccttcacgaatagtacttcgagaggatgttttatgtggagacccttataaaaatcggatattttcattcaaaggagagaaaaccgtaaatttggactgccctgtaaaatcataagacgaggggcttttttgcaaaatgacacccactaacactaaccaccccaaaccctagccgccgccgtcccctcatccctctcgtctctctctcacctctctcgctgccgccgccttgctccgcctcccgcttgcgctgccgcctctgcctcccgcttgcgctgcctccacctccgccttcccctcgcgctgccgccgccgccgtcgcgtcagcatctccgagagtctccgcctcgcgccgtcgccatcgccgagcacgagctttgaggcgaacatggagaaagtgaggaggcgagcactcctctcctcttctcctctcgtccctcctctgcatgtcgtcaacctgccgccgtcgtcgctgccgtcatcaacttgcctcgggtttcgtatggggaagaaagagggggaaaggggctgccgacggccgtatgggggagaagctccgctgtaggagggttgctagttgacgcgcgcgcgcgccagctgctccccggcccacaaggcccatcggccttttatttattcacgattttttcccttttttttgattttttcttttttctttttttcttttttttctgattacttttttaaaatctttagcacacgtattttttttttcaaaatgttttgagttgaaagtttttaaatcatatcttgaaaattttcaaatctgatttgaaagttttcaaatatcgagttgaaagttttcgaatctgagttgaaatttttcgaatctcgagttgaaagttttcaaatctgatttgaaaatttcaaatctcgacttgaaagttttcgaatctcaagttgaaagttttagaatctgagttgaaagttttcgaatctcgagttgaaagttttcagatctaatttgaaaatttcaaatctcgacttaaaagttttcgaatctcgagttgaaagtttttgaatctgagttgaaagttttcgaatcggaattgaaagtttttaagtcggagttgaaagtttttaaatatgggttgaaagtttacatatatatatggaaaaattcgaaaaaaaaaactaaccccgtcttgagccgtatgggccggcacgtgcgcgccgcacgcgccaattagaatttccgctgctgtaacccgcttcccctcccctcgagcctcgacccttcttctcccactcgtactaatcattcgctgcgagagagagaggaaatcgtgaatttcttcgacttaacgcgacgaaaggaattaaattaccatgactccagtccagagcccacaaacgcgttgtcgcccgcggctacaggcgaaagaaagattgacgcccgttaggcccattagtggctagcgggccgtttaacccttccagaggcctctcactgcggagagtatatagcccgtcttgcaacccacgatgaggactcgagcacgcagtcgcacctcccacccacccgcagccgccggcgagttcgagcggcggccaccgggcgggcggcggggcggcggctcggctcccctgatctccctcccctgcgccgctgcgcggtatggacctccaggatccagccgcggacgccgtcgcggccgagccactcaccgtcgccgagaccgacgaccagccgccgccgccagcgccgcctctggaggcggagggtgttgtcgtcgcggaggaagacccgctgccgcatccgccccttgaggtggtggaggaggatgtggcccccgtcgtcgcagaagccggcgccgctgccgtacctatggagccctccgaggctggcgcgggtggtgtcgtgctcaccgacgagctctgcgaccggatcgtcaaacaggtacaccagtttccggtccttccctctgttggctatcagatgttctgttgtatgctcctgcaaagacgacggattttttgagatgttgtgctatccatacgtcaaacgttccatccttgcaggtggagtactacttcagcgatgagaatcttcctacggatgagttcctgattaaattcgtgaagaagaacaagcaggggtttggtaagtggcatgcttttgcttcatgtagcgaaacctctatatattgtgatgctaagtttagatggtttagtctggtagtttagaaacatatgtatttgagacaggagccatgccaagtgtgtagtatcttttctccccattttgaactgcttgtgatgcgccctattattatttgcctgtattattttgccaccgagataattgtacttaggtttatgacaggtttgcttttcgcataaattgcattctagaagtctagaaatagatgtggtaattggtcagtaatatgtatatgattcaagttctgaaagctcttttatatcccttctctctctcttttattctatcctccgtgagacaaggtgtgactcttctagctcctatgtttctgcattattttgccttgtcgatcatacattagtggaatggaggtgaaaatgatgaaatatgacaggtacttatgagaggcatttacataggtactcctggtgcagctttctttagttgtgccgagaagctagtttaggcctctgtgaatactggtttactgttgtctgattcactccattctgttttgaaattataatcagggggactttttaattaataaaccatgggggctggctatttacttatttttgttgtttctctcttttcatggtttctgtagtcagttagatttcctcacatttagtttgactgtcgggccatgaggatacatgaaacttgatcccattaccgatgttgtctggtattcttccatggtagctgagtcaagctgttgcagtgggaactgatatgctccttactcatctgagctgcccctttttatttgagcttcacaattaaagtaggatggattagttttgaactctttgattgatcatttacagcaatagtttgctgccctcattcatagattgggacaagagctgcaatcgttttgcgagacatggaccttttttttttctttttagcagcctgatgttctgtatgtatcatatgcgctggattttgtacatgcttgggaagtagcttgtaaacaatgatccatgtagcactacttattgcatgacaactcagtggcatggtgtggaattatacttttaccttttgttgattttcaggtattaaattctttctgaatttctaggctgtaactggtatatcataagtgactcgttagatatagggtactcttctgtcatgaatcactaaatatatttacattaggtcgggtgaattaagtgttgcttagcgagtttatagtgctcaagtctatatggattgatgttcattagggttaactttcatcaaatattatgtattatatgaagtaaaatctcaaaggttcttctaattatgtgctatctttggtaatagttcctattggagttattgcctcattcagaagaatgaagaaactcagtcaggatctctctataattgaagctgcacttaggacatcatctaagctggtaatatattgcccatttattatctatgctttggaagtggtgcttttggtcagtgggagatagatatggttgctatgttaatagttataatttaaatgtatatcactatatgctgttattttgttcttaactttcaggtcgtgagtccagatgggaaaagggtcaggaggttacatccattgccaaataatgaattgaatgatgttaaggtcaatttccagcccactccttgctgaaatgcattatttatatgtattgtggaatatctgtgttctaagttttaactttaacttgcacgcagaaaaggatagtcgtggtggaaaatctgccttctgatttctccatggaaagcatacatgcgaaatttgaaacagttgggaagtatgttgtttgcttgtgtttgtgatgctatattgttctgaggacacttaatgattgatgctcataatatattgttttggaactgtactttatcttcatatgtgccagaattgcgaagataaccattcatgatcaacattcagtgggagaatctgcaacaattaagaaccatgacatcatgctaagtaacaaggtgtgtatcagttattactcagcgacattttcttaaaagatcttatagatacccaaactacagcccttttgattttactacctactgattgtagtcataggttcgtaatcgataaaataagtattgtagccatgggttatttctgattgacccgccatacaaactaccactcgttgccagtcactgaatggaaaatatatttgataaatttagtcatctctagttgcttttacgtctcctgaataaaattggatatatcctttccttcacccagtattcaagttggtaataggtcagggttgtgcaggtgcatgctcttgttgaatatgaaacagcagaggcagctgagaaagctgtgagttcccttatctcacatttaatggcccatttgattcccagcgtatgaatacatcttaaagattgttgtttatgtgtgatcaaattaggctatcaccttaaacgatgggagcaattggaggactggaatgaaagtcaggctggctaagcgaaccgtaggatcaggaaagcataaccagtcttcaaaagaaaatcaggccatccagggccagccttcaaaagtagagcagcagatggtatcagaaaagaatggtggtactgattcagtggagagtgctttcgacaatgagaatgtgaactctaatatttcccatgaggtttgatttatttcatacacctattgttttttttcaattatccacttggcacaattatgtttcactttctcttacgtccatcttcaccctttgcattcccttactgaactgcacacatgatacaagcatgaagttcaaatgtattattctatttagttttttttttcatatttagatgctatgatcaggaggttgtgtcattgttctgcaagtgtctttgctcataggtcatttgtgcatatctttaggacatgcaccaacaccaaaaagtaaatgctaaaggaggacgaaaaggtcgatataaatctcaaggaagaggtcagattcagcaaaatacagtgggcaaggtaaactgtttacactattttgaccctactaaatttgtagattatttgggtgatacattttatgccactgagtttcatccaatatccacaatatcagtttgttttgcactgagtgaaatgtttctcagatgaactccatttgcacatacaacttaagttaattcccatgtctgtgcatgatggaggcaggaggcttcatggtcaacatgttactctgcttctttatggaaaaaaactgaacaatatttattatcttaggcaactaataccattgtacacatctcctcacctagttttttgcgcaatgatatccttgttcatttccaaagctaagtctgttttcatcttgatgacagtaggttcaccagacttacattgatgtaactagtttttttttccctacgggtatcttttaacaagagctgaagaattcaatcctgcagttcttgctgtaaacacttgatattccaaatgaacacgcagaaggaaatcaagatcatttgtagttctctagttttgtactaatgaaaaatcaaatacctgtgattatttctccacatatgtattttttaactctatctggaatatgcatactgatgatttttcatatcaggccatgtctcatcccctgccacttctggttctgatcatgtgaacaagcctattcctggaccgagaatgccggatgggacaaggggctttacaatggggcgtggtaaatctcctacattccagaaaggggataatgctgaagaatagtgcttttgtcccaaaaagcctggtaacaatctaaccgcgtgaaaaacataattctgctgttatgctataagctgtcttgcttcgtgtaagaacgtagggacatgtcactgatatagaaaaggctcttattttttatgtagtgtctttctgaattaactggtgctttagtaggtctggtaaaaatttaacctcatgaaaaacatagtactgctgttatg

SEQ ID NO: 57741 - DNA, 17780 bp, Oryza sativa
  unsure (1)..(17780): unsure at all n locations
ttcctgcagccctattttgtgaattcaattttcgaaattacttcagctgactagtaaggttttaccgccaattgtgaagccgttgttccgtcattatttctgatgttctaggttttggctaccatcttgtcctgattaatacgaaaactggatagaatattagagcaagaaatagatgcttgaagtgtatgtttaaactatttaggatgcacaaagggtaaacaataaacagatcgagatccgaaacctttcagtggacttgaggcttgatttttggagcatactgtgcaccgtgttgatatctcctggtgaatgttcctctgaactctgaagtgaggagccagtagttacagtctagcttgtatatgtaaggttaatcggctgccgaacaggcagaaaactaaacagtcagcgcttgttcagttgatccctctcccatggggattgaaggaattaatctctcagttctcttcaatcccctttctcacggagattaaccgagcaagtccttatgggggctgtagtaccatatcttcgaagtcttggtctccagtctccagtctccagtcaattgagctgtgctgtcccggtccagtggtgctgtgctgttacttttaataggtgcattgctgtgggaatttattataaaaacaataaaaaaaataacatgtaagatagctagataacatcagattaagtaaattaatacggtttatgataatttagatttaaatagtatgtagaatggtgattcaaacgtaaaaagtaaggtggtataactttatggaagaagaaaaatagggagatagtttggactatagattaatcatctaaaagctaaaaacaattgatgtgatatgacttaattagaggaaaaaagagaaagataatttgcaccatagattaatcatttaagcactaagtgaggatgaactatatatttatataggatattataaaacataataaaaatatacattgaaacattatgtgaattatgttggatgataatttaacatgtttgtatttgaaaagctcttaaattataaaaactataaagatatagcatgttttcatgatgtttaaatgtgatgatgttagtggatgatgagtaacatcttgttaattagtggatgatgatgtggcatcttgttagtggatgatgatatggtatctttgcatgttaagtttaaggtattagtggggataactttatagtaagataggatgtgttaaggaatcatctagggacatgtgcctatccgacaagtgaatggagctcccgagggtgtgtttagtttgcgaaaagaaaatttttgggtgttgcatcgaacgtttgatcggatgtcagaagaggtttttggacacgaatgaaaaaactattttcataactcgtctggaaaccacgagacaatttattaagcctaattaatctgttattagtacatctaggttactgtagtacttatagctaattatggactaattaggcttaaaagattcgtctcgcgacttgaatgcaaaatgtgtaattagttttttatctgtatttaatgctctatgtatgtgtcaaagattcgatgtgatgttttggggcaaaaattctaggaactaaacataccctgagtaagaatgaacaggtcagatccgctgaaacaagcctcattttcatgaccagactagtgtcgcagcgattttactgcgatctgtcaccaacttaatacgatgttggatctcggttcctattcagaattgggattccatgagggccactcaggcaggaacaaagcacttgtgatgcctgcgcgcaggcaggagcagaagcaggaccaatccactcattggttccgcagcggcgtagccatgcgctccaaccatgtgacaacgacacgaggcgtcgcgggcggcatgcatgcgtgttcggttcatggccagaggaaaccaagccggtctctcggatacgtatccggccgaaagagtcggccaaagcccgtggtttggctacggcgctgcgccatctcacgcacatcgtgcagaacggtgggcgaatcgtggcggcacggatgcccgggcgccgttcgcctcgcctggtttacgaagcagtgaccggcatgcagatgaaaggggccctgccggctgcgtgctggcggcggcgatcgaacctgaggttttttgcccaagcggaccgtatccaaaccgccgtcacgcgggcaaggcccaagcaagccatgtgctccaccaggccatattcctctggtgacggcaacctcgctgcgtaggccggtaggcgtagatatgccgatcgactaccgtgcaactgtcgccggcgagttggcgaggtagggctgtacttacggtgaagtaacgtacactggtcggatcgtgtccccatataacaggagattgcagcctgctctctgcaatctacagtttctcgtctgcactcctgttggaaggtacttaagagcaatgctacacgtactatatttttcttactaaacttttactaacaataatctcaaccgtttgatttaagtagatggaagttaaaaaaatctagatgcactcatagcatgacacatcagtgttagtaagaatttagtaagaaaaagtcagtatgtatagcttttataggtgtaaagttttagcgtgtcagatcagatatacggacaccacctaattacagaatccgttaataaactgcgaaacgaatttattaagtctaattaatccatcattagcaaatgtttactgtagcaccacattatcaaatcatagagcaattaggctcaaaagatgtctcgcaaattagtcacaatctgtgtaattagttatttttagcatacatttaatacttcatacaggtgtttaaacgcttgatgtgactgggtgtaaaatttttgtgtgggatctaaatagggccacaatctctcccttcctggctcctaagctaggtgtaattttacgttgctcttcgaaatagcgggcatttgatagcagagaggttgagaatggaaagagcggagtcaaagaggcaccatgatactactctctccgtttttatgtttttggtttgtgctaggttaaatattttcaaatttaactagatttatataaaaaatataacaatatttttaacatcaaacaattattactctcaccatcttcgagtttgaccaaatttaaaaaataacgtagcaatatttataaatattaaatatatactataaaagtatatttaatggtggatttaataaaattaatttgatattataaatgttgctacattcttttacgtgattcataaatataaataagtttaacttagaataaaatcaaaatatcttgaaacttaaacggaaggaacacaagtgaggaggatgagaggtgagaatatgttgtttgagaaatggtatatgtatatatgtatcacaagtacccccgtctcataagatattaaattactataaatctgaacatacgagtatcttatatttgtatctatcttttttttatagagtagtacgtttgatcaagagtgaccatacagtttgactgaaattcccttaagagttttcatttgactagtgtacagacagtccaataaaaatatagttttataccgcttacactgccgtccaaaaatatagttttgactagtatacgcagccagcagagaataccgtcacatgccatgctcaggttgacccagctgttgtcagtgtgtcctatggtggactggtcgctggaagtgtggagcatatagactgttccctcttttttaccatcggttttgctaccgttccacttccacctcctcctccttttttcttttacagaacaaaatcaggcacaccgcacacgagatactacaaatatatcctcaggggtgtcgtaggtgctgagaaaagcggcgccactggacactggagtgagttggagtctcgtgcagaggctatgcacctgtgcggccggctgtgcgatggatatggaccgaatctcgtcacgacgtcttcaagggctgcacccaagcgtcgctagcttggctttgccacacacattagtgttgaacaggcaggccttcggagctagcaggcacctaccgcgtaccgcgtccccttatctgctttggacgctgctactgcacaaacttggtgagaggaacgtctcgtcaattcgtcatagtggtaccatgtttaatttgtgccacacagtaattcatatttttgctctattcccgtcactgcatccgttctactaatagtactcctactcactacatccgttataccgttccaataataagattgctcatttcaagatttattgtattagattatatcaaatacaatattaagttggtttttattagaacggagggagtactaagtagcactcctacagttctacttcttttgttaaaaaaaactcaatctaagtatttaattggatataggttcattgtactaactaataagggtgtgtttagttcacgctaaaattagaagttcggttgaaattggaacggtgtgacggaaaagttgaaagtttgtatgtgtaggaaagtttgtttgtgtgtgtagaaaagttttgatgtgatagaaaagttgaaagtttaaagaaaaagtctgtaactaaactcggcctaagtctaatccaatactatatatgttggacttttttaaggagccagtatatgctaatttgattgttcatggtgacagctggagcactgggtgaaatgattatatcgagggtttgctcgcgcgaaaagcaatccacaattcgatcggggcaaagcggcagcactaacccatcaatgctcgcgagtggcgtccgccccacatgccgcttaggtgcgagaccggcccgnngtcactcggccagtcggctcnncctgtagagatggtaccgtgccacgacgtcgtcccgtcccacctcgcgtcgctactaaagctcgcgcgccctctcctcatcgatcattcgccatgatcacagccacgtacacaacaaacgcggctcagtcctcacgcacagttaaatcttgatcagcgtatcaatcgcagtatccagctcccatggatagcatccacgaggagcagcggccgcggcggcggcagcagcagcagcaagaaggaggaggagaagaaacggcgtggaggtgccggagatggacggcgagctgctcgtcgagctcctggaagcgtccctcgctgcggaggaggatgaggaggctgtagcgcagaggaagcagcagctgggcttcttcacggccgacgtcggcgacggctgggacgggcaggagctgatgaactccatccacccgcaccaggaagaagaaggctgcgaggactgcggcctcgacgacatcctctccgacttcgacggcggcgggtacccgccggcgtcgtcgccaccgtacctctccgagttctggatggaggagatggaccacgccaccgcgggcccgttcgctgtcgccggcgagtgcccgggggaggagtggtacatggacggcatggccatggagtgggaggacgggaggagctactactcgttccactacccgtcctacggcgccgacgcctcctgcacggatcaactgtacagtagcccgttgtgggagtgatcagtgaactccggctagctagtagcccctacgttacgcgttagcgattagtgcatggccttcgcttagactccaagtgactagtaccaccaccaggttccagtttggtagtttgatctgcgttttttgcctcagttttgcaaatttagcgcgctctgaatttgctggagagagcatgagtccatgagtttttttttgtgttatggtttttaccgggcaattcatgccctgttttttaggagtactttcgcacggtcgtcgcgagtgttggtgtatataggtgtgttgagctttgaacaagtgatgtttggcagtttgggtgttgatgttcctgtgccgatgcctcagtctgttagttaaagttggtaatctgtctagcacttcctctggtctaaaaaagcaagtcagttttaaatacgtgcagtcagcacgagttaaatttgattataaaaacatgtgaagtatatgttttgggtataggaaaatgatatattctacacctatgtaacttttgaagtccttttaaaatttatgctaatagtaaaagttgtataattttgttttaaaagatccaaaacgactcgttatttaagaccggagggagtagttcccatcggaaatatgaagattaggcagaagaactataatgcgggaaagtttttttttcttttcttgatacatttatatgtgaagaacatctatagtgtagtttctattaatttcaatctagaaattgtacatcaaaaatttcagagtactatctccttggataatgtacagagtcctgaggctcttcggccatctggcttcgaagatattacacggagatttcagatttctataaagcgaagcgcatcagctcactagtcaccgttcacactgtcacagtttgttggaacaaaaaaagatcgctttgtgaaaagcgtagtataatacacgtacaacgagaaaacttagggcatgcaaaacgagaaaaccattagcgtatgattaattgaattataattattacaaacttgaaaaataagtttatttgatattttaaagcaacttctatagatgaacacacattttaaaattcaagggcctgttcaaattgtagccaaaataaatattaccaagttttggtaaatgctaaaattttggcaagatggcaatattggcaggatttcttatgtattgaccaaatttagcatcaaactaagcgtagacattttttttggcaatttaccaaaaatggtatggttgaaaatggtatcaaagtgaacaggccccaactctcttcaaatatttaactaatgactattttattataattaaattttatttgatgaaaataatattatttgattgtcattttatatgattatgatgtcattgctacaaaattgtaatacttgagaaatttgaagtcagtgatcagttttgaaaattgtgctatgttttccacgtctgagtgagtaggatggaggaagtggaaagtttttttttcacgaaacataccgtttatcaatcttaaaaaacgtgcaaacgaaaattgaggaaaaatcagtatcttgagacaagaacaccacatgtagcatggttaatcatcgctgatccagatccatatactgcaaattctgaataatgcagatgttgtattgcacgctgtgcgacttgtccttgaaactggagcagtaacggtgttccacgataacgatatgctgcgcaggtttttcgcctccggtggtttctttcaccgagaagcgggaaccaaatcatgcacaagaggtcaggtgccgtcagcctgtaacaggctaggacagcctgaagccattgtcgtcgtagtaggttcatttcttcaaatgttcagcaatttaatttcagttctgttcaaccgtcacattacagatattcacgagcgatcatctacaggtgaagcactgctttcaaaaatcacagttaatcttattgcagttcacattttcttattgacatctcccacaattcccattgtaaaccagaactccaatcaacatccgaatcaagaatacacaagtcaatgtaaaagaataaaaaaacaaaaagaagaagaagaagaaaacatccacaggttcatgatgcaatgttccctccaaagttaatgctaaggcagactgcacaggggacagtaggcaaattgatcagctagctcatgagctccttctctgctcgcacaggcggcgggccgccatggacatgtgcgtggtcagcggccagaccaccggacaacttggtgttctgctgctggtatacctgcctcagcctctcgatctccttcctcaacgcctcctgatgagctgcacatgcaggctattgattaattctcatgagtggtttcttttttcagataatggaaagtaaagagatgctccttcaggcatgatgggaagcagcagcaacagaaaatgcagcatgttgcagagaagtaaaaaattttactacaaatttaactcaccatccttgaaaatcttgtcctgtgctagagccgcgatccgctgcttgaggtggctgttgccgacggtcaggatcgtccgctgctgatccagaaacgccacccgaggggacagcacggatacctcgttctgcaaaacatatcacattttacacaaaaccaaaatggcgatgtttaatttgggaataaaccaaactgatgcctgcttgtcaaagaagatctagccgtagtggtcagacactaatggcaccctgaattaccctgcatctagcttgttcggatacgctactgatacacatttgatttgtaactgtctcgaccgatccctccatgtgcacccacgatcagagcgctctatatgacccaacgtactgtgcacacaaacggagcatgttacatggagtacactacacaacagttgttaaatgctagtactactacttgcacaaacagtagtactaccacacatttcttaatagggcactaatttaatcagatgtcgcgcaagcaagctaagctagctaggaaagggaccacgcacaacacaccactgcccactggccaatccatccatgcagaagcagaaccatgtgcgtctggatcatggcatgacatgccattgccactacgtctacgtgggctggttggtgccgtacggggggtgaggtgaagtaagacatccgcaggcgtgcatatgcacgagggtgggggctcacgctctcgctcatctcctcgccacattgtgtgctattgccagccaaccagtgtggctgtgtccatcggtcggtctcaaactggcgccacttctgtccgtgaaactcatcgacgggtcgcttactacatcgcacagaatgcagattgcacagccacgaacggttgatctgacgtgagtttgtagagttgaggtagggtgttcggtttcctagctaggattcagaattgtgccgcgtttcgaaacgagcgtcaactcggcttgctagagctcgaagagcggattggtatagggtgtgataactagttttgagtttggtgttgtcgtcgttgatatgttcgtattgcacgtatatgtatgtatacctgcagggttgtgacgctgcgctcgagctcggagatgtactgaagcttcctcactcgcgacctctgggccgactgccgattagccagtatcctgaagacatttccaaagaagagaacacggtaattaatcgaggaatttatagtgtcgtaaagtgatttgtaattgatcactagatgcatgcatggacgcagtgcccaaccgggcgcgttcgctcgcttacctcttgaccctcttggggtcccggatcagctccgtcggcgaggtggccgccgcctgctcctgcgtcggctccccggcggcgtgctgcccgtcgtcgctctgcgccgcggcgtgcttgtcgccgccgccgtcgctgtcgctgccgccgttgtcggaccccggggccgacgacccgccctcgtcggggaacatagacatgagctggtcgtcgtcgagcctgtcgaactcgccgcccgccccgcaccccgccggcgccacctcgacgaacgccacggagtcgctcagcgaccggcggtgcgcgccccgccgcgacgccgcgaactcggcgaactcatccgcccacgccgcgtcgccggcgcccccggccgaggcccagtgctggtggtgccccggcgccgccaccgggatcttgggcgggagctgcgccatgtacgtgtccttagcctatagtagcgatcgatctcgcgagcttgggctaaccacctagctctggcgcgcgcgttggacggcgccgcaacatggatctgccggtttttgttttatactagcatgctagtactactacagtatgctagctgcaaagcgctatagccaccacgccaccttgttactacgacggagggaattggagggtcacatgggacgagacttttggaacatgacgacagcctgagccagctagcagcagctctcgttaattaggcttcttcgaacgcgactcgatcgatcgatgtcgatccatccccgtccatggatggatgcatccatcggtttgcatgcggcgcccgcgcgggaacaaagttggtggagggggatcaacggtttttaaggcagttaagtaggtgggcaggaatccccccatccacgtgccgctgtcgatccatccatccaaccggccggccgcggatctctcctcctctcgtcgtcgtcatcatcatcatcgaccgatcggctatcatcaacaagttgcagctcgatcgagcgatcgcgtacagtgacaggcttcaattagccctcgttgtcaccccgggatggaccggtagtatggccggttgcgtgcgcgtcgatcgatcgtcattcggcgcgcgacagactgcgatggccggtgccctcgaaagcaagcagtcgagcgcggtgccggtcacctcggttcgttcggttataccgatcgcgcgcctgagacgagcacgaaattttgtgggagatcgatggttggaggcgcgcggcatgccgtcattgcatctgagtttgtgctgcggcgcagtgactagaatatgcatcgcgtgtcagactgtgtcaaagatagaatatactgtcaggatcgcgtgcgtttcaccggggaaatagtaacagctgccgcgtatcgggagcagcatgttcgcaaatccattgggatcagagatctcaccgcgcttttgcttgcttccacaatactactactgtacacgggaatcttccgcaacttggatcccgttaagcacacgcttttctcacggcctctgtacggacgacgtgttggatcggttctctccgttaatcttgcaaacgaaaagcaactcgttttgcccaatgaaggctcagcaatcaacacaagaaacgcacttttgccaactccaaggcccaaacaccacggcaaaagcttcatcaactaggcctgatattctattgggctgggtttagcagtaaggatggcctgatacagtacgattggactgccgaaaaagctaatgcgcgcgtgccggcggcgcgcgtcctctgaccttttttttcttttttttttccgattttttcgtttttttcacactttttttctgattattttttaaatcttttagcatattttgagtttgaaagtttttaaattttgagttgaaaattttcaaatctgaacttgaaagtttttaaatctcgatttgaaaattttcgaatctcgatttgaaagttttcgaatcttgagttgaaagttttcaaatctcaaattgaaagttttcaaaattttcaaatctggacttgaaagttttcgaatctcgattctcgagttgaaagtttcgattctgagttgaaagttttcaaatctcgagttgaaagttttcaaatttgagttgaaagtttttaaaatttgactttaaaatttaaaacttaaatcgaaagttttcaaatctaacttaaaatttttttaatctgttagtaaaaaaatctcccaaaaaatctccagaatctttcctaattactatcattagtgttaagtatattaactaatataagtagttaagactaaagagaacagggagtgctcgccagctggctttcctggcgcgcacgcgcgtgctagccacccccttggactgccttgtattcttatgtgctttcccaatggaaaaagtacatcgaaggtccctcaacttgtaattgatttataaaattgtccctcaaccgtaaaaccagatatatgacatctcccaacttacaaaaccgttcactttagatccttcggtagattttgttagagaatattatctcctggggagataaggtcctttcccgtggaccaatccgaaccggagtagagataatatctatcttctcctaagacccctatatataggggcagggtgtaacatctaaggttgcttacacttcagatcagatctataatgaagagagagctccaccatatatctgtgttcattgtctacttctgcaatgttcttgagggcaaaggaatgggcgcgggtgttttacatcatctcacgcctctattgctgtgggagggacagggaacgaatccgatgatccgctaataggcgcgttggtttacaacacgttatcagcagctctccgttcaccggtttgtcgttccaatctgttctcgttattagattgatttctaaattacagattgatgtgctggtatttcttgctctcatgtcccgacgatctagcgaggcttgcgatgcaactcgccgggaagctacggcgcggctacgcataggcgtcgatgagaccgccgtcggccacgcgaacgccagcgtttcgctcgtgtacgaaagcttctggagatcggcgtgccggcgaaccactgcagtgcgatccatcgcctagccagcggctgcatgcctgcatgcatcacgaggggaagcgccaccaaggctggccgcctcacacaccctcaacgggccggcgtggagccgccgcgcatgcgcgcgcgactcgtgctcccgcatggcgtcgccgcgtcggtcgcaccgcaggccacggagatcacggctccacgggcgtacaatgctggctgccgactcagtagtcggcctgatcttgctcctctctctctctctcgctcacttctctgcgcaggttggcgggtggagagaaggcctgcggggcgaggcgggagagaaggagggcgtcggtggctggcgacgcggccacaggccaccacgcggagtgaggaggccggcggggcccatgttcatctcgtcgaggatcttgtcgccgtgctcgaccagcttgttggagtaccacgtgaggaagaacctccccgcctcggtgaggtacgtgccgccgtccgcggtgaagaaaaacgtgtcctccggcgtgtcgttgtactctccggcggcggcgtccggtagctcccacttcgggtgcccggcttctgtcgccgccactctgaagttctcctcgaggtatttgtccgatgtcagggaattcccaaccttggctctccgggtaggattggtatcttagctcacttgcagggccaagcccaacctcttatgtccacaatcaggccagagtccaagaagccggccatgttctctctgaatcgcttcatgaaatcggcatacaactagtgtcgcagataaacaatctatcaagtcgattagattatcctaaatttgatcatggttgtgatatgtaaatttgcaatctcaatgtcagtatgtcacaaattatgaaatcggtgtacctggatgggagttctgccgtggaacagaggccggtcatccacgccgatggtgaggtactcctggttcctcgcgccgccagggctcgtgtagtgcacgtcggagtcgtcgtcgccgacgtcgcggactcaacgaggcagcgggatgcatggctccctgtacacgcgccactcgtaccgcgccggcccggcgcccttgacgatgccccactacacgtccgccatgacaccgtcgacaccggcctcccgccgcagccgcgtcctctagctcgttctccgcggtgaccacgcgcaactgcacgtctgcacgccacgccacggcgcagcgccgctcgacacgatcaattcgaacgaaagcttggagagattgcgtgagctcggagcttaccgtcagcaggcctcctccccacccggtgcggtggcctgctgccgcgtcgccgcccgtcgccggccactgatgtcctcctcctctcccgcatcaccccgccggccttctccccacccgccggccagccgccagcctgcacacagaagtgagagaaagaaaggatgaagggagagaagaggggtaagaaacaagggctgacatggacactcgacatgtggctcccacgctgactcagccgtcacatcagataaaaccggggtcaaaaccactgaaggatctaaagtgaacggttttgtaagttgagggatgtcatatatctggtttgcggttggaggacgattttgtaactcgatggcaagttgaggaaccttcggtgtactttttcctttcccaatttatctccaacttttcacatacacgtttcctaaactgctaagcggtgtgtcttctgtaaaagttttctataggaaagttgcttttaaaaaaaacgttcttggcttgatcaaccggtatgatcgcgaacagacttttgatatgcttgtaagttgagtatgtgttgctatttctcaacggcatcagtagaaatataattcccagtaatggcgtataaacactcttggtatattatggttgcagacttcatccgtaagcgcacggatataccattgtagcatttcaccggagagtattccaagggtatcgtatttatttaatcccatggaaagattatattagagagaactatactaataatttatatattacatgtaataatcaaagtttaagcaggggttaagattattaatagggtagaatgacacacagaaagagaattatatactctcattataatttatctaagctaagtgggaagaaaatagaaataatctattcctatacttctaatatacatgcatattatacatacatccaagatatatgattactttgctaataccctctttccaatgcactcctggtgcttcgagaagccacccctgattaacgagtttcttacgacaatccatcatgaccatccaaccggggctaaatatggagaagtaccctccccagaaaagtaacttaggattatatacacgcgcggaggaataccagtgctaagctgtcaccatcagcggcccacctcgacgtatccgcagcatataaccacaaataatgatatccaataatctaaacaccacgcttaaattaccaaatactactctaatatcatcgtcatgacatagagcaatcgtatgcacgatcattatacccacaccattgcattttccagataagctagcatcataatcaatatagtttgaatgtatgataaagttggtactcatatactcggaaagtagtacaataccagagtagtatctctactacttaaaaagtccgtagtggtggtggtgaggccattccaggcagacacgcggaatatgaaccattcgatcgtcaaatccatcggttcagaataggcagatgcgcttctctccgcatccttatcgagcgacgcctcccatcgcgacacaactcccctctcctttttctccgcctctgccgcccactccacccagcgccgcttgacgccaacgctcgtcgcccgaactagccgccaacccccgtcctcggcgctactccaccgcgcatcgcctgccgccgacgaccgtcgccatcgcgccctaccatcggcgaccgccctgccccacctgtagtagaatccctgcctcctccgcctgtcaccctcgtgcccggccgcctgtcgcatccgcccgtcaccctcacgcctagggggctactccgccccgcatcgcttgccaccgttgcccgcgcccagccatcggctgccgcctccgcttgtcgccctcgagccctgccaccggcggccgcaaatacctgcccccagcctctcctcatcttctggatttttttcgtcgcggccgccgccatgcagatcaatcgatccacccgctgttcggtctccctcacaccatcatgcattcacgcctcctcgtcctcacgattcacacctcctcttgatgctgcagccgccggattcgggagctacaatgcgagagagagcttgattcttcttgcttgaggtgtgtgttggagggagtgagctgagggctttatatagcttgagaataacggttacgacggttggaaaggttggtaataccctccaaccgtcattagggagtcatctcaaccgtctagccaaaacctggatccaacggagccacggctggttcgattgaaccctgggctgacccaaccagccgacggtttgacaggcctcctctttgtcctctcctatcttcagacttgtgaattttggccatttttagtcatgtcaattctgtgttcttgatccatttgttcataagtctgatctttgacagcgtccgtgattaatcgtccattttattgtcgaatcgcctctattttatgtttattatatgcaaaaggttaggaagcctagtgctagtggaatatatcttattttgacacaatatgcattgcaagcataacttatttctcctttatttttggtaatattgatgggcgaaactgatcgataacgaccgtcaacaaaaccccccaagcttgaacttttgcttgtcccgagtgaaggactcacaagaataaaaacttggttgctgatcaggagttgcttccacgctgtatatctcaaatgtacaggtgcagggtatgtatactatctctcaaatcaaataaatttggcgcggtggcttactcttacccctgattcccacgagacattacccttccttgtcttgagaagttgagagacattacaacaataagagcactagtcacccaatcttcacttaactttggatgtgtttccttgaaatttttttcatggcagcatggcatatttggaagcaaaggaatggattaatctttcaaactgtttagccatcaattcagtcatggaaatctatgtttgttaaagaagttcttctgcatatgtgcagaatgaaagatccactcaagcattccctttctaattggatacaaactttgtagcatatttgttttgctttccctttgtatctttgtacatatttatattttataaaatttaaactgctgggcaaagccctagcagtactttcagtcaaaaaaaaactttggatgtgtatagttcatgccaaaattagaagtttggttgaaattagaatgatgtgacagaaaagttgaacgtttatgtctgtacgaaagttttaggccgagttaagatccaaagtttttcttcaaacttctaacttttccatcacatcaaaattttcttacacacataaacttccaacttttccatcacatcgttccaatttcaaccaaacttctaattttgacgtgaactaaacacacccttgatgtgatggaaaagttgaaagtttaaagaaaaattttggaactaaattcggcctttatatgcaaatgataattactgtgctttggaatgggggttataagtaaatgttcttcctagaaacctacttgctccatcgaaaaaagacaaacatgggattccgtgttcaacgtttgaccatccgtcttatttaaaaaaattataaaaataattaaaaagacaagttacgtataaaatattaatcatattttatcatctaacaataatgaaaatattaattataaaaataatttcatataagacgtacagtcaaacgttggacattgaaatagaaattcaggatttttttttttttttttactacttgtactgacacttttgatactgatagcgtgtaatgtactccaggtctccatgtgtgtgggcccggtcaattgcaccttcgtctcttcggcttccatcttcgtacttcatctgatcatctccttttcccatcagaattcagaagcctttcgcacctcgccacgcaccagtgtgctctcacgcgggtgtactcgccgacttcctgggcgccacagacggagtcgcccacacaccaggcgcacacagcatcacga

SEQ ID NO: 57742 - DNA, 11525 bp, Oryza sativa
caagcgggggcggggcggcgccggcgccggcgcggcggcggtgctcggggcgctcgggctcgggggcttcgcggggcttcgaccttccaccgcgcggcgcccgcgggcgaggccgagctcgagcagctcgccgcggcgtacgaccgcgcctcgggccgcatttccgtctccatccgcggcgcgggcgtctccgcctcgcccgcggacctcgcggccgccctcgggctgccgctcggcccggccgcgctgggccccgaggtggacgcgtccgtgttccgctccgaggaggcgatcgccgccgcgagggggttcctccgcgatcgcgtgctgctgggaggcggtggtggtggtggccgggagttgccgggggaggctgcggtggcgctgcggctggtggaggaggggaaggcttacgcggtggattggtgccggttgttttgggagttgctgaagatggatttggtgagcgggaagccacggcgctacgcgccgcacctcctccgtctgatcgagtaccaaaggcccgagcttttcgccgaggttgatgggagttcgcctcttgggaaaagaaggaaaagcgcggcgttttcgcggcaatgccagtgggaagatgaaaaggagacggacttgattgacgcagagtgtggagattctcgtacccaggcggctgaagcagaggtggagaggagcagccagagcattggagacttggaggagatgccagttttggagagcgcaagcaattcaatgctgttgatcttgtgggttacaaaagttcaattgttggattgggggaatggatccatggagtgaacgagggaaatgcggagcttggatctcagaaaagcttgccttcagaaatcgaggtttcgggctgtgagatgggaggtaatgctgctgctggtttgaccgccaaagatcagagctcgaatgattcgtctctccttagccttcttcgcacaatggatgagcaagatgactcctcaagccatcagaatgtgatctccggggccaagccccaaccagggccaaatcagcagagcataattgagatcgaagatgaagaggatgacgatgatgatcaggtgggtgttggtcatgtccctcccaacattcaaaatggacattttggcctcaacaatattttgtgcaacagagggcaacagaaggctttcaaaatgatcaaacgcttccatctttccttgcctgcacacagcaaattaaagcttgcatggatgacaacttcttggataagatgaaggctctcatggatgctcgagctgctaaccagcgcatgattaacatgataacacaaaaggattatatgattgcagccaccaagagggacatactggaggatcttggagcaaggcacgttatgatcagtcaattcgaacatgacattgaattgatgcgtctcaccattcaacaataccgaaagttgtttgagaacacttctgctgcatatctagagtataggaacaggatgtcacgtgaggagggtgatggttcatctctggaagttattggcatagctgatgagacggagcaatttgttaggatgcagcaactggacatttatcagaggcttaataagtttcaaaagctttggctcacgaaatattcagatcttgttgggcatttgacaagagtagcagaatgcatgacatacctcagtaatggactgcaaagactgaaagattcaacaacaattcccgaccttaacaatggcaagcctcaactatgaattatgtcttcatatttccattatcctaaaaactttagtaaaccaactcatttttgttctacccgcaggcttggaaggcgaagaattgggcaaagaattgctgagtaagacaaaagatgcagagcgggaaggtgaaggggatcattgcagtagcgctgtagtggtgagtttaggtcttgtgctgctgaattttaaagtacattgaacgattgctgtttgagcaatttgtttagccaacgcaacaaatatttgccacgacttggaaatttgccataaaattgcttgctacttccatcaaaagtagatggccctgaggttttttatccaatatgacactctagctaattgcactgaagcttcgaagcccaattactatcaaccccctcgtttagcctcagcttataagcataagcgcagatttaaattttaaaacttaattttagagttgattttagggttttccgtataaattatttttaatggctaataagccatttcgctaatattaagttagtataagccaaacgtgtgtttcgtatctttcttcagtttttctttggcacaatgccggagcataacatgtcatgatgctacggtgctggaaggaaagcagacatattcagatcctgacattgcacttactttgcagatagatgaattagcacaacctgatcagaggaatgataaggagagcatgattgtcaatggagtttctggaatctgcaacgaagatgaggtgtagcttcacagggcacaagttagacaagaatgttctgttgatgggtttaacctagagtcagttaattgtctagggtttggtcatgtgggcctcaacagttgccctaattaattactatgttaaaatggtttagccgtggatattggatggtactgtgactatggtcaacaactttgtgcatgaatgacttctggcaccttgctatttttatctgtttcgagtcctatggacaagttcctctgcatgctggataaacacgcacgccgttgatttttctgtccctaggaatcactgtgggatctcttcgaaacctcataaacagtcactcttgtcttgctcggtgattcctttataagatattttctcttaggctattcacagtgtaagcaccggtggtagggtcttagtccaaaaaattagcctaaagacaccattccccacggtacaaggatcctattttacgtgacctagttggatttagacactgtacaaggaaaccggcacccacaacgctcgtgacctggtggagggtagcgaggggaccgaaggaaattaatttcctctcctacccccgtcttctcctctctttctcctcctccttcgtcttcttcgctgcctcctcccactccgcctcagcgcctccttctcctctcccacgccgcctcctcctatcgtcccaagcagtagttggcggcgtggtcttccagagttgcggcggtcgtcggtggcgacttcggtggtcttccggaggctcgccggcacctcctctccctcgatcttggcggcggctcgccggtgcgcgagcggccgccggttcttggcggcgcagggacgccggtgcgcgggcggccgccggttcttggctcgtccggatccgagttgtggtggcggttgtcggcacggggcccccggattttcgcctgccggatttaggggtcgtggtggcggatgtggtgggccgcggcgggggcagcggcaggagcggacgtcgcgacgccgacgggaagccgcggcgaggaggaagcgggcacgcggcggcgagattgttgattgttgtttttgtgcatgtgagatgtgatgcttcttggtgattcctcttgtgttcttggaacggatcgagttcttttttctgcgttcttgcttgaggtgtttcggtggcgggaagaatcatgggcgaatcagggttttctccactcgatgcggcgcgagggcacagcgcggccaagaaccacaccccacagcgtgcgcgcctcgtgtcttcctctccttctcgcaccctcgttttggcgaggtttcgcgcggctctacttgggggcgaggaggtttgctagggtgcgattccttctgccacgtatgcttcaatccgagctggcactgtgtagcaccggtccagctcaccgcactgtgagaggccttacactgcaggcagtagtatcaattggttgactatggaagaaaaccgtcttcttcagacgtcaatggcctgcctgtggttccattcatgcgggaccccttgtaggcctgtatcttcttacttctccctccattccctaatataagatattttgatattttgtttgcacggtttgactactcgtcttattaaaaaaaatggaattattatttattttatttgtgacttactttattatccaaagtactttaagtacaacttttcgttttctatatttgtataaattttttgaataagaggagtggtcaaacgttaaaaaaaatagtaaatatcccttatattagaggacggaggtagtacgagttgctgatacaccagatgagatgaggatcatgttctctgtaaagagaaaacgagcatacctggtttggaaaatggcatgaattttgatgtcatccattgggcataccttttttaaaaaagaacaagcctaatcatatcagatttttttgaataagtttactttaggttacttaatttatcgtcaagactaaaattcgtccataaaccgtgatacctgatatgacacgttctcaaaatcaatgcaaatgaggtcgcaaggcagttttgacggcaatttcgattgacgtgatgcctatgtggtgctgacaaaatcagaaaaaatcataggacccacatgttagtgagtgtttggctaaaaataaaaaattacaatgtgacccatgtcatcaaccctctacagagaaatatgtcatgacatgggtctgactgtaattttttttatttttaatcgaatactccttgacatgtgagtcccatgtttttttttctgaatttatcaacaccacgtagacatcacgttagctaaaaccggcttaagatcttattgcggtttatagacgaacttattcctttttttcccccttgcaagggttaccgggaaaaaatgttggactgggctttggcatcagcttcaactggcggcttgggcctggcctgtgcttaggttggcatgcattttggcaaaattttgagcaaggttccatttgatattttggtgattcatttcttgcgatgaatcttatgactttgtttgatagctaattttaaatcttttcagtttggctaattgtttttcttcaattgtaggttgaaatgatgtcaacattgtgtttgaaaaacatgaaactactgtgagagaattaacagttagataacatataatgtgatgtctaaagataatttgatttcttaaataagttattatactccgtaatgattacaaattcatttttcaacaactttagaaataaacaaatcacaacacaacatgataattgccaactaggcccaagtgcccaagttgaattttggattctctggcccactttttccaatatacatttggattctctgtcttgcaagaggcgagtcaaagaagcatgatagggtaactctcagctaatcttggccatccaattaaagatgaacggacaagataatactcctctgtgttcaggtgcataaccagcaggagatagtagaatcaatatatatcgaatacttttcttgtcaaatgtatcacgtctatttgtagtattatctataaacaattgattattgatagtagaaacattttttttctactagcagtagaattataataaatacctcaaatcatttttttactggtgatagtaccatagtagaatattactaacatggatcactgtaaaagtactacggtcattcttgttaaaattaagtacccgcttaaggattgtatgtggtcagactttttagacctgcgctacaacaactttataaatatgtaaactatacttatcaaatgatatgttagccgtctgaactttcgtaggaaaaagtgcgtgtacgagcgtgttcgcttgatgcaaacattgcctctggatagggagtgaggggttatccagaatcagatcatcgcccatagataagcaaatctcttctgattgtgaaaaagatgtctgaaaggacctagtcggctactccaaatgtggtactatcattatcctcaaccatgctatcctatggcttcgtagcagtagcactgattaatcacgcgatgcttctatcgaataaccttatcctgttgcttttgatcatccacctatgggcgaatcaattccctctaaagtcctattgcctagtgccctcgattggcccaagctgcagcatcttagtataatcatgatcatagttgggagcatgtttggtaaggttctgcactcactcctgatgcccctgaaacttgtataatccacaaagctcaattaccagccatccaatttaatatgtgagtgcgatgctagcgacatcggcatgtttatctcgcccccaacacatggatttgggactaccctatattcaaaggcactgggggaggtcataagcacttatatgcacacatgtaactcgagctgaatcgcctgtctctcgggttggtgcttgcttgctcatccatggccggagtcaggcagcgatccaaccaaccaccgctcggttaatcagtcggctcgacggattgctagcttgtgtgtgtatgtgtgtgtgcacgatctttttccggccatccaaccggattcgccaggccggccggtacggcaggcgtcaccggcgactttccaagtcacagatcgctgctttcgagttggagaacaaatctgtgctcccacttttccaagcttttgagtcggaagaccactcactctctccctcccctcgcgcgctctgctcccttttgttttctttctttctttctttctttcttggcagcgtgactgcgcaaagaggcgaggcgggaagaaccgatgcgctcctgcaatgcaagacctggcacgatcgcgatggcgacgccagcgagagcgagaccttgactgtaaatatatactactatatatttcctctccttgcgccagtggagtagctagctggagcagtggagtgtggagctgactggtgcttgcatttgactcgcgcgcttcgggtgcgtgcgtgcgtaactgagcagtgaagagcactgttgttgttctctgcgttgattgggagcacttgcgatcgccacggcgcactggtaccacgttgaaatttgaaatagtagagaaatgtttgggtattgatcggttgacttggagatgcagatgcatgccatgccacccatacgcatatgtagtgcactagtgcgtacagcgtacctaccgtgacccaaaaatgtttgttcgtccgaaaatgacatgttagagcttgtaaaaatcgctgtagtccaaaaatgtgtgattttgttcctgttggtatttatgaacatggtaattggggtagaatattgtagcagaagtcaatagactggcccatttgatctgtatgaaaagtataagaaatttaaagaatttccatcctatagaagaaaatcttaagaaatctttgaaataaaggattaaatcatattctccccattgaaaacaagcaagagactctaccacgtattttcatcttcttatggttgttaattcctatgttactcctacgtgtttatcaaactactactacaatacaattttaaagcttttctgtgtttttaattttatttctagagttttttcaattcttatgttttttacaactatgtgtttcgaagagggtttaaaactaaaatgcggggaaacgtcttttagtctaaaaatcataaagatgtcaatgacaaagaaaatataaactttgcactcttttcagtgtcccaaaagataaaggtattcccaggtccaactttgtaaatctgggagtactttatcttttcagtgccgtcttgtttgctcgtcctcttctctcatctccctaaatgacaggattacctagtgtaattaaggcgtcgtcaccgtgatcatgctgtttgcagttcaaaaatatactactaggatttgtctcccttaaattgagtgaacagccgttgaactacaaaatcctagttaaatcatcctcatccaaacaagcactgaaaaggggaacacttgggcaaaaaaaaatctatgggtctcaaccgcaactcccactttgcctagagaaattccatcagagctttatccactttcccttctttgtacaaatacaagagacgggtctgctcctttcctttgacagctacaagcaccaaacacctaatggagaactttcgttctcctaataaagaaaaacacttacacacttatgtagttcatactgaaccaacatggaacgcttgatgtataaacgaagcgaaaaatgaaacaaaaaatggcttaaaaatggccgctgattattcgccgcatatgctactgctgttgcggccgcggcagctggctttccaagtcttccatttccacggcgtggactcccggctgcctcctcggcgacggtctctccctgctcagcatcttcattagcgacgcgccgagcacccgcaccggcgccgagctaccggcggccgcctcctccttctccgcgtcctgcttctcgtgcacgcacctcgccgccgccgttgacggaggcggcggcggcggctccaccccggcgcggcagaccgggcacgacgagctggacgcgagccacttgtcgatgcaggcgacgtggaacacgtggcggcaggccggcagcacgcgcaccgcgtccgcctcctgcatggcgccgaggcagatggcgcactcggtggtgccgcccgccgcgtcgccgcccgccaccttcccgtacgccgcggtcggcagcgccgcgatggccgacgggtccagcccgacctgcttgggcggcgcccccgcgttcacggtcgccagcgcggccgcttccgccgcgcgcctgcggttccggcggcgtacgtggcagacgtagaggtggaggaacagggccagcccgagcacggacacgaacgcggcgacggcggtggcgatgagccgcacgttgcgccccggcccggccgacgagctcctctcgccgccgccgaaccacgcggaccccgggtcgctcactctccccggcacggctgacgtccgatccatcgatcgatactccgcttatccgctacacgcgagcgcgagctagttggcggagctaagcttctcccttggtttggtgagatggcgcgcggtttgggtgtgctaagctgagtagtactatctggtctctttataagctaagcagccgcgcctgcttggccttggctaatgatttgatttgggagggtttagtggtggcaggtttaggtttataggcctcggacgtgtgcgactgaccgtgacgctcgcgttgggcgcagcgggttggtgagtgctcgtccggttcgtgtgcctgtcaggttcgcggttgtgggggcaaaggcggggcctcgacggtgcgggtgtttgagtttcctacgtggccattagtcccccatgtccccacgacaagatgcgacttgatggcgactcgaatcgccgcggaacacgtcggttgctcggtgcggattttccccgggatttcttagccccggagggaagcgcgcgtcgcgcgagtgcggcacggcacggcagccgcgggccatgcagccaggtgttggccctgtaggcggccgacggtgcgccgacgcagcaaatagcccccgcgatggagagacaaaggaagaggatttcatgcgagatcttgcgctggttggttggtggtgacactcggcagctgtttggttggctgtttcgtgaaggtttgtttattcattgttcacgatggttacgggagtaatcgcagcagggtgaactgagcttttgtgaactgattaattggctctccttgtatggcaacacggctgtcaagtgcctctatgtcttgtcaactgtcaagttcgttgatgtggaggagtagtacttgattggagtacactttacttctgtactaaggttggatcaacagaacacatatccgtattccaaaggcttgttcacttgtttcgagtggattcattcacggcctgatacgaaattcaaggcttcggcgccgtaccgacgagtacgaaggaatccaccagtgagcagtcgtaggatggtgccccaggtggcccatggccaggtaggataggagtatgcctcagttgatgccaatttctggcgtcgagagcactagtagagcagtgatgaaaacctgctctcattcatccagagtccgcggacgagtccgaaggatgactgtgtgagtgagcctgggatggcatgcatgcagcatggcagtgctgcagtggcaatgccctcctttttggctcaaactacagagatggagtactcctagtagtacgttcagaattgaagacaccgtacactaaagttggtgctgctgccgcagagctgcttgtatagttaagcggcagaagattcttcggctacaatactcgacaacaaatttcatcgggtatatctgcaccttgattgcctcaaaactctagcgggaatggccaaattgtttgagctcccttttatcaggtgtaaagaccggagagatcgagccagagaggtgcatgcacttgcactttctttagtttccccgttgttgatgcttagccaaaggaatgacaacgatatctgtttctcgaacttatagcatgcgaacgactgaacgagacatggctgtactgtctggcccaatgtttaacttaagaattaagcttttaattactatagttggcccaaggtatagctttgcagggttattctttgatttggcccatatacaagtatacaacatcgcgtggtccaagcaaactccatctggtcggcttagcttcgtttaattaggcccgacaatcgccctgcctgctgggccgaataacggcacaggcgccgcctcaggcctcacccaaactaaaccagcatgtttcatcacgggcaggcatcgatacagcatgattcagttctcaacaacaacaacaataacaaaaaaaggatacagcatgattcttcgcaaaggggagagaagaggaagcaatgccgcatgatcgcgggaatgccatcttttggcgcctttggcacgagcatccgtcatgcatggactccatcgtcgacatgcgccgtcttggcgatcgacgttgcaggcgcgcgctcatctccgtgtacgtacgtgttgcgaatcccccaaaacgacgcgatgcgatcgatctggtcggtagctggttagaataaggtgcaggtttcctctcgtctcggaatggctataaactggcttggccgctagggcgaaccggcgaaggatcgatctaacctagcgcgtcgcccatgtcttgtatagtcatcgtggccacaggcgcgcgggcgcgcgcaacgcggacatacggtgacggctgggacaagctgaggtgatcgagagaccggccggacgcgcgcgcgcgaggggagaagcacagatacgtttttgcggcgacggggcgaacgcgacgtgtgctgcagggcgcggcttttctcatcgcgttggacgagcaaagcaaaggataccaatgagggaggcgacaaagattttgcctctttgaagtaggctagatctgcggcggcgcgggggcgccgcggggggggggggggggggggggg

SEQ ID NO: 57743 - DNA, 8537 bp, Oryza sativa
taataataataataataataataatcacaattttttttcaaataagacgaacggtaaagcgttgcaaaactgtacttattttagaacggagggataattaatctctcggatcatcgattaattaaggtatagtacttccatctagctaagctctcgttccaaatgaatatagtgacctagatcacacacacacacacactttaacagagagctacatatcggatggccgagtcccttaaaaaaatcgggtggtcaaatattttagttgaccatctgattaaacattaagtcatacaaggttaaaaaaaaatcaacaattgaattttttttttgtgaaacatggtaaaaacacacaatgaaacatgtcgctatagcgtatgaaacattgagtttcaacggtttaaaatacgtgttttttagttagaatataatcatgtgatatcttgttataaagattaattacaacggatatagtgatgtaatcggatcgtatatcggataagtaatttatgagaaaaaaacattttaaaaaataataatatgtgtgtgtgatagcgtggggagagaagcatgtagttggttgggaaattgaagcgtccgatatttttcttttgatcgctataccgataagaagtgttctacatgtgacaaaccgacaggtacatatgagcatttcgtctaaaatgagagagcacttcaaggaagaaaaatgtgggagatcgacggtgatattcttttgcatctttatttcgtttatttttctagctacttctccgctagccataagatagaggtagaaagtacaacggtctgtgagcactatatgcaaaagagcgtggcctagctggctactggggatctgctcctatggcagtagaaagtgacctatcctcagcatcttcaaatgggaaagagagcctgcaatcattgtgtgccatgccatactttacctatcatgtttgctgtctgatcgagcaagctgatgactgatgagctgagctgagctcgctaccaatgcactctgcatttctgcaatgcacaggggggagagggagagatcagagatagatagagagagaactaacttttttacccctaatggcagcttttccgttctgcgcttttacttcctttaacgacgtaacagaaacaatctgtctctactgattaatttttcttcttacgaacttatgatcagtaatgatttcctgctacgagattagagatgtcatccaaaagcccacttaatttcataattattgaaggcacaaaactgcgcacgttgcgtaccaaacatgatttgtcatgagagcatgagagttggcaggggagagatctaggagcatgcaaaaacaagagcatctcatgacaaatcattatgtaaaggaaaaagtacgaaatacccttgaactatcacggttgactgaattaccccctgaactagaaaaccagatattgatcaccctgaacttttagtaccaggagaattacccccctcaactcaatttagagctgttttcttctacattgcgtccgcgtggcaatccagtcagcatttttcattaaaaaaatggtgagactcacctgtcatacctactcttcacttatttggttattcccaatctctctctcgcgtcagtcgcgtggccgcaggcacgcacgggcacggcggtgtgcggcggcgacgacgcgaaacgaggaggggaaccggcaggagctcgtcgccatgcgcgacgccagccgcggtggccgcagagaccgggctacgctcatcgccgccgacgtggcgttcttcttctcggcaacgccgtggccgtccgcctcgtgaagcacctcggtgccaaggtggtggtctccgtcgaccgcggctgcgaccgctccgacctcaccttcgcggcacggaggggcaggcggcggcgcgagacgagggagcggcagacggcggcgcacgggccgggcagtgggcagcggcgtgagacggtgtctcagggctcacccagtccatgacggtggagccgctggcccacgacaccgtcgacgaggccacggacgacgaccgacgacgaggaggagctcgccttggccagctgccggcctctccccttcttcctcctctcgccgccggcttgttagtcttcagaataacttttgcactgaaggtatcatcacataagactctaagactgtttgcattactggtgtgctttgctaaagtatgaatgaaaagaactttaaccgttggcactcactttaaccagaattagcacagcatatggaggacgagataatcagataggaaaactctcacttcttttactaaatccatcactctgcccttcgacctcgcaagaatcacgcgtggctacatcgcatccattcgctgcaactcccatgacacgaaagccatccaccgaaagaaaaatgtggccatgaaaatttggtcggagcaaccgcgagggaaattcactgaatcctcctccggatcatggcgcccgaatcgttccaaaccaataccaatcaatcccccaatagcacgcacaagcatggccaatgcagcacgacgaacaccaggaggcccccgaggtcgagcaggaacgccgtcgtggccgccacgcgcgcgttgtgcgcgaatgccggctgcgacacggaggacaacgcccccgcggcggctcctccgcgccgtcaccgccggacctggaggaagaaggggaagggaaggggtggagcggctgtggtgaggaggtggcgtcgccgccgccgctcgccacccagccgcgcccgccgccgccgctcgcgccaccgcccacctctccccctgcgcaccccgtgagagagagaggaagaggggatggggatgtatgacagatgggtcctacaactttttaaaaaagaaaatgctgactggattgccacgtgtatactacgtaggacaaaaccactccggattgggtcgaggggggtaattcgtccggtattgaaagttcggggtgagcaatgtctggttttcgggtttaggggggcaattcggtcgaccgcaatagttcagggtggtaattcgtactttttccttctgtgaaatgagtgaaagaatgtcgttttgggttattcatggcatattgtacctctatggactgtggtacatttagggtttatacattgtcaattgtggtggaaaacgaagaattgagcaaggtggtattatttccccaagcgtgcctcctgcttctttgtcaaccaagaaccgtttgttgccccacaccccccccccccaaaaaaaaaaaactaattaaggcgaacacaaatcactaccatatctatcccctccaccgtgttatatatatggtcaaggttgacatgacaacaatcctatcgcccttatcctaatcctctcttggttaagattggttggattatagaggcttcttttgcagcaataaccatattgaattctctgtttgggtagagcacatgccatccgtttgtctgatcattgtagtcaatgctctacatatttgacagaaaactccacgacaacccttttattgagtactcgtgtctagtaaagcttacacaaaatctacagctcatcaacaaacctcaaattatgccctttcagtgaaggtagctgaagggtcactggtttacaaacaatgtacatgctagtagtataggccaatggatgtagtcgatgcggtaatattgcaactccgacccctgctggggcatgcccaactcaatctattggtatttggatgaatatccaagatttatttttttacaaaaaatatatatatggtatgtaatgcgtatgtgtatgaaaaaaggttgtatttaacctaagagcccatattcatattcagtacataatacgtatgctatatattccattaatactatgtgattctatacatgccaaatactaggggttttacctataaatatttatttttaccctattatatttcgtcaaaaaatcctaggcccacccttggctcgaccttatacttagtatggtcctgtgtactataagatgttctatccaaatgatgtaccggggattaattatttccctgaacttggtctttaatctaccatataataactttaagtcttaaaaaaggacaatcatgctttttggcaaaatttacgtttttcctccctgtggagaagtggtcctacggctacagcgctaggcctcaagctacgatcgagctgatgatcaattaagtctagagacttggcagctttaagctcaagctaatcgatcctacctaggatagactaggtttgtttgagcctagctcatcaacatactcactttgtcaaataaaaacaatatagtacgatatgtgacatatatagtactatcaatatggataaatattaaatttattttatatggtacatatgggatatatgacatagactcccttatatttcatacatatgacttgcgtatattatcattaaggattctgctggcttgatttttgaaacaaatgaggttcaattctcagacatctcttgtaatttagctataatagtcatcaatctcacgcaataaagacatgttattttctgaattcgtggggatcatattaaaagaaaagatccatattagtaattagttacaactcaattactacgtaccgattttcgattttaaaactataaactaataaaatgctacatcgagaatccaagatggaagtatctaaaaaaataccgcaagtcttttgagtaaaaaactttcagatataactatagtataattgaagtgtaactgcattgtaactacactgtaacagtataactgcactgtaactactatatagtttatgtaaaacttgcattcaactatggtttgattagctagcactaaattcttacacgtgacatgtttgaaaatttatttcttgcaactttttctcttcacgcacaaatcttaaggcgatccgatggtcacaaatctgaaagttttttggggggcaaaaaacttaagaaagttttctagcaaatccaatccaagataggttcaactccatatcgatctatcaatatcaaattttggagttaggaaataaaataaatctaaatagtccaaggtacctcctagaaatcacatgttttgtttaatacagattctcaataaaatctacagccatgataaaatgacctacatttaaagcctaaatattatgtgatcatatatcatatatacttatatagttcatcccactaactgtagttaatgctatttctcttttctctcattaagccacatcaccccaattatttctagcctttagatgatatatctatggtccaaattatctcttatttcttaaaaacatgcaatctcaattatttttagtctcaaaattgtatcaaattgttctcgtattgacaatcaaattacatcttatttgtctatattatgcaacttaatttttcgcagcaacgcggcggtgtattcatctagttaatatgggagttttctcagagcgcccatttagtaaaggtatgcatatatagatagattgtcatacaaaactaacattagttccaaccatgacatgcagaaaattatataataacttatgtaaataagaaatgattatttatctaaaagttgaggagggagggggatggggccgggagtcagctggtagctagcctggtacccatttggtaaaaatccatagtttttgctttcaaccacacaaaattgtttctctgccaaaataatagcaatcttcctttattgaaccgtcgtgcatttttttttaaatgttactatatatagatcttcgagtcatatttggccacaacatatatagcaaaagtcaatatgctaaaatgaacaatgtactcaaacagtagccctttttaatttttttagagaaaagaacattttaattaatggtccggctatggggagaaagttcgaacacaaacatatgctgctgcagctagccctttaaaaggagtaaatattatcgtcaatgatatgcatgcatgtaatattttcatgaatccgcaagcaaattcagagaatatggaggcttacatgcaaaacaaggaaagtcccagcctagaaacaagaagaaacaaacatgacaagctactgcactactagccactgccgaattagatggtaggatgttgatacgttgttgtcctcagcctctttcatactacaattgtcagaagtacggtatgacattcaatttcagaagattcagtctgtgaatgaaaaggatctatacccaaagcagtgaaagaaaagaaagaggaaaggtagagataaaaataccattcactcttccaataatagaggagcgtagagtgatagttatagtagagagcagatgccccccttgtgttcctgccctgctcctatcattatcaccatggaaatacaacagaagcaacagctgcagtggtctaaattctttcttaattagccaaacttttttcttaatctgaatcccttttactgctttcatcctcctgtacctcccatattgccgatatattattgcaaaaaaaaattggcgcctttatggaatcaggatctaggacaaccttcgaattggctaaaggccggaatcttcttcagaataatcagatataagaaacattaaaagatccaaaggggggaaaagccatcaagatcatagaccatatcatctcttcatcatcacatcttgtccatgccgagaataaaggggaaaacagcaatagcaactaatgcaacagcaacagctgcctagttccaagggaacgtactcttaataattaattaagccttggttacacatgcatgaagacagcagataataatgagggaaatttcatcagccaaaatcctacatgaaatgacatacacgtacccttaagcagatcagtgaagtgtgttaattaatagaaagcacacacctcctgcatgcgcgccatgcatcaattcttcagtctcttctcatcacctgatcacctcacttccgtgctcctcctcgccctcaagccgctgcgccgccggcgcgagaaaccccataaacccgccgccgccaccggcgccgccaacgagatggccgaagccgacctgtccggcagccattgtcgacggctggtggtggatggctgcgactgcgagggggtctagccatgcgcgggctgacgcccacccgcgaccgctggactgaaggggttccccatgcgagaagagctggctctggtccagcccttgccgcgacggcatggcgaacatgtagccgtcgccattgccgccgccgcggccgtctcctgtgctgttctccggggcatgccatgcctgcattctctggctgtggtcgggccaacctggaacgcctgcactcgagatcataccgtggtggttcgacgagacatggctgaagatctggtgctggttcgactgtagggtgaggcacagctcctgcggctgctggttgcttgtcgtgcgcgacaggaggtccggcggggatcccctgtactcgtcgtgtccggcggaggcggcgccgctggctgtggacgaggaggggaacagggacttgacgctgtcggagactcgatctgcccccagcgaatgtggaaggaaggagccagcagcggccgacgcggcgctggtcatggtgccgccggtagtgttgccgaacccgtaggacgtcgaggtcgcctgctcggtggcctcgggctgctccgtcgacgccgcggcgggcggcggcggggcctcggcgcggtcggggagctcgtcgatggcggccttggcgttgcgcatgagccagtcgacggccttgctgggccggtcgtagccgaggcggtcctgcacgtcgtagaaccggatggcggtgtgcgcggcgaggcggacgcgccggtcccgcagcccgcgcgccgtgcacaccttgctgtgccggtccttgcgcccggccgcggaccgcacgatgcggcctgccccgaatgcagtggccagcgcttcgacgggcgtcgactcgccgctgctgccgccgccatcgccgccgccgcctccacctcccggcccccggctcgccggctgcctgatccggtgttgcaggaagctgccgaatccctgctgctgctggtagatctgaagctgctcatgcgcttgctgcgccctctccttctcctggagcaggtagtgcaaggtgctcgcgctggcggtagggttgctcgtccaagggtctaagcccttggacaactggttcttgtcttcctccagcttgagctccctctcacccacagttaaccggaaaggagaagagcgaaaattaaaacaagaagctaaattctattcctgcatggggtttgccaagctcagctcagctcagctcagctcgccatcctgatgagagggaaaaaagatacagtggccatgggaaccccacagctccatgggcagagcaagcacgcacacacacagtcgcagcagcttaatagctatagcggcgcccagtgcagccgcccggccggcctctcttttgtgaaagtgacaagaaaag

SEQ ID NO: 57744 - DNA, 6602 bp, Oryza sativa
atatatatatatatatatatatatatatatatatatatatatatatatatatctgtactcatttttttgttctctctttttttttctccttcgtgagtaaagtggaggaagagagagattggtagggtggggctatggaagtatagatcgataggatgatgcagggagaggggggcgccgcagacaggctcacaggggcagcaggagtcagggtgcaggagcagcaggacagaagctagctctggtgagatcacgcccccatctctccaatttccctcaaatttccccaaccttaattgcgtgggagaagcccacattgaattcctcctctcaatctctcatcactcgactctttctcgagaagactgtgctacaccaataggagaagcccacgcatgcattgtatcgatagatcacccacccgctgattgtgtactgtttcgttgtgtctattcagttgcaaagctgagcacaactgtgatggagaataactatagtgatggtcatgcatcacatcttttttgggtgggtttcatcttcgttaagctagctagcatatattcggattcagtagatacactgcaccttttaatatatttgtactatgaaacttaggaatggaaaagcttcaaatacgcgagagttaattgtttttcatgtgaaattcctgagcaaaatactgtcaattctagacaggatggagcacaggacctaatgtttgaagttactgactatataaaagtttttcatgtgtacaatacgttcagttatttagcacttctattcgtaagtctatgttactctatttatactcgtctagagttgaagtgttccctgtgaacgcagggatttaactgaatctatttcaatttcagttttgtaggcctagcgttggatcttcataggaattttataggaagtagttcaattccaacaaaataaaaagcaaatccagcgttccaaacatggcctagtgttcatataaatatatatgatggaattaatttccatttgcgtggatttgttttttactccctccattttatattataagtcgcttgatttttttcttaattaaagtcttttgggtttgaccaactttataggaaaaaatagcaacatttagaacatcaagttagtttcattaaatttaacattgaatatattttgataatatgtttttttattgaaaatgttagtatatttttataaaaacttagtcaaacttaaaaaaatttgactaagaaaaaagtcaaaagacgtgtaatatgcaacaaagtattatatttgattgcaccttaagtaacgggtctgtatatatctatatatgtacaaaaatgcagacttgagtagtagcaaatcttcaaaagaaatattatgatgtaaaaaaaacgtttgtaacattttgtcggttgatttgtaactattttttttacacatactatatccatgctgaaaagcttttattttaagctacaaacctggacatatgaacctagataactacttagaattagagcctttttgatgaaggtagtatgaaattccattcagtttcatgttggctgggcatctagggttttgttagttgttacttatagtatgctatacagtgtggcaggcaattagacggtagaggatagtatcgcagccaacataggagatatttaaggcaattttgaggaaagaagacatatactctctccatcccaaaatataagtttttttatatgaatctgaacaactgtttgtctagattcatagctaaaaattactatattttaggatagagacagtatatagtaattaatttggctataaatatgtttttgtccttttgactccgcaatatatacagaaatgtgactggatttcccaaatgaagttagttagttcggtattgactattcatgtgaaaactaaccagctcctactaacaatgttacgctcgactttttacacatgatgacatgaacatagtattactatgggcagatcatccccagtacttatattaaagactccttatatatagaacttatactagctacctgcctgccatctttgttagtaaatcccgacatcgcaatcacacaggtacagtctttttctttctccaataactactacaagtagcaggctgcaacgtgtgctagatccatcaactcttgcccgcgtgcactgaatgcatacgcaccaattatttggaccagacaattggttttattgggggtgtcctctgtgttggccgggttggtttagggtccagggcgtgtccggtttgctaaactgggttaatctctccttgccagatataaaacgtgtcccatgatcggttttcccttcggccttatcctcccatttgcgatgatcagacacatctatcgtcctcccatttgcgatgatcagacacatctatcgtcctctgaagatcgaacacatgtacacttgcccatccgtctctgtctcggcatcaatgcaaaatatgattgatgaggacatgcctatactgaatgaaaccagataaacgtggttagttgcatatcagcatatgcatggcacgaattaatgaagggtttcctctcgccgtgcaggtacatatatatattaactgtgtatggattaagggggtcatacctttaattaatttattggttttgaattgatagatcttgaaacgactgtaccctccaaaaggaggaaaaaaaggatctttgtgtagtatcgttttcttttgtggcgtggttgtgtttactgtggcggaatcggagcttttgtgtcgggtgtggctagccgaacaataataacccataacaccttcatgtccgtttttgcacatgtgattgatggttgacggagctatgggcgaaagccttacccccggtctctgactggtgttggcaacattggtgcttgtgggcgtcgtcttcctccttgaagtcatcattaagtggctctctctttatccgggtgaaaatctagtctagtgttctcaatgggtgttggcattattctagatgtttgttttccttcttcgaggcttcatgcctactccattagtttatgctccacggtaggggtgtttaggtggtttgagatagttgtttgtcagtcggaactactcatctgttttgtggtaagactggcaacaatgacatgtgtcagtctcagtagtggtgccaccacaagtttatcttttttttttctccgtgtgggtttaatttgctggttttcctctaattaatagtgcaattgttaggttttcacgtcgggttttctaataaaatggaccacctattttttttcttaatttaaaatagaaaaacttcatatcctgtttcttgaggtttaccttaaaaaagaaaagaaataagatcttggaatcactttggtcttatattgcatcattcgtaggttcatgatcgatatcgtgtcctccactgcttaaataagcgtaggttatccggccaaatcatcaagtccttggcaaaaattatttgtgccttgatctttttgttcattaaggactacaatcggctggatctaccatgcacgtacaggtgatttatgacactgcagtccctaactagttggtacccggattatatattattacttgcgagttattcattgtgtgtagttatatttataataccatatttttcactaaaataaatagtcagcttgtatttatattgtaagtttctaaattatatatataatttaaatgcatttacaatgtaagtcccaaaattacatatgtaaagaaaaaatcacagcaagcagcacaattgcatgaaaagaaaacgcaaaagaaaacgatactgatcagtatcacagcaaggagtacgaactaagcacgcgtgcatgcataagtacaaactagtgtttgcacgcacgatggcaaagcagtcctgcacaaaatctataaggaaattggagagctaacaaactgaactttaatcagagaatatttatggcgatataattatagcaaaaccgtattctttttgcgaaatggaagaatccgatcgagctagtctccccacatgcgtaggcccgtaatatagcggctgggtttaatattgtaatctgcaagaaacgatatgattttacacgtgctgaaatcgcagcgcttcgatgtttataattctcgcgagaggacaaatgttcaaacaaatatatgtgaagatgattgttttttttcctccctgtagatcagaaattattacctctcggtatacggtaaacagtaatcccgatctcggctttgtctgcatctcaatgtctgtatatatagtcgctgtagctgtaaatgctgatcacatgaatcccgagcaagcaatggctcactttcatcataccgatcgattaattatcaggcgacctagacatacattgaagctatacacctacagaaggaatgacaggatttcagaatttaatgccactgatgatacctttggttgcagaattgaatatacggttaacataagtatagaagccggccaacagttaggatagcagccaacccccctgactggtacgtagcttgctagttgctagatgtggttgtgtatactacgtatgtagtacaagtctcgatatgattaattaagcgcatggtcagtataagcttaatcgttctcaaaatttccattgcgttaacacgtacagtgcccaacaggtagaaaacgtaccagccgtgttgatccgttatactagtactaccactagcttcggtggccggccggcctcctgcgccgcgtttcttttcagccttttcctggtctccaactgtcccgccgggcttgcggggccgcgcggctagctgcaggctggcaaagcgcgcgcgcgctcgctgccactgcgagctcctgctcgctcggtcggccggcccgtcgctactcgctaggcgtcactagcgccaacccgccacgccagctcgtacgttcgtactgctgctcccccaaaacccaatgcaacgaacctttctactagctccgcctccgcgaccggccgcacgcctcgcgctcatgtgacgcgtcaccctccctgtgtactacgctgttggctcgctcgatcgatcgtcatgcatgcgcgcagcagcagctgcagccgcagccgcgcgcggccgaggaagaaaggacacatgcatgtgtccaattattgagactttgaggcggggaaagcgcgcgcggacacgccggacagcgccccgggcaggcacgaggtagaccgcgacaattcggcacgaaagagggccgatggggtgagagagggtgaggccggcggctgtcccacgccacggaacagtagcgcgcgcgcgcgcgcgcgagtacgtcgtcgtcgagactggagccgggcgggggcgcgtgacaccggccggcccggaggcggggcgataccgtatagtaccgacaccgagtgcgacgcgtcacggccgcgtctgcatgcatgcctgcgcagagaccgggccgggcgcgaatgggaggagttttttggaaacgcatgccgatttacggatctggcgcgctgggcccgcccgcccttttccctgaagctctgtagcgacgcatgagcgagcagagagggtgtggggtgatggcgatggatgcgggcgcggccaccgccgctcgtcgcttcgctggtggcgtgcaggcaggcgcaccgcgcaccgcgcaccggcaacatccgcagacgcggatagcaacgggcgtgcatgcggcgcggcgcggcgcggataaaaagggttgttgccgccttgccgggggcccgacggtggtggatgagtgtggatgtcgggcttctcggccttttgcctgaaggaggcgccacatcatggagcccagcatggacagaagaggctgggcctggcccgtttgaacttctcacagcccaggaggcaggagcaacgggccctaccccattgtgtgctccacgcaccgcaacaaggccgagctcctgaaagggaaaaggaaaaagagggggcccaacctcaaactactacaaccactgttctaaaatataacaatagcataatactataagcattacaaattataatattagattgtatctaatccatataagattacaatattttaggatggaggtacttttttacagggccagcgaataatgttctagccaaatttactaagagcgagtggagttttatataggaaaaagtacgaattacccctcgaactatcgcggtcgaccgaattacccccataaacccgaaaaccggatattcttcaccccaactatgcaaaccggacgaattaccccctcgacccaatctgcggtggttttggtctacgtggcgtacgcgtggcaatccagtcagcattatgtttataaaaaaattgtgggactcacctgtcatactcctcttccactcttcctctccctctcacccttcctctctctcacgggtggtaggcgggggacagagcagcggcggcgacaacaggggatgagggtgacgtggacaaggatggcgacggaggagtggaggacgatgctcgggcactggcggcggtggccatggcggagaggcggtggctcgcgtggaacggatggccacgggtggtggc

SEQ ID NO: 57745 - DNA, 2020 bp, Oryza sativa
cccgccgccactcgcctctctatcgccgctcgcgcccgccccctgcgccgccttgccttgccgccgccccgcctcctccgacgccgcgctcgtctcgcctcatccgctgtcgcgctctcctcgaagccactgccgtcgcctcgcctcacctcctcctccgccgcgctcgcctcacctcactgctgcctctgccgtcgcccgtgatagagaagagagagagagagtgagagattgggaaagagatagaagagagagagagactggcaggtagggtctgcctacttttttataaaagaattgttgactggactgccacgtagaccaaaaccaccgtgaattgggtcaaggggggtaattcatccggtttgcatagttgggggtgagggatgtccggttttcaaatttagggggataattcggtcgcccgcgatagttaggagagggtaattcgtacttttcttttatatgtagtagtaatacatttaccaacaaacatggtttgtgggaaaaaaaaataccgcgacatgatcgacgtctatcacgcattgttggtccggatataatgatgctagttcctatgctgaggtgctcaacgaggggttaaatgccctctctttcagaaagaaaatgctacacataccatgttttcttaccacttttgctacgcatacccgtgaatttcatatatttatactataattttgcttgcttaaggttttggcacatttcatgtaatgggtatgtatgtcttgggatataggtgcccgatccccttatggaataactggaaacgtaagctgtaaatctgacgtggggtgcagaagattttgattcctttttggtcttagatcatattttttcaatgcttgccgtataggaaccatgaaaaaataattacctattcgattaaaaaatattagtttaaataacatataagtaaaaaggaaaaataattttaaaaatattataaaatggatcaatatttcatatctctggttgaccaagtacccttgcgtaatgcctaagaagcaaaagaaaatcatcgtcctggatatcccgaggatatttcctgttcgctcggccgcgactccgactccttgtgtggtgtggacctgtggatccctcggagatgttgctaaaaccatttggtgtaattgtaaaatatcaaccatccctttatttctaccggctgatattaatttctcctaattaactctcttaagcagtgttgatttggtgagaaaatatttttattttcaccaatgagataagcatcacatatgtgtatatccctataagatcggtttattcttatcgggtatgtggtatccatatccctgacaagcattacatatgtgtatatccccataagatcggtttatcctcattatgtattttgaatatatttttttttgtctcggacaacgctacttgaaatcgatttaataaaaacaagaagaattggatatgtgttctagattacattgtgcttgcatgttattttgggaaatgagtatgttattttcttttacgttagttggagtgcaatcgctactatggaaggaaacatctttaaaaaatagtttcccttctaatcaaattaattaagtgtgaccgaggtgtcttaattgatctcatatatagaaatagaagaatggctatgagtttgccaaatcctcctatagattgttaaatgggttgtttattttcgtgcacgcccgagcacgcgtgtatagttcatgccccagtaacaacacgacccatttagttgtgggtcgtgctggtacgactagtctaatcatggtgtgcttgggctgctaccaggctagcgtaccaacacgacaattgcatatagcaaaccagcacacacatggtctaggaatggtaggacgcaacctggcccttgtgacatgatggcgactgacgactggtgaacaattgctagttgagcaactgtcgtccgaacaagagctataaagaaaggaaaacgaaagaattgagaaagctagggcttgtgtta

SEQ ID NO: 57746 - DNA, 1758 bp, Oryza sativa
acatatgttgctcatgaaatgcatattttttttattttgtgcagtagggtaggaaatatttcttccttttccatcgtaacaacttgaaatggtgaatgctttttaatgtccgcaggtgaagattttggcaatgattttctttcatcttggaaattaccaaaatcaggaaatgacacgattgactttgacgttgagtcagttccgaagaatagcaagaaattcagctttgacaacctgtgagtattaggcttgaaagtttcctttagcatatgatgccgcagtaattgggaatgacagtatgtttcttttatcagggatgattttgggcttgatggagcctttgacaaattgtcgtcatttaaaatgggcatgtctgatctagatttctctggtcctctcaagaaaaaggtgaagcccaacaactcaaatggcaacgatctttctgaagggataaaagggactgaaaaggacaacttctccttttcctttgatttcaatgagtaagtttttcagtgaataattttagtgagtaagttatattggtgaagaccaataaatatgacacaaaatcatgaatttagttgcttcattttctttgttttgtttacttgaaggctgggcaagttcaatcttgatgctaacttgggaattgaggagaatggtatgagtaaatttgtagaaaaggtcaaccctgtctcttcagagggtgacaaggatccaagaaaaggtctttcagttaagggctctgatgttctgggaggtaacattagtaaggaacaaaagcaaacacatgatgcttgtactctgaggcctactcatttgggaaggtagggtaatgtaaagaacgataactgtgcagcttcaaacattattcctctaactcatttgacggtatgcatgattttttcagctttagccctgcaagaatggaccaaaataaagtagatttgctctcaactgatacacatgaagagaaatctaatgagacacacccatcaagagcagctgttaacaagccttctcagaatcttccttgcagttctacacctggtgaagatcctacacacgtgactacaacagcagttgctgagaactgtagagaagctcctttggtggaacttagtaaagttcatatatcaagggggaataatgatagtgggcaatcagttagttcacaattcatgaacaccagcaccacgtgcccctccatctcaagaaaattgacggcccaatcagattcccaaaatgaccagaatgagattgtgggggaaagtgcatgtcttaatgcacaaagtcctgataaccaaaggtttagaggaacttcaatgaagcttctgaagaaaacatcatgtgaaacaaagaaggctgaaaaggggacttcaggtccaaagagtctctcttcatcaatgcagaggtttgtctttgctataagtttctttattaacaacataagacctttattcttccattcagtgcttacccagtgattattttcattaacagataatgtatcttaaatcagatatcagtaatgtaggattaagtgtagcatatcataattctgcttgtacaagggagttcttttcctttatgtgagccgagatgtaattttgtacagtgatttgttaccatgtgacactattatgataaatatcatgcagggatatgagaaatgtcaaacccgcatcattgaatgaagcagggagtttgtctcttccgccccagtcttcaattgttaaagcaagcaggcctcctcaa

SEQ ID NO: 57747 - DNA, 752 bp, Oryza sativa
ttcatgcccgttagctgtatctcttcatagtatcaagatgcatgtgtagtcgaaattctgcagcttaaatagcctaatagtacccatattagccattcatgattcatgtaccaattttactctgaaaaattgcagctgaattgaaatggagctacacaaaagggaaaaatatagcctaatagtacccatattagccattatgctaaacttttggagtctcttgtactcatttccagttattctttctttctcgctgaaggatttcagcaggtttgctgtagcttggacggccgatccttttcccatggccattagcgtatgattgtttttctatcgagatgacatcatctccggtcatgattctgacttctgttacatttaatcaccaacaaagagtatactatttcaaattgaatcatgatcctataaaaaaaatagaaaaatgatgtcatccggaagcaaacaagcgaagtcacgagcagaacacggacaaaacaaaaggcacagcacacccaaacttccaaactgagttgccatgtcgcgttcaatccacacaccacaactacgggagacatgacgtaaacacaatatatactggagataatctagtgatttttatattaaaatccattacaatcaatatttcttttagcttgcataggcatgctagtgtaatctaccatagaatgaactgtagtgtagcaatcgaagttcacgtgatactgtaagggcattgacagggctgcaggaat

SEQ ID NO: 57748 - DNA, 1684 bp, Oryza sativa
gctaaacatacataagcctaatatttccctatgtattcactagatggtattttaaatacatataagaattggagcatgcatttaaagcgaaggagcaaaatcacatacacagtataaagaaaaggtatgttgtcacaacaaataaagaaaacatgtactgtacatgtcaatcaacacaaaaggctactccatccgttccaaaatataagcatttttgtctgcacgcggggatgtccaaataggcatataaattttgaaatacgtgcagaaatgctcatattttggaatggagggggtataatatatggatgagtatatgacatgatcataattacactggatgcaaaagaactgtcccccttcagtgcagaaactgaaagggtggaaaatgtgaaatactggatctagtctcaaaatatattttttcttaaaatagtgatttacttacttcatgaagatgtttctcaagagacttcaatctttgatcagtctcatcacggagcacatcacttcgaagttcacccatggatctctcaagcttatagcaatagatctccagttgtgaaagacgattagtaattccctcaagcgatcgcagcaaattatcagcatatttcttcatgcacttctcaacagcaaaaagtacatcctccttgccgtaactctcttgttcataagcttttccaaatggtctccccaatctactgtcgtgaaagtcctgctgcacaagtacaagaatgagggatgaatatagcacaaggatttctactattataatcattaaattaattttgcttgtaaaaatgcagatatctttgacaaatttcattttttaagaaacaaatacatcagatttttgtaatgctctctccaactatgtcagtaatagcttaatttgattatttatataattttggacgatgcaggagaactgcgcttcatttcattaagaagaaagaaatatttacataggagggatcaaggagtccctcctaccaagaacacatcccaaaacacaccaacccacaggtgattatttatatttcacctgttagaacatagaataccatcctccagcaacaccaagggtgtcatcagaagtttccagaatgctataatggactttcaacattcacccataaagacaataatctctaaacataaatggactgaacaaatagataagcaagacaataatccctaaacagactgaacatataggtaaacttatcaagtacaaaatcaacgtcaatccaccttttctctaaacattagattgtgttccttacctagaatagcaatgtcctggacacatggtcactaatttatatgtaacaaaaattttactgaacatgaaaactataggcggtattaatgttacgtgtgaatcaaatagtcatgacttgcataaatcttattcaacagaatgtcagaaaaaattatctgaaaactatatcctataggcatctttctctctcgtgcagtggccctcacagaaataacccactgaatatttcaattgatagcttattaaatgaatttctcattgactatctccagcctatattgaccattcaagacaaacctacactgcacatcagaattcagtgtgggtttaatcaaaataagacctgaaaatcccaagtatagcaggtaccatataaaccttgatgcacacaataaa

SEQ ID NO: 57749 - DNA, 9462 bp, Oryza sativa
caaaggcgtcgccgtcccggttgcttgttagatggacgctcacattgacggaaacctgcagcgcctctgttggagaaattctatccttcggtactgtcttcttcagctcacgttaaaattaaaagtttagatagaattaaaataatgtgatagaaaagttgaaaatttatgtataaaaaagttttaatgtgatgaaaaagttgaaagtttattgaaaaaatttggaactaaactcggccttagttggaaaagaaaatttttgggtgtcacatcggacgtttaaccaaatgtcggaaggtttttcggatacgaatgaaaaaaataatttcataactcgcctggaaactgcttgacgaatttattcagcataattaatccgtcattagcacatgtgggttattgtagcacttatcgctaatcatggactaattaggcttaaaagatttgtctcgcgatttctcccctaactgtgcaattagtttttcatcttatctatttaatgttctatgtatgtgtctaaagattcgatgtgatgtttttaaaaaaaaatttgggaactaaacaagacataagggtataatcattgttttctctgcaaatttttacaatcgtccaatcagtctataaaaatcagttgtatattcatgctaagtacagatattcacttaccgttatttttaaagaaaatctatttatattatatatatatataacggtgaagccaatacctatattacagttgagcggttaccactctgttggttttatcaagtgataacaccaacatgataacaccaacagagttcaggtaactgctcaactcaactgtatttataacaccaacagagtttaggtaaccgctcaattgtaatataggtattggcttcactgttagatatacaaaatataaatatattttagagtttatcactattgttactattgttacataactttgggatatccagtattgtggttcaagaatacgaatccaatacgaccactagttaagggagtcaaggtgaacttattccttccatctctatctctactattataaaaaataaagatgtttttgccggtaccttggtatgtcatccatatatgagtcggtttttaagttcattcgtttttggaaatacatatccttatttgagtcggtttttaagtttgttcgctttggaaaatacaaaatgatttctttaaaaaaaactcgcatgctaatttgagacaaccagactcctaattgtagctcatgtttagattttctgaaaaaatatatatccaagcagattacttgagacgatcggactcctaactgcaattcatgattttctaaaaaaatatatatccaagtgaatacccatggtgaatttcaccttaactaaaccatataacaataataaaattaaaatagccttcaaccattgcaatgcacgaacattttttttctagttactataaaaattgacgatgcttccgctgattctttggtatgtcgttcgtatttgaattggtttttagttctttcgcttttgaaaatacagaaggagtcgtgtaagaaattcatgttaacttgggacgagagtcagactcctatatgcttcacaattctcgctatcccataagataacaacgtacacgatatatctatcatcccaataagagttcctaactagatatcaatactatcaaaataaaaaaaatcccatatacttttgctaacaataatacaaataaaataatattcatcgttacaacgcacggatatgttttttaagttagtgaaagacggaagactgtcagctcacaggctaacatccataaattgggccgaagcaaggccttccgtggcaaatcgaaagtccgaaacgacgttaactgatttaagcccgaagggcctcatcgcagaagaagcccacaaccattaggccgtaacaatggcccgcgtcatggccttctgcgagccgttttgctggtaggctacaacgacggcgacgaggcgggcctgtttggcacagctctagctctacttccattctttctggagctggagctcagccaaacagctccaccaaaactgggagtagagttaggtggagccctttcacaaaatgtactagagttgtggagctgggtttaggtagctctacaacttcacttcaaactcaactcctggagctaaatttagaagttggagttgtaccaaacagggccagaacgttttgaccgaaaaagctatacgctctccctttgatcttgacaagagccttttccaccgagctagccattatttctcatcccttttctcagtcagatgacgtgctggtcgtccatttgttaattatttgcaatgtggcacaatcatgattcatgacctatgtaaagttgcgcatatttttcttaatttttgatggaaaagtttctaaaaggaacctttatatggccacatgctcggtgtcgtgtatatatatgtgtcacccgtacggatgattatattcggattggcaaatcttcgatggtaaagtagcaatgcagggacatcgaaagcagcaattagcatttgacattcgttcgtaattcatatataaatatttgctgaagctagctttgtcacaacaatgttggtaataacaatacaattcaaactacagcgtatacaaaatatatatgctagatagctgcagcggctagcgtacgtatacatatgcatggctactactccccggatggccggatggatatgctacgatgatatatatagctagctgcagagaaaacattatttgctgccaaaagaataacccggccgctacacaagttgcttgctacctgctgccacccttagttacaagggtttagtagtacaactattgagcaccagtcgatcaacctaagcctctcagagagattatttctttgagatcataatagcctcagacgagattatttcacgaataatgctcgatatatatatcggatcgtcgtctagtaatggtgctgagggtccgggccgcccggcacttcccgcttgccgccctgtaggctcctcacgttccacctccccggccgacgacgtccacggataccaaatccgccgccgccgccgccgccagccacgtcgtcgtcgtagtcgccgcccggcggagcggcgtactctgccaaggcacgggccgcctcggcctgcgtggccgcgagccccacgacgaccaccaagaccaggcagagcacaatgcagacgcaactacgaatagccatatctcaattgatcgatgaaattattcaccgtacgtacgtgtgtgtgtgtgtgtgtcgatgagctatagctagctagcttaggttcgtttgtgttgtcatggccaggtgccggcgcgaggtgtgtttatatagggggtgtagaggagacggtggaactagtgcagcgacggttacaaaagaaacatataagtgtgggggccaaagggcgccggccggggggcgttttcttggataagttcggtactaatctcaactaccaccgcattggcgcattctacgtagcctttcttctggcctcgtccgagtggccactggccaccaccaccacaattgctggtgctgctactagctagtaatagatcagtaccatgatgcacaccattgccactttctgcgacgaggaggatatatatatccccttttggcttttgcattaggcattagagtgtgaggtatgctaattgcaatggctgtactacatgtaggttgctgttggatgaaactgtcagctagctaggcatcctagacaacgagtgcttggagttgtcgaattcacaaatgtcacaggtaagatggaagaaattaattaaacacacagtaaacattgagtagaatcaaagccaaggacaagactagtagtgtagctgaactggctatgcgccgaatgcagtaccgccagcacgtacggcgccaaattacctggataaattcctaagtacagcatgagatattgagctgaaaccaaaggcgaatcaatctggttcagaattgcaatcctgcattcagtattactgggtcccctggctatcaacatttgcaatctcgactttgatacgaagctactgatatccataccttttagtgccaccagacattacaataggtaatatggaaggcaattgtaaaatatgaaaattcaaaagaattctttgaccaaatcactttgtagcatcaaaacaaatatgctcgatcaccaaccattagtatacgagcccgctacgtagctatgtagacagtgcttagtggaaaggaaaacgagtagccaataaaatccaatgcttggatgtaatttatatgtcaatatgtcattttgctcatctatgtgcctgcttcgtcaaaaggctgtagtacctcgaaaggttagttaatgtttcggttgcagatttgctctttatatctttgcaaccgattagccacatcctctgcatgtaacggctgtctgacctcctcataatgcaagaaggcagcttgcagaattttataagataaatggtcgaaatcaaacccaagagattacaaataagaaccacttgattgttaacacagagtccacgtttcgggttctaagtgtctgtttagctgagaaatgatacggtcatttgactttaattcgatcctgtatgacttgcttggtttgagatacgaaatggagtgatccatccgtaacttcgtccctcaaaaagtcaaaacatatggttactgacaaaaattaggaattctctttattccgtcaaaaccatgaaataatctcacgatgaaatactcgcaccagagaagccatattaattaactgagtcggttgtacgtcacaatcagcagattccatggtaatatagaggaaaaagttactgaaatcattccagtcaacaatctttctacatactgtgttaagtgactagatgcaatctgtttcgaaagcgacaatgctgttccttttacaccacaccttttgccactctctggatgaaagcaacctttttcagataatagtaaaaatattgatccacctagaaccttaagcgatgacgttattctttttttttttaaccttacatctattacctgaatataagtgactgaacgatcgcttaggatatttccaactcagtacttctcattttcatttgcatagcagatgcagggaacagaagcagagtgatcaatgaagatgcctagtagttatgtaccatctattacaagatcatataaacaaagaatctgcaggacagacgaaactaactattttgtacaggatcaaccaaaactaatttgatatccaccatgatccaaatgttgaagtgatatacggtaaactggcgagtcaatgtaaaaaagaaaaggcgcacctccattgtttatcaaatgcaacttcacctgaaacattgctagctaaatatttgtgaatctgtttggcaaccttggagaaatgtgaccatatgacaggccttggttggaaatgcatgcctttacaaacaatttcagcttcctttaaataaccaaactttgtatgacagatttgctagctaagtacttgagtatctatcataccgtatgtctggcaaccttggaggaatgtgcgccatacgacagcacttggttggaatggcatgcctctaatcacaacctcagcttccttcaaatgaccacacttgcatagcatgtccaccacacaaatgtaatgctccatctcaggctcgattgaatattcagacttcatatgtctgaatatattcattccttcatgcaccagtccaccatgcctacaagctgaaaggactgctgtaattgctaccttgtcaggtttgaagccatcctcttccatggctttaaaccatgccagggccttacgagaaaaaccattaagtgcaaggccagaaattatagctgtccaggagataatgttcctatcttccatttccttaaaggctttcagacattcttcaattctaccgcacttagcatacatatctagcaacatattatgaacataagtatctaagcaaccagaattggtcttgatgataagcccatgaagcaacctaccaagaacaaggctattagactttgtacaaatgcttagcaggctcacagatacatagctatcaaaatgatgccccaaaattctcatcagttcgaaaaatttaagagcttcagcataatcaccattccttgcacaagcagtgataagtatgctccatgaaacagtgtcattacatccctgatgtaaaagtagcttcttcgcttcgtcatacatgcggactctgttatataccccagctaaaacattcatggagacagcacaggagtcaggatctaacatacccccataagccaaagcatcagaaaccatttcatgtgaagcatatgaagatataatggcacttgagacatagtcatagccgtcgtaacccaatcttgttaccaacgagtgaatctgcaacagatcgaatactgatgggtccttgagcaaagaagacaaactaacctcgtttggcataacaccagatcgcaacatctctctcagaataaaaaacgacgttggaacatcagtatctgagtgacaagaaatcagtccattccaacgtgtggtgctatcctcaggagcttcttcaagaactttgtgagcatccttcgtacaaccacattttgaatagaaatcaaacagtgaagtgttcacaaatggtctcgtattgagattgtgtttgataacttttgcatgaatggaccttccatgttcatgtccatttatactggtgcaggcataaattacactgctaaatgttatttcattgggcaaaacactccaaccttccatcatccagaaaaattcaagggctctctgaggcaagcttctcctagcgaaggcaatgatcattgtattccaagaaaccacgtctctgaacatgaactcactaaacagattctctgccaaagacgtggaactgtgagtacagtatgaattcagcaatgagtttgcaactgttgagaaggaatctatcgcaattttcttcacaagcccatgaacttgctctggtgtgccaaaagcaggaagtactgccacaagagagccatcagacacgctgttaccgcttcgaaccagcgccctgaaccagatcacagcatcgcaggcacgtccatgctgcgcaaacgaagagatgagacagttccaggtgacgacgctccgcacaggcatttcgccgaacaacctgagtgcatcatcaaaccggccattccgcccaaagaaccccaccagcgatgtcccggagtaggggtcgctgtggagcagcccgctcttgaggatgtgagggtgcagctgcgccgcgcagcgggcgccggccgaaggcgaggagaggatcggcgcgaaggtgaacgccgtcggggcgacgcccgcggcgagcatgcgcgcgaggagcgcaaagccctcggcggcgcggccggcgcgggcgcgggacgcgatgagggagttgaagagggaagcggagggcggcgcgctcggactcgggctcggcattccgtcgagcgggtgccgggtgcggcatgggggggacagcggcgtgtcactcctggcgcgccggcgaaggccaaaggcgtgccgtcacgggcacgagatgctcgcggtgcgcacagctaatcgcgcgccccggcgaccggcggcgccgcagcaggcggggcggcgtcgaggcggcgcgtggcagcagcggcagaagaggggaaggaagaatcgcaaacgagcgcgcggcgacgttgcgatgggctcctcaccggggggtatctgcccgagcgcgcttgcagttgggctggtttgggccggaaatacgcgtggcggtgcatcgggccgaaactgcaaggaaagcgcgcgacggcttccgctgagcaggctgtgcgtcatgatagaccgggccagttttcctgcaatttgcaacataaaaaacgtttttttttttgcattgcatatctgatgatatttgcatattttctctttatctgtcaccatattgcgcagagcattttaaatgatcttcagtatcttcgtcatatccgggttagcattttaatcgatcatcagtatctcgaattcttggacatatgtaccacatgcagacttagtgtactataaaatgccgccctggataatatagggccggttcactttgatgaaaaaaaaccttaccaaattttggcattaccaaaaattttagtatagttgccaaaattttggcaacgtgccaaattttggcaggatttcttatataattactaaaatttggcagcaaactaaatatagccatttttttggaaactttatcgaaatttggtaaggttaaaaatggtatcaaagtgaacgcctatagtatagctagctaggcggggtctagatcccctagagttggctacaactctatcaggtggagttgccatgatttgtgccattccgtgtacctcaacggctaagattaagccatgttaacattaatatatacttaaaacaagtaattaaccgtgcaacaaataaacttgcatcaacaacatgtcacaggattttttttttactatagaattgtagaattaatacaagaatttcatacttcatctattttattaaaaaattatacatattaatattgatatggttcgctgttgcatatatatgaaaacactgtgttggtatatactgttgcttagagttgatcgactgtacgtggttattaagaacaaaaagtttttcacttaattttttgttgagaacataatcaaaatagaggaagcgcgcgttgaaaaaactaatttttctctcaagctataaccattaatgttgaggagttaatttattaggtaaatttgatgaggcatgatctcagccgtaggaaacagtggatggtatagatttggccaactctacttggtagagttatacccaactccaagggatccagagcagggtgtggatccctcggagttgccttcaaatctatataagtgtaccaaacatccctgaactgaccgatccatgaactgaccgatatatagcccatccatgaactgaccgatcgatcgatctccttttgcttgatatatatatactaagtgttcttttggccgacatggaaggtacagggcggcggccggccgcggcaatgttggaatcgttagcggtaggtaccagttgataaggcattggcgtttctcctcatgcatatgcaatgcatctgctgcgttggaccatgatcatgtctgacttggatcattagcattagctaactatactagaatatcaataacatgctagccagagtattgattaattactagtatctttaatttctggtggccggcagaccgatcgaggcctactgcctgcatattgccggtgtggcggtgcatgccttgcttatctctcttgacagtaagcattctggcctgtgc

SEQ ID NO: 57750 - DNA, 7405 bp, Oryza sativa
gcaagggttttttaaggcatgacagcttttgatctctctgattaccctattcgttaagaacctatgaatgagaagatcgtgacaaggcacgtcgcaagcaatgacaaaaatgaaaagttgcatgcttacctcgatcggtagataggagaagagcagactaattaaagagttaatgctcttttccttgattgaaaacaagaaactaattaatgcttgagtgactgttgtcagagcagtgtgagtccagagctaccttttttttcctccgttattcttggcatcggtcgaggtctttctttttagacctactgcgataatcgtctgtcgagtcttgcaagggccacacgtacggagatgagcttttcatttcacgttttactggatgatacttataatacgacgttgctacaagaatttacatgaagcattaattgttagatatagatgataaactttgggtgtgtttgaggaggagaggattgagtgattgggaagatacgcaaaacgaagtgagccattagctcatgattaattaattattaactattttaaattttaaaaatggattaatgtgattttttaaaagaactttcctatagaaaatttttgcaaaaaacgcaccgtttagtagtttgggaagcgtgcacgcggaaaacgacgtgctttcttcctcaaactcactggaacgaacgctgcctttgtaatgatgacatcatgatgaataactttaatcactttgttgaattttgtaaatcgcagttctgttctcgagcccaaagagtgaactctttaatggggtggccttggtaatacgacgttgctactaaattttatactagaaaacgtgataccttccggtattttttgaatgatggtaaaattaccccctgaagaatacgtaacaaaaaaaaaaaactagaggacgtatgcacacgaacatggagactcgtcctaagctgtgcctgtgggcttgggtgaactgagcacttcccggtttttggcctggttagccaagatcaatcaacaatttattgtaggcttttagacattgtgtgtaaccatcctagttttattaaaaaaatatgtagtaagtattatttattttgttatgacttacttttgtcagtgaaggtatttcaagcattcatatcatatttctcacatttatacaaaacttcaaataaaatgaataatcaaacgcgacatcaagtttaaaagacaatagcaccatatatttaaaaacagatgtagtatttgttgtcagtagaaagtacatttagtgatttactcaagcgtatatattggactgctggtcactagctaaaacttgagaagttatctggagttactcaacgatttgatgagctgctggggtacgaagagccgggtcttccagctagcttcataaggtggtgagcgatatgtattcgaagcctcaccccttctaattatttgtataataggccatttcctaatattcacgtctttatttgatgaaccgctgtacgcctgtacctagtgctccattgactagtgccatgtcaatgtttccttctgaaaagttcatcactaagaaatacattcacgttatggtcaagcatgcagcaatattataggctcatcattgatgccgattttctatgcacatatggggccgcgatatatatgcgcagaacggtgcctttcggccttacagctatacagcacataactaaagttggcagcaggtgcatcccttcgtacacagccgaagtctgaagctgcgtgtataaattgcttcctatactttattaatttgcttattaatgtgtcgggttgtttagttcactacttcactttatcaagccacatcttaatcatattataattattagataggtatttatttcgcggccacaacttagatttaccatactttcttatactttaaactcctaaatcatttattttttttcgaaccataccacacttgtgacataataattcatggacataattttttctaccatgatcacactttagctaaggttagctgtcgcaaaattagtcaccaaccaaacaacccctcctttcacatgacacaggaatatagtgttgtacgttcattttcaatgtatacagtcaatgcatgttaattgtgtcattgttagctcggatatatatatcgttgacgaatgattatatttagctgcttcaatttgcagcccaatttaaactctagcactgtccttttaagttggtttcttgagaaaagcttgtacgagtacatactccactgaccgaccgctgatcttattgatctatatgatggtacgtacagagcggatccgatcaatgttactaaaactaagcttgtgcgctttgtcgagtagatttgtactagaaatagaaaatcaaagtgaaatcactatattaattattcccttccgatggtgtttcacaggtatgcatgcatatgcatcgaaatgaactcgtctatattgtccatctatctgacaacatacagtgcagaacgattaattagtcgagttctacagttctacactacacatggtctgatcatggacaagaacacatgccgtacaaagcgaaaaacagaaacaaatcaagacgaagaaacagaagtggtaaacaaaattaaccgcaagatcgaacactgaaacatgcagcactgggcgatcgacgaccatacaaaaaaaaacctccttaatttgtgttgatgcagacgaggcgacgactacctacgactgagagagatcaatggtgctggggatccggccctccggggctaagccgcttggactcgtgcgccgccgcgccgccgacgacgacgaccgcgccgccgccgctcctccgccctgcagcctcgccggccgccgcggcgggcaccttcatcatgccggccacgcctgcgcggccggcgacaacggccgcctcctccggcgcccgttctctcaaagccctggccgaggccgagcgcgccacggcagaaagcatcaagatggcgcagaaagcgaacacggccaggtacgtacgtgccgccatgtcgcctgctgagatggcctctttttgggaggaaattaaagctgatggattctagctagctggggctcgagacttgggtttgggacaaagctagttctacgtacaggtcgatcgttaggttgaaggtgatgatgggtttgtgtggagctacacatctaggcctgcatcgtcttatatagcctatagaaccttgtggcgtccacgtaagatagatatgatgcgtgtgtagctataagctagtaacggacatgatctctacagtcgagggcaagctgactaagaaaccatgcaaattaagacaaaagtatgttaactttgccacctcttctaaatgctcagccactaattagagagagagagagagagagaggctacaacgaattgtcttctcggtttattaggggcggcggccaaagtgtattccgactatgataatagctatacgcagggtatgcacgcataaagctaaatatatccgtgtgtttttaggtaagcacgtatttatgcatggatcaaaaaatactccctccatcctaaattgatcatcatatatacttatacaccaagaccaatgataatttaaatgacatcaatcaatacaccatgcacacacattctccaataatgcatgtatcaattaaaaaaccatgtcaattacacctcattactaccaaatctatatttcatggcagccattttgggtttttactggcggtatttggagccgccacaaagcaaaggccaatgaagatgaagcatctgcgctggcggcgaaaaaccgctagagaagttcatttttcactggcggtctatgtaaggcagccgccagcgaaaactgacttatgtggactgctagcgaaaacatatttttgctagcggttcctcatttttactggcagtggatggccaccaacaaaaatttggtttcactggcggcaggtaatgagacccgccagcgaaaataatttggaagaaaaataatcaaaacggaaccgcaaccctagccagccgtctgcaataaaaattacaccaaaaatatccccaaaatcagattttcgcagcgtgtacatattcaaatccacttccaaattttcgagcatcgattcaaatcctcatccagagttcacagcatacaagcattttgaacatggaagtgaacacagcatacaagcattttgaacatgaaaaaaagaaaaagaaaaacagcaacaacagaagagaggaaggaggccgtcgtcgccgtcaccgaccgagcagcaccggttgtgcgagccccgtcgccgagcatcaccgccgctgagctcttctgctgtaccaagccccgatctaggaagccgggctcaccagcgaaaccgtgggagggggaagggttgggggagggggaggaggaggagctcgccatgccctctgtcaccgttgtcgtcccgtcgccgtgcccccgcttcccatcgcagtcgtcaccgcgccccccgtcgtcgtcgcgccccaaaacagctcctcccgtcgccgtcactgcacccccacctcccgttgcagtcgccgtcgcgccccacgactcctcctcccgtcgccatcgccgcggcccccgacgaccgccttccgtcaccgccgcgcacggttgcctcccttcgccgtcaccgccaccacccgagaaccgtcggcagagccgccgccgatgccgcctggaggagaggacccgacgcctaggaggagtggatctgtggaggtgaggaggagaggagaggatttgaatctggatctggatctggtgctgagaggagaggaagatatttttattgtgaagaggtgtgtgggattttagactatttgccattcccttagatgtagcattcccaaatgccatcttcccaaataacttagacaatttgcccaggtccccacaaatcagctctcctctgccattttacacccaatttcgggtcccaggctgccacatcaccaaccaaggtggcactgagagcgtgaaatgtctatcttgccctgcctcttctcaactgttatgttttaacataaaaattacacaaattgccactgacactaaaattgaacaactgctctcataggagcactgttaagacatcccagtcactctaatccctcgttcataccatcccaacccaaattgcacaatctgacaaaatatatcagccacattgcaccataataacaagtatataacgcaattcaacggaacatttcttagaactaaaatagtataggcttcaaatattgttttctgcatttctacatagcacgtctagtagcaagcatggctggccttaacattggtctttgctgccattaaatacataaataaccccatctttcttgagtccagtttcatgtaacaaaagcaaaaaggcaacatcagttctgttttttctttggagtcaatttcttcttggttggtggtagtggctgtgatggtgttgcttcagtcatagccaagcgcctccttgtcactggtccaggtgaatcttgtgagcatccttctctagcaatagttggtgttccagttgtccttgtttgactaagaaaaaaagatgttagttatgcagtcatcacaataatgatcatgtaattaaaaagaagcaaggtctcttttatatcctaacctcctagtgactcgagcagggctatcaactaattgaactctagcaacctttgatcttgttggagtttcaacaatttccttagcagttatctttatcatagcttttgtagcaatattctttgccttcctcttcctaaaaaaacacaagtagaacacaagttgaagacagtgaataaagataggacaagttaacaagttaagaaaggaaaggaatgaataattgaagcaagttaagacaatatagaacaagttaacatgttagaattattacctctttttggtcccattaagaggacacttttggctgctctgtctatgccctagcccaccacatcttgggcatttcacctgccttctgatctttcctttccccttctcaagacaagaaggaatcatgtttttcctttgcctaggaacagttctaggttgggcactggtggctgcaacttaaaatctttgttcgctgttggccattgggacttgtcagttatgcaggggatgacaccttcatatgcagccctaaagcaactaacagagaaaacgggatcaacaaaatcatccatgattggattcctttgtttggagatagctgcaagagcatgagagaatggcttccctgttaactgccactccctacatgtgcatttctgttggtcaagatacacaacatgcctatagacttcaacactattatggagctcagtcacttcagctgtatcatccgctcccttcatgactctcatgttggctaaacctctagttgctgcctttagttgtgtgacaattgcaggtaaaatgtttctgccttctagtttttctccaatcttccttctcttagcccacaaggctgctgtcttctctctgattgcatctgctagggcatcaacttgcagttccttgaattctttgatccatgcattccatgactcagccacattattagtgatgaagtcacatttgatctttggtgagaacttgctccttgcccacagaattttatgatgtttgtataaccaatcaccaacatcaggatcagctgataaaaccttatccatgtgatagtcatagatctcagacctaaaagctctagcagctggccacaagttaccataaactgtaccagttttcctctttgtcaagttttccatcaagtgcctaaagcactccctctcctcacagttaggaaaaaccctctcaactacattttctaggcccttgcaagcatctgtacatattgccaggtcttccacatgtccaatacacactgcaagttgctccatgaaccaagtccagttatcagtggtttctgcatcaaagaacccaaatgccattgggtacatccaattatgcccatctaaggcatttgatgctgccaagtggccattccacttcccattgagggccgtagaatcaatgctaaggtattttctgcatcctaacaagaaacctgtgatgcaaggctcaaagcaacaaaagaacctctcaaagtgaacttgaccatttacttccttggtaccaatttcaactcgactgccaggacacctcaactctatctcagccttaaagttatacaaggaatcaaagctatcatcccatgaactcccaaatcttttgtatggccctctctttacccttccaaacagtggagtaaggaatctgtaccttgtaccgctcctctaatatggtctttagctccttggccccacaatttggcttcttcctcat

SEQ ID NO: 57751 - DNA, 828 bp, Oryza sativa
ctcacaaggttgtgcctggcctccagcttcaacacgtgggtcaatacagtatgaccgttcgctgaatcgtgctactgattaatagggcattgcccaaacatatctatttatccaccatttcaaccctataaaataataaaaataaaattcaccgtcttaaaaattcagctcagaagttccgtttgaaaaatgggattatttccattttttaaatttcaccgtttggtagtgtggggatgggatgtgcaatccgggtggcggaattactaaattaccttcgccattttgacgtgtagttggcctctgtcgtcagtttgcccgccgccgccgccgcctccgcctccgctgaccgcgagcgagcagggcgccgtcgttcgtcctgttgcttccgcggttccgccgcatcctggtgagtacatcctccgccaccgccgtctgcgccgatccccatccatcgcgcgagcgagcgagcagggtcgccgtcgttcgtcctgctgcttccgccgcatccgttatgcacatcctctttcccatctccctctacccacgcactttttttctcgaatttgcgttaaccctagcttctgttctagaaatttgctttaaccttaatactcataacagtttgtttgttccccaaaagtttgggggtttaactgaaccacgatgtcccatgttagatccgccactgcatgcagacaccttccctgatgtttctctgagaaactaccccccccccctccctcccttccctctgttctccagagctacatagtgttatctgaatagaagtattgttctagagagaagaaggtttgggctgcagga

SEQ ID NO: 57752 - DNA, 721 bp, Oryza sativa
gagaattacacagtacaatgcagacactcacaacgcacgcacactcacccctatgaacgcacgcaaactctacccctatgagtatcttcgaagactgggccggcaaatccatcctatagattgataaagtcaacacagacgccttgctgtcgacgggtacatcgcctaccactgaaaacacaaagccgttaaagccaattcgttttcatggggagtcgaacacaggacaatcaaatatgtacattatagattatgtcaatatcctaaatgatacgtaaaaagagaataggagagtatatacgttatactacattttcgtcataaacatttgtgtttggaacaaaatttggtcaaaattgtaaaacttaacatccaattttatatcagaataagcttataaagtttaataagttgtgttagtattcttcaacacaaatttatgcgcatattttctattaaaactacgccatttgagaaagtactaattatcaaagtttcaaattttaaatcaaatcttaatcatctaatgtttatgactagctaataacatgagttctttcacacagtacctacaagtcccaacaattggcaccatcgagtactagtacccaaggtttaataaacccgtttagatggggttacgaccaccccgcggtttggcggttatcattggcaccatcaagaactataacacagggcttaataaaccgttttggatagg

SEQ ID NO: 57753 - DNA, 2316 bp, Oryza sativa
aaaagcacttctccaccagtgtactacacatgttgtgaaccatgataatctcaggtctaaggattcaacagcaacactaaatgagatcactgatgacacaatacatatggctcttgcagtgtctcatgttgggtctatccaacaacatgttcaccaacatgtgtccatattattaatttggtatctctataccatgatccatgagacatgatcatcaattaatatatatgctgatcatataaacatatttgttccacatatgatatttgatcagaatcctttagaaatagtaacaaacaacataaagagtcccatgaaagaatcacatatagattaaccaataatgagttatctatttccaggaataatgtcggataaatatgtaaacatagtatgtgatacaatcatctttatgattgcctctaggacatatcactaacataaacccgtagcaagcagcgagcggcagcctccacgcgctactccgcgagcgctgcgaagctccggccgacgcggcagtccgcctcagtgccgagccgcggctccgccgcctcctccggcaatgcgtggagcgtcgcgaggctccatcacctccgaggccacgcgcgactccgccggtcgcgtgcggctccgagtctccgacaccctccactggctgcccgcgaccccgccgagtcgacgtcgcgaccgcgtgcggtccgtcgcctccgcggccacgcgcagctccgcacctgacgcacggctcggactcctccgccggctaacgtatagcgatgccgcgtgcgcatccgccgcctccaccggccacgagcggctcgagccgcggccactttgcgcttccgccggccgtatgcggcttcgtcgcgtcagcggccccgcgcggccggcttcgccgcctccgccggccgcgtgcgccgccggtcgcgcgtggcttcgccgcctccggtcaccggcgccggcctccgttggctccgccacgccggccttcgcaccgtaggcaatgccgcacccgccttggccaaggccgcctccgcaggagggccgtgtgcggttgcctggtctcatgacggccattgctgcgccacacatcagctgcacgaagtgggctcactcgtgcgcactcggcgccagcaggccctgagcaaagggaaataggcggcaggtatgcatgcaaatgcatggttgcatgcatggtcctgttcacgtatagattagaaaagaaaacaaacaaaaaaaagaaaggagaaaaggagggcgtacatatgggtccgcggcatgaccaccctcgtgggacgtagattctaatcactcgagtggatgtccactcatttagtgtatgttaactaaatgatcatgaatttttttttaaaaaaattacaagatagattaatatataatatatcactacataaacatgtaacttaaaattcaacttttataagttgtaaaaaaagtaacaaatcaaacttttgatttgttatttttgttacaacttgtagaagttgaatttaaatttgcatgtttgtggggtgatatattgtatatgaatctatcttgtcaaattttttaaattttttttatacccatttagttgacaagcaacaaataggtggatgtccacctaggtgattaaaagtgtttccccaccctcgtgcgatccacgccgcagcatgtagccgcatgcggcttcgcagctccgcctccgaggccccatgcgcctcgccaccaccgcggacaggcgaggatccgccggccacgtgcagccccgagtggttccgcctgccgtatgcggcttcgtcaccacctctgcggcgaccgcggtttgccgcccccgcacggccccgcttgcttccgccgatcgcgccagccggctccttccgctcggtgtgcgtgcggccccgccgcctccacagcctggcgcgcagctgcgcccttctcgaatggtcgcgcatgcgaatgcatggcactgttcacgtgattctctctctctctctccatatatatatatatatatatatatatatatatatatatatatatatatatatatatatatatatagtaaattataaagagtgctccactcgcagcaaggtccagggcggcgctgccacggccccgtgcggttccgccgagctccgccggacaagcacggccttgtacggccccgccgcggggccgcgtcatgtgagacctcccccctgcggcctcgccgacgcggcggttgggccgaaggccacgcatcccgagccttccggcagacctgagcatgggcacacgccatgcacggcctggtgatggcgctgtcccagccac

SEQ ID NO: 57754 - DNA, 1735 bp, Oryza sativa
ttagtccctcccaaggtggatcttaggacatcaaaagatgcttggagacccctacaacattcattcaaagcggatttgaagctccaaggtcaataggatagtttaatttttgaaatcgagttttaggaaaaaccgtactattaagaggggttccaagtgttgttctgagatataaaaagtgctcttagtgggttccttgtggtagaatatttttgggagccatttttgcaaatgggtccagaccggatagagaaggctggccggaagttccggtccctggacccggaacttccgaaccttgcgacatgtgaaattttcctaagtgttgtctggaagttccgaatgtcaggaacttccggacctcttccagttcaaaaatgtgagtaacggctagatgtcgtcacctagccgttatatatatccagatcgcaccttttggccattttcacttcagttctttcatgccctaggttgttctagactctcccaagatccctttgcttcctccactcaaatctagagccattcttgtgagattgagagaatagatgagagtgtaggagtgatttggagaaggtttgaagactaggtgtgtttgagcacttggatatcttgtgggctgttacttgggcttattactcttggagatcttctcctaaacggttaggtgccacctgagagcttccaaagatcatgtggatgtctcgagaaagtttgtgaaggttttccttacctccgcaaggaaacgaggtaagtgagtaaagattcttgtgctgagatttcagaggttctcctaggtagagcaacttgcacttgtggtcttttctagaaggatttgtgagttagatcttggtggtcactcaaattctagaaaatgacctagaaatgttgagttgaaggcctcggacttcttcgaggttctttgcacgggtgaggcaagaggttaatcgagacccagctctttggagcacctcaacggagagtaggattgcaagattcgaacttcgggaaaaaatcgcctttgtcttctctgtgatgattctatgcatgttgctgtgattgtgtatttgctctttcttcctgtagtttaattcgtgcaaattagtttaagtctctgctagatcttcaattttttctgttgcccggaagttccggtggttagaacaccggaagttccggacagtctgagcagatcggaagttccggtgttccacacccggaggttccgaacctgctgaattttaccgctgtgatttgtttgtgaatttcaggaaaacctatttaccccccccccctctaggctacatctttgcgcgttcaagcaccacctacgcgctcaagatcggctcgcaccaccgctgttgccctgcctcgggcaatagtaggtacaatatcatgcaattacatttcaaatcacatgtgagacctccacgtccaagagactgatgaagcaatctccgcggcggagtcagtgttgagaccgtcctagctccggccggatggagtagttcaccatgactcttgaaaacaaaaggaaaaaaaggtcatgatgagattcacgtggcctctggtccgcgaaccaatttccttggccaagtcatgtgagacctccgcgtccaagagacctgtgaagcaatctccgtgccggagtcagcgttgagaccatcttggctccagccggacggagtagttctccacgactcttcaaaacaaaaagaaaaaaaggttatgatga

SEQ ID NO: 57755 - DNA, 955 bp, Oryza sativa
gattggttgcatgccgtggggaaaaagctagacacggtgcagtgcagcgatgaggagaaagtcatcttcgccgcccaccagctgcaggggcccgcatctctatggtgggaccatttccaggctacgcagccagaggggcaacctattacttgggcccgcttcaccgccgctttccggagaacccatgtgcccgccggagtcatggcccttaagaaaagggaattccgagagttgaagcaaggcaaccgcttcgtgatggagtatttgcatgagttcaacaatctggcccgttacgccccggaggatgtgcgggaagatgaggagaagcaagagaagttcttggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatcccgggggatcctcttcgcagcagcaacaacagcagcagcaaccccgctccgcgccccgacctcaattcgtggtgcgcgtctcacagccgcagcaacagcagagtcagcaagggactcgtgcgccccgtcctcctacgccagccgtgcagcctggacaaggccgcagggatgctcaaggacaacaacgtctgtgcttcaattgctttgagcccgggcactttgcggataaatgcccaaagccgaggcgccagcaaggccaagcgcctccccgccccaacaacggtggtaaggatgtcattccgggtcgtgtgaaccacgtgactgccgaggatgtgctgacgactccggacgtcatcgtgagtacgttcctcattcattctattcctgctaccattttgttcgactctggagcttcccactcgttta

SEQ ID NO: 57756 - DNA, 1777 bp, Oryza sativa
tagggtgcgtgctcatgcaggacggtcacgtggtagcctatgcctcacgtcagctatggcctcatgaaggcaactaccctacccatgacttggagttagccgcggtggttcatgctctaaaaatctggcggcactatctcattgggaatcgctgtgaaatatataccgatcataagagtttgaaatacatcttcacccagtcggatctgaatcttcggcaaaggagatggttagaactcatcaaggattatgatgtgggaattcactatcatcctggtaaggccaacgtggttgccgacgctctaagtcgaaagagccattgcaacactcttaacgtccgtggcattccacccgaacttaatcaacagatggaagccctgaacctaagcatagttggtcgtggattcttagctgcgttagaagccaagcctaccttgctcgatcaaatccgcgaggctcagaagaatgatccggacatgcatggactcctcaagaatatgaaacagggtaaagccgctggtttcacagaggatgaacacggaaccctatgaaacggaaagcgggtatgcgttccagataacagagaacttaaacagctgatacttcaggaagctcatgaaagtccttattccatccaccctggcagtacgaagatgtacttagacttgaaggagaaatactggtgggttagcatgaagcgggaaattgcagagtttgtggccctatgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaagctagccgagctctacttcgctaggatcgtgagtctccatggcgttcccaagaaaatcgtatctgataggggaagccaattcacctctcacttttggaagaagctccaagaagagctgggtacccgattaaatttcagcaccgcctatcacccgcagacagatggacagaccgagcgtctaaatcagatcctagaagatatgctccgcgcatgtgtcctagatattgggaagacctgggataaaagtctcccctatgccgagttctcctacaataacagttaacaagccagcatacaaatggcaccttatgaagcgttgtagaggcagcaaatgccggacaccgctcttgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacctggaattcgcagtgggtgattttgtataccttcgggtcacgccattgcgaggtgtgcacaggtttcagacaaaagggaagctcgcacctcggtatgtgggtcctttccgtatcaatgctcggcgcggagaagtcgcttaccagctggagctgcccgcctccttgggcaacatgcatgatgtgtttcatgtgtcgcaacacaagaaatgccttcgagtgccatccgagcaggccgactcagagcaaattgaagttcgcgaagatttgacctacgtggagaggccagtgaaaatcctggacaccatggagcgcaggaccaggaaccgggtaattcgtttttgcaagg

SEQ ID NO: 57757 - DNA, 5591 bp, Oryza sativa
attgactcttcagtcacctttggtatggctatgcacttctataatctataacatcgaggggcccagagatatctctccataggaggggaaaatcccatctttattattcatatcccactacatgtttcgtagcatacccgaagaatacttttataactacccaattacggagcatgctgcgtttagcagttactaagtaagctactacacatgttgggagtcatgataatctaagatctaaggactcaacaccaatactaaatgaaatcattgatgacacggcacatatggctcttgcactgtctcatgttggggctatccaataacatattccccaacatgtgtccatattattaatttaatatctcaataccatgatccatgagacatgatcatcaattaatacatgtgttgatcatttaaacatatttgttccatatatgatatttgatcagcgatcctttataaatagtaacatacaacataaagattctcatgaaagaatcacatattcattaaccaataatgaattatctatttcaaaaaacaatgtcggataaatatgtaaacatagtatgtcatacaatcacttttctccatggtaatgcgcatgactagtaaaaagaaagaaacattatacctacccgcacaatggttgttagagtagtgtgtagaattaataaatgattggctggagtgtccatgtactactaatcaaaagtctacttcgaaggagagatttaattggtttctagttatctaatttaatttaataattcactaatacactgcgtcacatatgtaacgtccttatacatgcatgttcgcttaaaaccagacatcatatattaaaaaaaaataaagcctaaaattgcacactcctaagtctaaaattgtacttggtatgcgtgtgtatgtttaccttttttaacagtacttatgatgttagatatggctttactttatttttatctaagattgaactttttgtaactagttttgtaaaggttatgagctgtaatttttgttattatttctatatgttaaaatatattgttcatccttttcgataagaaaaaaaagatgaagcaattgaaatcattgaatgtcatgtgtgagaatcacctagacagtcctaaaactaaaaacactactttacattgtgaaatggagcgagcatatataattaattggatctatgaacaatataattagatctgccttttgacgttaccttgtcacaaattatggtgcaaatatacggatcgagctacaaagcactactgtccgtctgccatccctgaccatttctttattgtccttagccggctggtgacatatttggtgacgcctaacaacaaattcaggtgatcaccctactgttcatcaagacactttagcagcacacactacagtgcaatggcgctgcatcttctctcactacgggagaaaccatctttggtcggtcaatcaaattccacaatagttccggatgcaataaaaaccgggactaacgatattctttagtctcgatcaaaaggttagagctactttttttataccaatcaagactaaagatcaatttttagtcccggttaaaaaacggtaggcggtgtcagacccctctattatctttagtccactaaagatctatttctagtctcggttgctaaacaaccagaaaaaaagattggcatgcgcggagaggaccaggcatgcgcgcgtgatcgaggaggaggcgcatgggatcagttaataagttagtctccttctcctccctcacatttatctcctcctctcctcactcaccccatcttttcctcttcctcctccggatccgccccctcccctctcctccccctcctcctcacatatcaggcggccgggcggtgatggcggtggcctcgcgtggcagcggccgggcggcggcggaggcagcctcgcgcggtggatccaggaggggaggcggccagaccacccccggcagctgcaggcggcggccggcacggaggcgcgcggcggcaagcggtggaggccggcgcggctacacggatttttttcttttttccttcttaaagtgtgattcgatctgtgttgagaatgaactatattgttctgaatgatttatgttgaactatgttgctgtgaatgatttgatataatgggcgtgagatatacaaaatagcaaaaaaaaaaaaagaaaaaaaacttggtcccaggtatttgaacttcgtagtccaggggttaccaaccgggactaaagatcgatctttagtgtcaagtatttaaaccttcgtagtctcgattggaaaaccgggactacagggggttaccaactgggaatacaaagcatttctccaccagtgtatgagaatgatcttttcttccgtggaattgctgtatatctgtcgacagatttcgatttcttcaccgtcaaaatgttctgaacactaaaattaatatatcttcctggcccatgcacatggataggatgtaaaagcacaaaaaaatgagtttgaaaagaaagtataatatatactcgctccacttttttaatgttggaccttaatttgtatatatatttaaccatttatctttttagaaactcacataattattatttattttgatatgatctagtttatttttaaaggtgctttaagcttggcttacaatttttacgtaattgtataaaagttttaaataaaatagcagttaaatgaatgaacaacagtcaaactgaagggagtatatcacagtccgcataggcagaaacaagtgctcaagttttcaacaaacttggatgtgttaatatgcagatgggggagctgaagaaactggttgaagagggaaagataaagtacattggactgtctgaagcgtcggcatcaacaatcagaagagcacacgcagtgcatcccatcacagctgtccagcttgagtggtctctgtggtcaagagatgctgaagaagacataatcccaacttgcaggtcaacataacaaacaatatatattaatctgcccagagtgaattttcataatattttcaattggacatatgtttctgaacatttcagggaactcggcattggaattgtcggctttttgtccagtggcccaaaaatagtaggcacaatgtccgaactagagatgaaaacggatcgaatacgctcggaaactagctctatcatattcgttttcatattttttctcgaaatcaaaatcggaatcggaaacccggatacgaaaacagaatcgaatattatcgaatacaaatacgaagcgaatatgaatcgaaacgaatacggtaatgtataattatcaaaatatcaagacccctcaaaataagcttcttaaaacgaggaagagatgtagccattagttttcaaaaacaaaacatcagtattctcaaattttatcagtattcttaaatgttatgtttattttccatacaaatttatgttatcatgaaacaaataaattaatgtgtatagctgaaattttcgtaagcacattgaaatttttgaaaattggttgaatattttaaattttgggttgaacatttcaattgaaagtttttaaaaatttgagtggttctttttcagaattgaatttttttatttgtttgtttgtggaccatttaaggacccgcatggaaaaatcaatttttccatacggatgacttaagaagccgtatgcaaaaataaaatttgaaaatttgaaactaatttatctcactcatatgaactccaaattggatgatttttttttcctaaatgtttttaaaatcatgctctatcatgttattgtgttcttactgctattattttggcaatttttttcttgtgactttattttatcaattaaaattttgaatttcaaaacttcaaataatattttgaagctgtaattaatttcagctgaaaaagtcatgaacataaaagttatagagctcatcaagacatacaacttttattttggtcatttcttcatccgataaagtgatagtagtattattcaaaaagtttacacatctctcttatagtttatagaaacaaatgagatagatgtaaattttatgaacaatgttactatcactttgtcggatgaaaaaatgaccaaaataaaagttatagatcttgatgagttatacaactttattgttgatgactttttcagttgaaatcatttagtatttcaaaatattgtttgaagttgtcatattttgaaattcaaattcaaacggttcaaacaaagtcatatagaaaaatgaccaaaacaaaagttgtagatgttgatgcgttatacaactttattgttgaaaattttttcatttgaaatcatttactacccgaaaaattatttgaatttcttatatttttaaattcaaattttatatggtttaatcaaactcggatggagaaatgaccaaaataaaaatgatagatctcaataagttatacaactttgtttttaacaacttttttcatatgagttgatttagtgcctttaaattcgttttaaagagccacatgtaaaatgaaaattgatttttacattaaaaaaatccaccattttcttcaccccaaccttatcctcttgactcttcctctcctctctctcacacacacactttctactctctctctctcacttcctctcatccacagggcgcaggtcgggtcgggcggcggccggccgagagcggtgcggagcggggcaggcggccggccgaatcggaaaattggtccggacagacggaaagtatccgaaccactttcatccctagtccgaacaagattaccggaaggtttcttttgcccatatatattttctctccgtgtttttaatagatgacgccgttgacttttatacatatatttgactattcattttatttaaaaattttatgtaaatgtataagatataaataaaactttaagcaaatgtataagatataaattatgcttaaatactttgtgtgataaaacaactcacaacaaaataaagtataatcagttaaattttttgaataagacaaatgaacaaacgtatgataaaaagttaacggcatcatgtattaaaacacggaggtagtatataacaatccatttgaccaccgtcatctctcttaaatcaatcatgacactatccaaaatttgcaaactcaatgaatggccattttctgtttcttccaggatctaccaagattccagccggagaacatggagaagaacacggtgatcttcgagcgggtgagcgtgatggcgacgaggaagggctgcacggcgtcgcagctggcgctggcgtgggtgcatcatcaggggagcgacgtctgcccgatcccgggcaccagcaccaccaagggtggccaacttcgaccagaacgtggcggcgctgggcgtgcgcctcgcggcggaggagatggccgagctcgagtcgttggcggcggcggacgtgctgcgcggggacaggtaccacgccagcttcctcaccacctagagggactccgagacaccgccattgtcgtcctggaaggaataagattgaatgataactacacaagtgtggctatgcctccattatcct

SEQ ID NO: 57758 - DNA, 1390 bp, Oryza sativa
ccatgtattcaataaggcagtaaatgaaatgaattgaatttgattcctctcctgttgttcttcttcttcctttgtctccttctattctgcactagattccccagtctctttccatattatattgagttctcattgtattcgatcttgtggtagtttgtgtgattcgatctctcacgaacttgggtcataacaattggtatcaaagccgttccgatccatcgtctcttggtctgagcagtagatccaagcaaggttggtgtttatccttagcgccgtgattctgttccatggtttgagcagcgagaagatgagtgaagacggtggttgtcatgctcatggagacggtcatgtatgctttgaacaacacggcaagcaccacaaagggtaacaattttggtgaagctttgaaaagttagatgtcatgcttcacaaaggaggccatgtatgctcgaattttggtgaagctttgaaaagttagatgtcaatttggaccataccctcggttgtgcatcctcttccccagccggcctccgatgtaaattaatgcttcaccagcatcctcggatatcaccagtaatgtgaatggttgcaggagaaagaaagattgaggagattcagagagaatatgatttaggggggcaacgtagatatttcacgtcatccgttcacactgggacacctaagaaaacaatattaagaatttagaggttatatctccattgacaaaaacatctaaggccaaacctaaaaatggacattttcaaaagttgtcggtttttattgcgacaactagtggaaattcccccttggctacaacatttccactgttctcttttttttcttcttctttcctctctggctcagcttgctcggcacatctgttattttaatattttttaattcccagcttgcatcagtaaccacggcagcaacaaacgaagagtagaccaggcagcaggcagcagagcacaaagcagcagcagtagaaaatagcaagcaggagcagggatgggcagagcaaaagctagcgggggtggaagccagctagagcagatcgatccatctctttacgcctcttttttatccgttctccctttatttatttttgagagtgaatcgaacattagtctagatatcttaaccatgtactttcgtatcggatcagggacagtggcggacctaagatttttttatcttgggtgtgcccacgtaaaccttagtatacaaattgagtatttcattaaggttttaatctgaagatagaacggtactagagaggtgaaaaactacttgatgaccttatctaggctatgtttagttccacgataaaattgaaaatttaaagaaattaaaacgatgtgacgaaaaaattaaaagtttatgtgtgtag

SEQ ID NO: 57759 - DNA, 2216 bp, Oryza sativa
ttggcatacacaagaagatattacgttttagattgcttcagcatgaaagagtaatatgatctagttattttgttgacagatatgtcgaacaaacaaatattccaagtttaccatggaccaggaaacgtccgttacgggccaactggggtagatctgtcagattttattgtattagaaaggggaattgatagaccggctgagagaagtgtaccttctataaaaggatggttaatgaggggcttgagagttgatccacagacaagtgacatatcaatcaatattatagtaagtcgggcaactgagggtttttattgggaactaatgccagttcaaaactctcgagtgtggaaatggtatgtggaaaatgcattgcaacgcgggtggcctttagctatggttccgtttgttcacccgaaggatccaggtgtgcagatgaacatggatgatggcgagggaccaagtgctgaagtaaatgagacttctgtggaggaggtcaacgcacgagaggatgggggcgtagtagctccagtaggcattcaaccaggtggagtggccgacgagggggagactgtcggtgccattgtggatgaaatagacagggaggattctgacaacgagcgtgtagagaaaggtgattcgtcagatgatgagacggatattaatccagcagaatgggctagtgaggatttttctgagatggtcgtctctgaagaggatagtgtgagatgggagtacaaagaaaatgaggttattcagggagcgatttatagtagagcagaagatatgaaggaggcggtaaaacattttgcagtgtcaattcatagagagttttgggttgccaagtccaaccggtcgcaatatgaagttcggtgtgttaaggaaaaagatggttgtccctggagagtgcacgcgtataaggggaaatggaaggattattggacagtgtcagtcgttaccaagcatacatgttttctacctggtgtttagaaataccacaggaacattacatgtgcatttgttgcaactgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaaggtggcattcatgaactgtcgtcctgttctctgcattgatgggacattcttgacaggaaagtattggggccagatactaacagcaataggggtagatgggaacaatcaggtattgcccttggcatttgcttttgttgagagtgagaataccgacagctggtactgattcctgaaattagttaaaacaaaagttgttggtatgaggccaaatgtgtgcctgatacatgataggcacgctagcattctacgagcgatagaagagttgcagtttgggagtatggaacgaggataccctggtgtttgggaagatgtacagagtaggtggtgcatgcgtcatatgggagctaatttgttcaagcaattcaagaacaaggagcccatgaacatgttcaagaggctatgcaatcagaaccaggagaaaaaattcaatgagctttggaagagattagatgagttgacagccaaatgtagtgatcagcgtgcaacggctccatcgaccgccgttgctgaccctcctgaagctcttggacctctcccaatgaatagtccaacattggttagaagaactggattggagattcggaaattttctcagtggattcttgtaacgccccgattttcgttcgggattaaaaatcatttaatgatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaagaaaacaaataaaaacctccctcctctctttgggcccc

SEQ ID NO: 57760 - DNA, 6935 bp, Oryza sativa
atggaccgatgaagtttcagtcttcaaagtcagggcatctgtaaatccgagaaatgttggtcatttttttcaaggacaatagttcaaaagttctcagtcaggcgaaagtaagactacccactgtaaggggggtaggtctcagagatgagttttggtttacctcgtcggcatttcacttgaatgttcaacccagtgcagcaatttggttagtaattaaaggagtccgttgcgagccactagcagagtctcccaatctcaagtcaacaggttcaattctaatgtacacccttgaggccaggtcaacagttcagcttagagaagtagcatcgaggatggttgcagttcagacgaaagacaggtcaagcaggttttcctggaattacttgttatttgaattgggaccagtcgaagcggacatagggtaaatgatttataaatgccagattccattttcatcctcttatagccagcgtggtgaattctcaggttaccaaaattgctaacctcaacagttcagtccaaactaagtaagtttcaggagcatccgcagtcctagactgggtcagttcaagcagaaccagtcggtccagttttggcaaagcaaaggaacagaaaggtcgaatccagccagttcaatcgtgcaggtttgatcaaccagtcaatcaatcagttcgaagcagaatgtggcagttcaaggtgcagatcagtcagaccgcccatctgcaccggctttctttctagccatcccagaatctcgggacgagattcctgtaaggggggtagatttgtaacgccccgattttcgttcgggattaaaaatcatttaatgatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaagaaaacaaataaaaacctccctcctctctttgggcccctttcggcccaattccccccccctctctccctctcgggccggccttctccctcggcccgctcggctctctctctccctcaagtctgctttgcctccccgtcaacccgaggccccacctgtcatcttctcccccaaccgtctcctcctctctccttccccccgagccaccgacaggtgggccccaccagtcagggccatccctaacctccggctccctcagccgaaaccgccgccacggcctccccacgtcgccgccgattccgcctcctcctccacccgcgcgctcgccccgaccgcgggaccgcgtcaccccacctcctccactctcctcccccacttttccccccctccaaaaccggcgccgaaccaccccactcgcccacgtcgccggcgcctcttcccccttcaaatccgcctctcccggccacgttctccccctccaggacctatataaacgactcacgtgcctcccttcatccgttttcccctctccccgagcaccccgcgccccctagacacctccccaccgtgctccctctagccgccgctcgccggcgatctccagccgcccgccaccgccgctcccgtcgctgccgcgctgcgccgcagccacctatagcatcacagcgccccaccgcaccccggcattcactccatctccctcctccaccgccggaaccaccctcccatcgcgaggccgagccactaccgccacacaccgccttcagccggccgttgccgccgcgttagtcgtcgctgcacctcgccgcttgcgccgtcggcaacgccgtgccaagctctaccccggcctccgctccgttttcccaaatcgccaccgtaaccacacctcccccgtcaacccgagccaccaccaccactggccgactccagccgcgtcgcaccgctgctacagtcattgcagacccacgccgttgcctccctcggctccacaaggacgaggagaacctcggccatctcttcccatcgccggaaactcactggacgtccagattcccgtgcgccggtgagcccttcctcccttcccttcctctccagccggccatgtcgccgctccgtcctccctaacacctcccctcccatcctagggtgcagctgccgctcatccgcctcttcccgagcgccgcccgtcgtcggagcgtcgttgtttccgtccgtcccgagctctgccgtcaccgcctcgcgttgccatctcgccgccggccacctccttccgtcgtatgctactcggtgagctccccctcccttttcccgccgcactccgccgctccccggtcggccggtcggcgagccggctcgcgcccgcctgaggccgcccgatgcacctcgagtgaatctgggccgtccacgtggccgttcggcgccgcccgcgtcggtgccctcgtggcgccacgtcggcgccacctctgccgcatgtccgccgtggccgccacgtggccgtccacgtggtgcgcccgcgcctgtgccgcggtggaccgagtccaccgtgggccgcccccttggctcgctgacgtgtggggcccgcctgtcggcgccggccctttgctgacgtcagcacttgtcatttcctttgagaaattaattattaattgcgcaataattcggtttaattctagaaattcatttaaatggctcaaaatttctaaaatccatatctaattcattcgaactccgaattgagccattcaacttgcaaaattcatctaaaattgagctctacatgtttgtttagtttttatgtcctgtttccttggtttttattagagttttttctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataactgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccacggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacagttttactgttttgctcaataaaatgttttacaaccgtctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgcggttgatcggcttccggattcaccgcggcacgaaagggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccacggttatgggcggtcgaccagattcaccgtgattagtctcacacttaataaatcgacctaatacactgtagtttagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaattctgcatgaaccaaaagagaaatgggccaaggcgtatgacacaggtggtgcatcatatggaataatgacaacaaatttggcagaagtttacaactgggtgatgcacggtgttcgtggactgccactagttggcatagtggagttcattttacatgggacatgcagatattttagggatcggttccaggcaattcttccctctatgccgaacaacagcattttgtttggaactttcatgcagaaaaagctagaggagttgcgtaaaaaggccatgaaacatcgagctctagtgcaaggtactcaacaacaaaggtttgagatactttgtcaagataaggcaggcaggggtatctaccgcaagagagtgaagcaggagtgtgttctcaaagccaacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcagcgagatttatgggttcggcatagctggggagttcacagagactaacgatgaagtactcaatattcctgacccatcgaagctccgaggcaaggctagaaggaggaggactcgtcgcatccgcaacgatatggatgagtcggatgctggtagggtgaagcattgcagcaaatgcgatgaacgtgggcacacctacaagcattgtcctaaagacaaggagaaaccaaatgcggcggaggcaggactatcaggatcagcagtagatggagctcgccctacgggtgaagacactacctacactcgaccacgtcctaggcgtcgtcgtgccacatctggctacgtggtgtagttcttatgttctatgttggcatgtggctttgcttgtaatttgtttcgaacttattgatgtgtttatgtttcgtcatgtaatgtcagacttcggcatgtcatgtctttaggtctcgtgatgtaacgtcagactaaggcacctagtgtgtttaggtatgctgatgtaatgtcggacttcgatacgtaatgctatgttatgttatgttatattatcgaactctacatatatgttaaattgcacgtcatcgttatgtacccttagtaacgtttgctatatttaaatagcctgtactcttgttgtacataattattctcatgattttattactatttcataattttacaacttatcttttgttttacattactactttttgaattgttctaacacgaaacactatatttttcagagatggcacgtcaggatacacctcagttgttggacccggcgatagatcaccgacaccggtctcaccttactgcggtacagggggctcagattgggacgttccgggcacggacgtgcggtgagctacttacggttcacgactcctttgtcgagaggtacaaacagtgtattactataaattagttgcgctgtaataattattataatgacatgttaatttgttattgcaggttgcgtgaggccggcctcctaccgatgtgtcggctggtggaggctgccgccggcgacgtggacccggccagacgatggactgtggaccggtccctcctagcagctttggtcgaccgatggaggccagagacgcacacttttcacttgccgtgcggtgaggtagcccctaccctacaggacatatcgtacttgttggggctaccgctcgcgggagacgctgttaggccagtgaccacgggtgtggactggcaggacgatcttacggcacgtttcgcactagtacagcgcgcaccgcatctcccgctcgagccgttggcacaccaccgcaacaccggacctacgaagaggtggctgcttcagttcaccgtgagtgtttttgtaccgaaatgacaaccg

SEQ ID NO: 57761 - DNA, 1932 bp, Oryza sativa
tattccatttctccactctagtttggtagtagttgagcaacatcccctgaagatcaacagatgataaccaaacagataatgatttaggatcacaaataactagattgctttccttgctatcaagtgatgtcaaactgacctggaaagtcagatcccaaaacttctgcattttttgctcaaagcaagtgcaagtttcagtaatcatcattttcttttgctcattccaaggaattatacttgcagcagaatcagtagtgcaacatttcccttctctaacttccagcaaacaaactaatggcagccaaggtggcatgacaaatagtctgagcttgtcaacatgttttcctttgaaggaaaagttcacagaaccaaattgcccagtactgctcagctccacaaccatcactcttgcaagaagtaagtgactccaacttaagtagcagttgccctttctttccatttcaacaaaagatagccccaaaagtaaatattcaggttcaccagcagcatagataccttccttgctagtggctgctataaggttgatcaaaaaggacaactcacttttcactccaacattgaatttcagcttattgctccacaaaatttacctccaatgaaaataatgttgtgggaaccaatcatccatccatattaatattttgcgaaggtggacctttccatcacctggatcccactctagtggcccaaacatgacatgtataatgttcagcgagtttaccaatgaaaattgcttgcccacaaagagttgaaaccatttcgcttcggttggagggggccaaggtggcagtatatgtactttacaacagctgcagttgaatgccagccatgacattaactgtgactccaatatgatcaactcttgatcccttgatgttatgggtggccatggatcaacctcaaagtgttgcaacagcagttgccatggaactaacaaatgtccttcaactgattccactaacactggggtgcttaagaaggacaaataagacacaacttgagagttgttagacccagaacatttcgctgaatacctggtgggcatcaatgtgtaatgcttgatgtcggcgatcatccttggtgagaaggcgctcaatgatgcaatggatgctggaacggtctcaagtacaaccgtcttggtcaggaacgcgatgtcggctttgttggcgtcccacttgacatcgaagcccaacatcgaacacttggcgtgcgtctccttggaatagtcagtggtgggaattttggtggtgctggttgcaccattatcagctaccaacttcatggaggccatggcagtggcggcacatttgaccatcgcaaccagtgtgagtttgggctcgatgtcgggactagagcatttcgtcaaacatgtggtgggcgtcacctttgactgctctttcttaattgacgctggcaagtcttttgccttcttcccaacttccggtgtgcatgcttcaaccacatctatgagagaccgtatatcagctctagttctccgatcagcctcctctcgcctcagctcgtactcctctatccgcctcaacagcaagtccaatttgtcttctattgccatggcaccctacttgatgagaactttctcaactagaccaagagctagatgggggaaaccaggctggctctgataccagattgttaggaacccactacttccagctcaacaactagcatccaccatagaagcaacaactgctttggggacaagagaagacgacggcgacattttggcaatcttcggcgaaggaaaaccgatggccgggcttcagcttggcgctgcgatgctgaggaagacgacggcgaaaaccgaccaccacggagtcatcgacagggctcgaccggaggtggagtagatcggcttcacgtcgatgaggggattccaatgggtttcagctt

SEQ ID NO: 57762 - DNA, 999 bp, Oryza sativa
ctactttggtttgagggttatgacaggttgtcataagaaactcgtcaacccagggtaactttgcgatgcatcatatcgggagggcatagctgtcacgccctgaagtacccctcccttgctctaaattcataaaataaatcgttcgaagaaattgtttaatttaacctagagagaaaccctaaattaataaatgcaaataataatcggaatcggcatgtggaatttttcttgggttctacatgtcaaaatacgctaacaggatttttagtggaattttcagagcattggaaataattttaaccaattaaaataagcaaagtgcaatattaaatccctgggaaaatcctttttcctttttatccttcctttttccccctcttttcctcctttgggccgccggcccatctctcccgccccctcccgaagtccaggtcgcctccccctcactccctcgggcgctgacaggtggggcccacctgtcagcaccttccccaacctccagccggagggacggcctccctcctccctaccgccccgcgctccctgccgccccgggccacgtcgcccactcccccgcgcgcccgcactccccgcgcccacgccccactcccgctcaccccgcgcccgcgagatggccgggattcaaatttgaatcccgcctctctctctctcctcctccacctcctccactactccggcgaaattgcgccattcccggccacgactcgccgcctcccctcctatttaagcacgcccgcaccttcctctctctttttcctttctcggccgagccctcccgagccctccatcactcccgcaccgctacacccgccgccgccgccttttccactcctccggtcgccgctcgccgccgctggagccgccgccgagccaatctgccgccgccattagcttcgccgccgccaaagctaccccggccgccgcatccccatccaatcccgccgtcgggacccgcttctccccgcgcgccggtgagta

SEQ ID NO: 57763 - DNA, 936 bp, Oryza sativa
cgagaaagaacacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctgaacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctaggtccttcttcagctgcagattctcctgacgcggctccaggatcttcatgttgttctcgaccatcccacggcgcaccatctgatggaagtcgatacaagtcgcgtcgtacgcctccaccatgcgcgccaggtgcatgatggtagcgtcatcctccgagctagcatcccggaaggtggcgaagtcgcgggctcctccgtggcgagggtggtagcggtagggcgagtgctgcaactcgtccgggtagcgctggtgaagagtgacgatggcgaggagagcgtcgttctggcaagcggcggggaaggaatccccacccgcggtgactgccagcgaagtccgctcgggatagccagagaggatcactgcagtgacctcccaaccagcgtggggctccgcgtcgtcaccctcctgctccggaagcggcctggcctggtagtccactccatgtgggtaccccaagaccacgcatatgccccgcagctccaagacgaagccagtcatgtccaaaccacgacgggtgacgctgccggccatctacaaacaaaaacaaaaagaaaaacaacattttaaaggtcagattttggcgataaatgaagcagcaagacagagagagactagacag

SEQ ID NO: 57764 - DNA, 704 bp, Oryza sativa
atcatgtgtaccttcgtgtcacgcctcttcggggagttcatcgttttcacaccaaaggaaaattggcaccgcattttgtgggacctaataagattgtcagtagaagaggagaggtcgcctatcagttggagttacctcaatccttggcagatgttcataatgtgtttcatatgtcacagttgaaaaggtgtttaagggtacccactgaagaagccaatcttgagtagatagaaatccaagaggatctgacatatgttgagaaaccaatccgtatcctggagacagatgagagaagaaccaggaatcgagttatccgtttttgcaaggtccaatggagtaatcactcagaagaagaagctacttggaaacgagaagatgaattaaagtcagctcataagcatcttttcgccagctcttccgaatctcgagaacgagattctgtttaaggggggtaggtttgtcacactctaaaaatcctgaatttataaattgttgtttaaatggaattattagaaatgatttaaaaagcctagaagaaaagatctaattttaaataataaattccaatataaaagtgggctagataaaattttattaaatacttctatagttcctagatttttctggaatttatttgggccaaggaaatatttttaataaatggaattgcatttcatgaataatttaaaaaagaaaaaggtttt

SEQ ID NO: 57765 - DNA, 3064 bp, Oryza sativa
ccagactttaagaaatggcttggagccatgaaatccgaaatacaatgaatggatgacaatcaagtttggaacttggttgatccacctaatggtgtaaaagccattgagtgcaaatgggtctttaagaaaaagacagacgtagatggaaatgttcacatctacaaggcacgattggtggctgtcacaccctaaaaatcctgaatttataaattgttgtttaaatagaattattagaaatgatttaaaagcctagaagaaaagatctaattttaaataataaattccaatataaaagtgggccagataaaattttattaaatacttctatagttccaagatttttcaggaatttatttgagtcaaggaagtatttttaataaatggaattgcatttcatgaataatttaaaaaagaaaaaggttttaaaaatcctcttttcgctttgggccgaaagtcggcccaattctctccctctctctcctcggcctgcttgcacccggcccaaccagcccaccgagtcgagccgccgctcactctcctctctcccgctgacaggtggggccgtgatcttcctcgcgccgcccagccgcgccctagccgcgcaagccggcgccgcccccttccaaaattcgcccgcatctttccatctccgatcaaatcaatagaggggaaatgatcctcgggatcccctcttccttttctcttttggaatcttcggctaatttcgtttggaaatcgttggattcgagctcgattcggattcgttttttcctcctaaccctagaccttccatcgccgttgttggccgccgtgggcctacatcgccgctcctagcccctatataaggacactcgggacctcctcttttcgtcgccaccctcgcctcagctcgccgccgcttgtagcgccgcctccacgacaacccgtgcgccgctgtcgccgccgcgagtccagccgtgcgccgccgccgctctggtcgtcgtcgtcgctcgggaaggccactgttgggttcgccaagtcgtcgccgtcctcgtcctaccctccgtttccaccgaggatcgccggagcaccgccgtcgtcgtcgacccgaacgcctccgcagcttcgacctcgtcgccgtcgctgtccgttgccgtccgccgtcgtccaagccctcagtgagttcgccgcgtcgccctctacgtgtaggtgccctccgtttgcgccgccgcgccatcgttcgccggcgagcgtgagttgccgagccgccgccggtgatgacgtcatcgctgacgtcagcgccgtgtcatccgtagacccgtggtggattagatcgatctcggccgttcgttttgtctagattagatctcggccgttcgttccgtacaccgtccccgtgcacccggtccaccatgaacccgagcccgctgacgcaataaatcatttttccttttcaaaaataattctttattccgtcataattcaattaaaatctaaataattgatttaatccgatttaatctttaaaaactcataactaattcatcttagctcggatttagttggttcaagtctctaaatttttctaaaattgagatctacaggttaaaagtatccacatgtactgttcatgattgtttatgtgctgttttggtgattttgctcttttatgcttcgattccgacgttcctggagagtccgattttgcaggagaagactttgaagagttccaaggccaacaaggcaagtcacacatatcccaaacaatcctttgagcatgttgatcccgtttaaagctattgtttctattcaactactgcatttattttcgaatgtcattgggtgggaataacctattgcctttgttatactttgtcgtttgattaataattggattagctagaacattatatagttttagctaaaagtgcataggatgcttagccatgcttagagacattagctcatataaatgggataacttatgattcactattatttaatgatggcttaatgatagctcacgatggttaatcgtgattggttaattaattaatttgccaactaaaacttgataatggtgggttgtgagcgcatggttttgatggtcgtgctcatgacaattaaggaccggttcacgattttcggttgtgaaacattaaccgtgccaaccacaagccagcgtgggcaacggctttactttttatatagtatggttcattctggagcaccagactgtgaagtggcggagataagcacacgggggtttctggggagtctatgccttgtttataagggggtgattatgatccaggaatagtaaactgctttgaattgtgttatgcagagggtattgtcacaatctctattcgggtacttgttaagtatcgcgacgcatggttgacatgatgttgaggttgtgtcttgtgggtacagtggtacacctctgacctgtcacgtcctgataaattcatcccaaaataaaaatcattttataaaaggaataatagaattaattacaattcgaaaagaaattggcaaacactaaaatacgtataagaaaaattcgaatgtggcccagaaaatttttgttaaattctccttggtctaaaaggagctctcaaattttacttgaattttcagagcaccggaattatatattaagcaacaacaacaattaactaaaaagaaaaactaaaaataatcctcctccctcctttgggccgagtccagcccaaagtccttcaatcctccctctgttttccctgtttctcccgggccgcccctccctcctcccctcccttcggcccagctccctcctcttctcctcctgggccgcctcggctttgcccggcccaagccgagccgcgcctcccacccgtgccgcgcatgtgcgcgcgcgtgcgcgccgttgccgcgcgttgactgcgcgcctctcgcatgggtcccgcctgccaggcgcgtccccgacctccagccgccggcctccttcctctctctctctcccgtgaaccctagcgttgttcctcctccaaatccaccccattcaagccggctttttccaaattaaatagggggaattaat

SEQ ID NO: 57766 - DNA, 2014 bp, Oryza sativa
tgagcgcatgattttgatggtcgtgctcatgacaattaaggaccggttcacgattttcagttgttaaacattaacggtgccaaccacaagccaacgtggacaacggctttactttttgtatagtatggttcattgtggagcaccagattgtgaagtggcggagataagcccacgggggtcactggggagtccatgccttgtttataagggagtgattatgatccaggaacggtgcactactttgaattgtgttatgcaaagggtattgtcacaatctctattcgggtacttgttaagtatcgcgacgcatggttgacatgatgttgaggttgtgtcttgtgagtacagtggtacacctctggccagagtaaaactattcgaatagccgtgcccgcagttatgggtgggtctaacaatgtctttcgtgattagtttcatgcctcttaccatattaaatgacgatgataataatttgtttagctcctggtttagaatggtatattcctggtttggaggtagaactgtgcagccgggtttggttgttcagaatggttgggcctatgcaacgggtatgttgtatagcgttggattaatattgtttaattaaatactttgcaattttattaaattctggagtatttattaaatgccatttatgcaaatgagactatattatgccattctttgttattccctgcatttgcatatttgctgcgtggcttgttgggtatgtcatatactcaccttttaattattcatcaaaggaagagttctacagtgatgctgaaggtgtgaaggattaggcgtagccctggtcaagctgcttgtgggatagagtcgtctgcgccgttcatcttatttttccactgcttggatttttattgtttgagaggaactatctacctctgtaatgactttatattcgcttattaattagagtaatgattgcactctattatcaatttgttattgtgtgcctcggctgattcctggacgagggtttacacacatgtaagcgtttggaattttggatagaaattccgggcgtgacaagttggtatcagagcctccttgaccctaggttatgccaaacggttacctatagaagccctctaaaaatattgaaaaagtagaactgttctcctctctttctcttttaattaaaccaagctaatggcatatgcagtttatagtccctttatttgttctcattcaaaatttactcattattttgtgttgttagtactgtacatctattactgtactaatggcccattttttatctttcttttcagcagaaattttacaacctttctttttatcatgttgcaacataatttagcatgttgattttataactctctcttttattttattttgaaacctgttattcagaagtgcaaaaaaaaatttgtgatcccgttttatactgtttcaacttatcttgcaaagattggtttactttatttatttaccttttactttgattgtctagctttattcaaattaatccaaaaacttgtgctattaattggataaatgtcttaactccctcctttcacttgtctttagatgccgcgcttcaagcctgagtacttgttcggtactgagggatttgtccaggaattgcgtacgatgtccttcgccataggatttgggactgcccctttgatgcccagattcctcacgatcgtgatgaagagaagtgccgtgtcatggtcaccttgaacagtaatcgtgaagacatcccatcggtgatgttcgaggctggagagggaaactatcctcatgcttgtcaggagatggcaaggatcgctacagtgatcagttggccgacactgagtatcgctaccatcctcgccaaccccaaggaagtgaccgtggcagctatcttgaacctgcatggattgacaatgatgctaccacatggcatttggatgagatgctgtgcgccatggatgagtcccgcgctgaggtcgtattacctgctcaagatcgtgaagactggaatcgt

SEQ ID NO: 57767 - DNA, 1821 bp, Oryza sativa
gatatggatgataaataatgacagaatatttagctttgttggcatatctgtattttcctttttctcatactcatggtttctgtattttgcttagtgtgataaatactttgtcagatatttgtcatgtcatgctcctcatacttgagtctatgatttcggttagctgtgctagccttggtacttttattccttccataaaggtgtgatcatgaatagtaatttcaagtcttggaatgttttgtgctagaatattaggggtatgaatgctgagaataaactgttgtctttaaggcagaaaatcggtgagagtggttgccagattttctgtatacaagaaaccaagaaggaacactttgagctctctgatatcaagaaatttgcccccaagcgttttgattcatttgcttttgccccctccgtgggtgctttaggtggtattctaattgtttgggtctcaagagtcttcttagggactccaaaagaagttaaccccttttttgtgaccgtggaattaacttctagattcacctctcaagtttggtccttgacatgtgtgtatggaccatgcaatggccctgaaagatcagattttgtggcctggtttaaaaaatattcagattgatgctcaacagaactagctgttcttagaggattttaatttttacatatctgtgcaggaccgaaataaaataggagctgatatgaatgatatctttattttcaatgttgtaattagttccctaggtttgcttgaaatccctttaaaagggagaaggttcacatggagtaatatgcaacaagatcctttactggaaagactgtattgggtatttacatctgcatcttggactttatctttcgccaacacaactgtcctccctttgaccaggaatatctctgatcatgttccatgtgtggtcaagattgacaaaaatccttaagtccccaatcttcagatttgaaaatttctgggtggaagctgaaggtttctttgatattgtccagcaagtttgaatgttggatcctggctttgatgctcctgcaaaatgcaattccttcaaacttaaaattctcaggaagaaactgatcctttggagtaagaacttgtccagactcatgcttctcttgacaaattgtaataaagtcgttgattttcttgatcttctagaggaagaaagatgcctttctttacttgaatagaatttcggggaggcagttaagcaccacatcttaaaacttctgggagaaagttggtattcaggaaaatttattggaaaaaaagatgtactaatataaatggatgatgctgggagaagaaaacaccaaattctttcaatccattgccacaaaaagatacaaaataaacacagtttctcaagttatggatcaaaatggtcagatagtttatttgcatgatcaaaaagcaagtcttttctatcaaagtttcgaaaacagtatgggtatctcttgctccccaagaatggtctttgatttgaatgatctctttcttcctagggcagacttggaatacttgactgatatgttttccactcaagagattgatagtctcataactttaatcccagctgataagtaccaggcccagatggtttcaatggttttttcatgacaaaatgctggcacatcattgctcattttcatgcagaagctacagacttgcaggttctcaataattcttacatcactctggtgccaaagaaacctttctccagagacagttaatgatttcaggccaatttctctaatgggttttagtcttaagtttcttaccaagttgatggctgatagattacaaggtgt

SEQ ID NO: 57768 - DNA, 738 bp, Oryza sativa
aatagctgagctaaaaaagaatatgagggtcggaaaagcccgagagttccatgaagatgagcatggcacaatctggttgggagaaagattgtgtgtgcctgacgacaaagaactgaaggatctcatactcacagaagctcatcaaacccagtattcaattcatcccggcagtactaaaatgtaccaagacctcaaagagaaattctggtgggctagcatgagaagagaaatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcagggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcaaggaagtcaattcacttcaaagttttggcagaaactgcaagaagaattggggactcgtttgaatttcagcacggcttatcatccacaaacagatggtcagaccgagcgagtaaatcaaatcttggaagatatgttgagagcttgtgcacttgactttggtggagcctgggataaaagtctaccgtatgcggaattctctta

SEQ ID NO: 57769 - DNA, 3222 bp, Oryza sativa
ttgttgttagaagtatatatacttgttttgcagtattagtatatcctttttttttaagtagtagtagtacataacttcttttttcatttagtaccactatacttaggctgcttgttgttagaagtatatatacttgttttgcagtattagtatatccttttttttaagtagtagtagtacataacttcttttttcatttagtaccactacataccactttttaatttaatgtcagtacatgtatacctttttttccggatatattatgatatcttggaatgggtatatactgattttttcttggatgaagtatatatactgatatcctccctgaatgagtatgtactgatcttcccttggaggaagtatatatactgatctctttttgagtgagtacatacttatctcttctaagagtgagtacatacggatctcctctgagaatgagtatatactgatcttttagattagtagtggtttatatttctttttaattagtaagtggtatatgcctcttcttagtcagtataatttttttttaatcagtatatactacattcctgagaagtttatatacttctgtttgatctgtatttactgcgtttctcattgaaggagtatatgctagaacgttttttagtcggtatatgctagtattttttttgtttggtcagtacgtacatactatttttacctggtagtatcaacgatcaaagaacagtacgtatataccactaagcagtgcatgctgtttaaacaaacgagcagtgtgtaatcatactgattacaataacgagtggtatgtaagatataatcgattaagaagtacagaaggttaagttataatcaactaagaagacggtaacagtacatagatacaactgagattaagaaaaagaaatcatagctacagaggaaaaactgcatcactgcatcgccatcgtcgtcagactataatcttaagctaagctaattgttacatctctaccagaaaccaaatcacaatgggagatgtgcgtacatgttcgtatctgcggtcttccaccgttgccgcgtgattcattagctgggaataactctacaaactggcatcatcgtgcatggtcgatctgtggcagccgccggccgaatcgttcgattcgtttgcctcgaccagccgtactgattttagttggaggagagttcgcgtttcttgctgcggtagtggaactgtggaagccgccgccgaccctgatactgttgccatgggaatcctgcgaaaggggagtaatggatgtaaacaaccatcaatgataattcaagcattgaaaggacgtaaatctagtcgatcggcaccatcgacggggagcacaacccaactacctgatgtcgttgctaatcccatccgtctgaggactgtatgaggaagcgggtggtcgaactggttgatggagcgcgccgtccacccgtccgtggctgccgtggcaagattgctccagttcttccaccgccggcggacttcgcgacctccaaccaagctaccgtcaaggaaccgtcgccgcctccgcctcgcgtcaaaccgcaaatgtcgcgagagctgttcgatctgttgagtactaaccggtgcgatttatataattaagcgctaattaaggatcatggattattatttacaaaaggaaaatcaaaacgggtccgttcggtgatccgctaaggagcttcatcgagatggctgtgatggacggtagatggaaccgggtgtacgtactcccgggagtacatatcattttcatatatatatatatatatatatatatatatatatatgacatatattaataatatgtatttatacatatatctatgcatatgtacatgtacaaaatagacatatatgtatatacttaacattttatgtgcatatataatatatttacactaaagtaaatgtgtacatatataaatatagatatgtattacaattcattatgtcctagctacgacttcgacgtagtcgttatctcagaagttaacgacttatgaattgtagatccgtcgtagtagaattcaccctcgggatcaaggacttgttcattgatgaatcccatgagttgttcttgaacagccgtgataaagtcctcgtgtgtgaggttgtccctcatgtgaataacctatgaatgtatgaagttaattagtaaacaagaaatcgatacatacgcaatgaaattttgaatggtttatttatacgtacatcgagttctcttgtggtgatgatttgggttgtaacgcagtggcaatactcgcatatgtagtagccgcacaagttagttccctcttcctgttttgcacactatatacatgacaaacgacgagagattttatatttgaattagagattcgatataaattttgatcatgtactcactacaaatttgaacctccggcgaagtttttctttccaagtgccacggaccaaatgacggaaccgataccaagccctacatgaagtttaaaactatatatgattcgtactagcaatagcaaaattcgtaataattaataacactggaacatatgacattacctgtttataagttcaaaaatctggtcaaaagtagactcatctttattcattgagtcatagacattgactctacattccttcaagtcgaagagtaaaaggacccagtggaatatgcaatttgtgtgagatgatatatgaaacactgtgcatctatatgtacgggaacgaaatttgttcggtagatagtaaaaactaactctgtgttgtacggcagtagtatgaacgtcttgaaatgctgctccttgaggagatggacgagattgacctctgtgggttgcggatacttggtgaccatttcgacgtttactttccgagggtcgatgaatccagtattgaaaaacccccgctgtcgagccctttgaatctccattctacaacgatgaaggaattgttatatatggtgtacatatatacaaggagctaattaaaggaacgtaagaaatataactcaatgatatgtacaaaatccatgcgctcagaatagagacgtcgagggcatctagttggtatagttcgtagatatccttgaaattgatccagagaacatcttctccttgtaagaagtcggagttcttgattctcgctccaataatctccctaccgctggcgctcatctccatgtaccattcatggaattggtacatctgtgtgggtaggga

SEQ ID NO: 57770 - DNA, 2063 bp, Oryza sativa
aggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgttgacatccatgagggcgattgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggagggggggtcgggtgtcaggttttggctcaggccaaccccgcacccccctcgggtgtgtagggttggccgggggctaccacacatgcattacattcttatttctcttttttcaacatttcaatagaagcagtttcaatttcctaaaggttgtgtctgtgctgttctttccttttgaagaatcttggcttaaaataaggtcactcgtactcaaccttgccatcgggggttcggtccggtcagctaaaatcgccaaacggggcccagaaccgagccgtgccccggggcgtggtgaactccgggggggaatcgacaaaaacccacaatcgggtcacccatacccctcggtcaccacgttcccggcctggccagtctcgacatgtggatctccccaggcactagccccgacccgagccattcgaggactgggacttgggcacgagcccttatttcaagctaagacgcaaaaggaccacggcacagatcatcctcatctcgtatgtatagcaaaataaaactaacacaaaaattttttcatcatttctgattgcagattaagttaatttgtacacaaaagaggcatgaaggccttagaagaaagaaaaagaaaaaagtaaagattggcgggggcccgggggctcattccgacgcgcccgagtcgacggcctcgtcaccaccatcgtctgcactgctggtgttgccctcctcgtcggagctgggggcgaacgcgagccgaggggccgacccctcgaagcttgcat

SEQ ID NO: 57771 - DNA, 2643 bp, Oryza sativa
ctctcccgtgacccgtagagccgtcgccaccgtgcaagccgccgccgccgtcgcttcttcgtcgccggccgtcatccgtcgtcgttcgtcgcgttggtgagtaccatcgggttcgtctcgtcgtcctctacgtgtacatgccctccttttccgcagccggccgctctatctccggcgaggtcgccatcttggttcggccatgggtgatgtcagcatgacgtcatcggtttatctttttcccgtagattaaatcttcggaaaatcataactaaataaccatagatccgtttcaggtggttcaagttgctaaatttttctaaaataaagatctacatattaaaattatccataaattgaattaaatttatttaattctttttaaatgggctttaattagatttaatcttgtaaaattcataataaattcatttgaagtcagaatgaggccgttcaagtctcataattcatctaaaattatgatctacatgtttgtttattttttatatactgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttgtttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataagggggtgattatgatccaggaacggtgcactgttttgagttgtgttgtgcaaagggtattgttacgattttcccctttgcaatgccgtggtggtatttcggggcatggcaacatgtgtggaaccgtgccttgtgggtacagtggtacacctctggccagagtaaaactattcgaatagccgtgcccgcggttatgggcgagttgagcaatgtttttcgtgattagtctcacacctctcacaataattattgatgattaactggtaataatttgcttagctcctggtttggagttagatctgttcagccgggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagcttcgctagaccgtaattccgctgcagttttcttttcttttgtaagtatgtaacgctattattgatgattctgtatattaaattgtcagtttgtgtacctcggctgattcctggacgagggttctatgcacaaattagttcggaaattactagtgaatttccgggcgtgacaagttggtatcagagccatctcgactgtaggataagccaaatggtcaaaccttaaggactaattttccgaaaacataatttgtgaaaatttctcctttcttccttatctagaattctttgcaaattgtttcattgtctactctcctctctcgttcaacttgaagtagttctgaaactagtggttgaaacctgaagacgccaatgaggtctactgatggaggttaagtaaagtggatcgaggaagaactgaagtgccaagtggtcaagatggaatgaagtttggatcctgtcttagcacctataccgccaaagtaattttgaagaatagttagtagggtagaacgtttgttgtttgctttgtgtgtaggtatggttgcattcccatcattggagaagttcattgatgagtgtgtgactatactaggttgcttgcttaatcaacttgaacaatataatggtctacacacatcagatcagtgttaacctggttaaggtcttatctttagtgtaacccctctccttctatcctttctaatctgcaacagatggtgaacactcacgctagtggaagtggaaacaataacaatgaagagaacccaacccttgctcaagtgctggctcaacagacccaattga

SEQ ID NO: 57772 - DNA, 746 bp, Oryza sativa
tccccaaccgggagtaaatatcttttcccgctatttcgaaattctttttaaacccggttagggttaagaaccgggactaaagattatagcactgcatataattttcgcttacatatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatatatatacttagcatatatatgaatgatattattatattggtaaaaactctaattaaatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgtta

SEQ ID NO: 57773 - DNA, 776 bp, Oryza sativa
ttcgctcatagtccgatagcttgatggcctccttgacaagtgcagacatacccctgaagaagttcatgacactggggtctataggaatcttcttttctggacttcgaggcttgaattgtctcttgacttctgacgcaacgtaagcgtcaagctcctcttgcgtgcaatcgtaccccgggtccttgttcttggcggcgtcaacttttgccttcttcgttgcccttgtgtgggcaggcggtggagctgggggggcctttgactttgaaggtgccggaagaggagcttgcggaggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatat

SEQ ID NO: 57774 - DNA, 1483 bp, Oryza sativa
aattacacatcaacttctacgtagctcaaattatagtccttttaggtatgacgagtaaataatttccaataggtttttatcaagctttcctagaaaacaaatacttctaaattctccactgtaacgcacggcccattcactaataactaaatattctctaaattatctttactaactgtagagcgaagatcgaaaaacatattttggtagttgtatcgtgcacatacacagatttgagattattacagtggtttgtttctgtcctaaagggcacaatcaattactttcatggtatatatttacttattatatatataaatatcaaataaatactctttttttagataaaggaaatgaataaacctggtatctacatccacaagacatgtacaaagacaaagcaaagaaagactcttactgagaaaaagctttgagctccttcaagtggacatgctgcagaaggttaaattccagctttgcaagatctaaaagaacaacaatacactcttcctcctgtccgtactccagcatgtaatgcaacatttcaactctcttgtaggttctcggtaatggtaagtgtagggcaccgttgatttgattatctagaggggccttgagcctacttccatccctcattgattcgaggtggtgccttgcaaaagacatagcttcttcaagttctggctcatcatggacaaggaggtgagctgcattgtacaaacttaataatgcccttggttcatcagctattgtattgatgaacctcccatcctctcctttgaatttttcgaatacatctgcaaggcagctaaattaaatgtggatttttccttccaaaagatactagattcccttttcatacaattttttaatacatcggatattcttgactaatttttatgtatatatatactctaatttggatttatattgaaaaattgtttgacacaaaaaataattacgaaaatgaatgaatacctacaatacaatgacttaaaattttgtgatccaaagaaaaatacaaaaatttgtatatgcaagtcatcaccaatataagaaatactcgcactattgaaaattgggcctatctgtcatgcacacagtggataaattgttactccctccgtttcatattataagtcatttgacttttttcctagtcaaacttctttaagattgaccaaatttattgaaatgaagggtgtattttgtaataaacttgtttggcattattgtagtttgtaaaatacatagtaatggttgcagtgagatatttctgaccaagttgcaattttgtgaaaattactctgcaagttatctcctatagtatttattagtacctggagatacccaaatgccatgctccctaagtaagcgaaagtggagagcaacctcgtggaggctagagctagtgaattcactttctttgatgtcacttattacattgtttatctcatcttggaaaaggtgatctattccaaga

SEQ ID NO: 57775 - DNA, 1332 bp, Oryza sativa
aaaacgcgtgaccgctccaaaacgcatgaccgacgatcctacaaaacggttgcgcgggacctcgacggtcccgcaggttcaaaattcgggagcgaggcagccagtgatttttaacgttgtttagcactatggacactgtgtagccctgtttgacacagttttgtaaggcggtaccgcaggttcaatgtgcggaactggccataaacaggtctaaacagtgatgtaaagtggcaaacagtacccgaaacattgtcaaacagtgccgactcagtaaataaatcgctggccagttcgctcccgcgttttgggaccatcgcggtcccgcgcgaccgttccgtgggacatcggtcccgtgttttagaactgcgggaccatcgcggtcccacgtttccgttcctcgaagcgggtatatttttgcaaatctcgtgcaggtatataaacgtaaattattgaaaaaatatgtatatttgtgtttttttcactttttcaaagtacataattagatatagaagtattaattatataatttgtcatgtgaatattgccgttgattttacagctaaaatatgccactcttactatagaagtcaagacttagttgaagttgttttgggaatctgcacgtcaatataccaaatgagaaacattggagggagtaattgcccatgctacaaagaactattttcatgaacaacccctatattttaataggcggcctaagtaaagacctacatatgaaaaagcgtaggctctccgatcaaggctctactgtgagagtcaattttcataggcaagcttcctaggaggcgcgtctaaaaataggattattcttttaggtgcccgtcttaaagacccggtcgataaaatcgtatttttcatagaaaatacccaaaattgtctataaaaacaatcctagttggcctcataataggaccacgtgtgaaaaggcgaagccaaaataaatacgcccatcaatctgcccgacctctagtcactctttatgtcgcatcattccgtccttattccttaattatgtcatctcatattgattgcgatgatgcttgtattggatatcaagatagggtttctagaattttattattttggatttttttttgttttttgagcaaaaatcttatgcactcgagcatcttaacgtgtcagccagtgaaaaccagttttttgtgtgtggttttgatgcctatctgggaaaattcggatcttcgtaaacaagttgcctgcgtggcctaggcagccggagcgtgtttgacgttaaacatgtgccggtattagtcccaccatttttgtttattgctcactattgaccatgca

SEQ ID NO: 57776 - DNA, 1321 bp, Oryza sativa
caaggaactggagtcgcacaagcgccgcttggcgaatttccgcaatcaacagggtgctaaccaaagggtccgctacaccaatccctatcccgggggatcctcttcgcagcagcaacaacagcagcagcaaccccgctctgcgccccgacctcaattcgtggtgcgcgtcccacagccgcagcagcagcagaatcagcaagggactcgtgcgccccgtcctcctacgccaacggtgcagcctggtcaaggccgcagggacgctcaaggtcagcagcgtctgtgcttcaactgcttcgagcccgggcactttgtggataaatgcccgaagccaaggcgccagcaaggccaagcgcctccccgctccaacaacggtgggaaggatgtcattcggggtcgtgtgaatcacgtgacggccaaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgagacgcaccgtcactctgtaccgagggccggaacaaccggttgttttctttgcacccccaacctctgtcagtagttcagaactgcattagataggactgtcagaaatccccatcgtcagggagttcggagatgtgtttccggaagaactacccggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtacatacgtccgagtacttccccctggggtgctcctgtgatttttgtggagaagaaagcaagacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgcgaagaagatattccgaagaccgcattcaccacgcgatacgggctgtatgaattcacgg

SEQ ID NO: 57777 - DNA, 6382 bp, Oryza sativa
cattttaattggccaacaatttgaaacaagtaattgatagaaagaacaaaatttaatttgacgcaaggagataaaatgcatagatggacagtgaacgatcaaaagcaaaagtggtttattcggctagattgcaacatccaggacagaggaatataaaaagatcacacattggattgcttattggtctgttctagcctaataggctctgtcacctaggattgatcactgcatctgatccaaaacctgcatacagagaacatatatatcaaattagtaatgtagtatagtgctgaaatggaattaggcccgagtgtgatttggcaacacagctgagcagtgaaacgtgtaggaactaggaagggaggcggagatgcaggagcatggcggcagggccgtgggctgcgcgcgcggtgtagacgtaggcgctggggaggcaaaaccgcactagcggtgcagcgcacagccaccgggcatgaggcgtcgccgcgtggccctcagcggccgtgggggagctcgcctactcagggttgttggtcggcggggaggcgtaggtgcagaggatggcagccaacacagattgggagaggtgtggacacgcggagcggctggccagcaaatcaccatggtgccttaccttcagattggtgcctggcttaggcctgaggggaggagcagtgcagagagaagaagagaggggatagagtttcgttggagaagaaaacccacccacgagctctttgttggagaatggagagagaggagatagagtttttcacgggcagttagattttcttggagggataaaatggagggaataaatggcgcgacaacgaaagacgtgagaaaaaaaatattgagaccgaaaatactggagggagagcaaaataatttaagctcatttttttcgaaggaaagatttggaaaataacgtgagactgaaaaaaaaaaagagggaaagaacggagcgagagcaaacgttctgtcggagataaaaataatgttaaattctgactgagtagatttaagctcaatttttcggagggaatgatttggaataagactgaaaaaagagggaaagaatggagggagagcaaaataatttgcgcaaatacacaaaatgttaaattcacatcaagtaaatttaagctcgatttttttagggcagatttaacctccagttatctaatctagttcagctaatttatttttgtgcggatcaataagaactagttataaaacttcataaatgcactagtaaaaattattttctactaatacaaaccgcgtcgttgccgactcggtcctgagagaccggataaaatccaaaagtaacatattgttttcttaaaatagtagttagttaatttatcttagcacgaccgaaaaatcacgtgttttttcattgtagacccggtctagaaagactggatgaaatccagacgtaacatattgctgtcttaataaaaaagtagttagttaatttatcctagtacgaaaaaaaaccactttattttacattgttgactcggcccagaacatatttttgtcttaaaatagtagttattcaatttatcttagcacgaccgaaaaaacgtttttttttgtcaatctggtccggacagaccggatgaaatcaagacgtaacaattttttgtcctaaaataatcattatttaatttatcttagcacgaccgaaaaagcatgcgttttttcgtcatcgacctggtccggacatacctcatgaaaaacagacgtaatatacttttggtcttaaaaatatagttatttaaattatgttagcacgaccaaacaatcacctattttttcattgtcgacccggtccggacagaccggataaattccggatgtaacataattttttgtcttaaaattatagttatttaaattatgttagcactaccaaacaatcacctgttttttcattgtcaatccggtccggacattccgaataaattccggacgtaatatatttttttgtcttaaaattatagttatttaaattatgttagcgctaccgaaaaaacacttgtggtccagacaccgcggattaaatctagacgtaacatattttttgtcttaaaataatagttatttaaattatgttagcaccacaaaaaagccacgtgttatttcgttgtcgacccgattaggatagaccgcgtgaaatttggacgtaacatattttttttcttaatagttatttaaattatgttaggacgagcgaaaaaccacatattctaaaaatatatttttgaatggtttattttaaaatttagaaataaaaaagttcaagaaatttaaaaaaatctgagcagacagaatttaaaaagttttaggaatcgccactagagaagaaatgaaaaaaaatatgcatttgctagtatttgaactggagtcctcaattcagtagaaacagccaagtaccactaggctatgtccacttcacattggagaagtctgttttatttatttattcacgttaggtgccattgacaatgtaaatagttttctcgaggaatttgtataagatggaaatagaataacacaacacagatagatgcaaaaaatatagtcggccattccattttctcatcatataaacaatatgatatcttatatattgaaaaataagatctaaccaccaattctgtatataactaatgtacaacattattacacaaagcatatatgcaaataaaaaaaatgcatccatctggctcaatcacttggacaatccaatgaaatctacgaacgacacagtaaagctattgtggtgaagaagcctcgatcccagtaaatctccatccaaaattactgccataaaaataaagagctcgccaagtgaggatatcaacgatataaggaaatcagtgataatggacagatagacagagaacaaccttcataacctcacctttaattagttaccatgttatcgacagttgttccttctatatctcttcggacccatgtctgaccatcatgtgcattgtcaaatagctccccaagattattgacatgatatggttcacattccacatcattccattcttcgcccagttcaaatacatctctgggtttcatcttccttacaatagaccaccctggatttaaatggtcttcaatgtaaaacacttggtcgacttgatttgcaaatacaaagggctcatgctcaatcttttcaccggtatgaattttatttgagaaattcacaagtatgcagccaaacttatctgttttcactctttttcctttagttacatcgacccattcacatttaaacaacacaactgagaaatttccatagtagtctaactcaattatatcaagtatctttccgtaatacatgatatcaccaaggacagggttggtatcactcgcagacgtgtagctcgatgtttttgcagtcacaacaactccactattttgagtcaccctgtcataacgctttgatctgaacctgtacccacgggtattgaatgctctatgtcgttttgctacctcaattggtccacgtgccaaccatctaatatcctcatcaatgctatcaatacctctttgattctccaactgcaaagatctacaccacaccaaaagatacattagttttactcatatttgaaaagaaaaatctaaattttgatacttacatgatctctgaaccaattaggaaattgttcattttgcatgttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagaggggacttttcccttttggaaggctgaggggaaaggaagttaatcctttgtaactggtccatacacaaatccacaaaaacacaggagtagggtattacgcttcgcagcggcccgaacctgtatacatcgccgtgtctcgtgtgtcttgcgggcgggtgatctttccacatacagagagagagagagagcttgggattgcaccctaagcccctggtcgaaccggcaaaggggggcttgcgcagtctcccggtgaggggcaacgagctccgtcatctggcgcgccaggtaaggggctcagcgtgtgttttctgagctctcatactcttccgtgtgcaccaagtttcccttgttcagcctaatggccgagcaagcaaaggcgcacgacctctctccgagtgtgagcggcgacgacggggagccaaacccgcgccgtcgagctcgtactcccccacctcctccacgccaaagtcccaagcggggggaggcgctcgagagagtcgaaaaatccgcagcatcgccagtcgcgggtggtgcaggagaacggcgagatggggagcgtcgcctcctcgtctacggcgacggcagcacgcctcaaggcgcgcttcaggctgttggcgcgctcctacgtcacccgcctgtcgtccctgacccggagtctccagcccagcgatggctggacgacgtggccaacttggtcatgacggcacagcaacgcctgggtgctggcggacggtccgccaccaccaagacctccggcgccgccactaccggttccgcgtcgtcaagacggagagcgcggcgagcggcggccgctgcacgccattcggctaccactccctcgtcggcgcctccgactcgggaggatcagcatgaagagccggatgcccgcctcgacattgagcgccgacgtagtgatcggcgtactccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcaaggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattccctccaaagagccccagactaccgcagagctttttcagctcgcggaccgagtggctcgtaaggaggaggcctggacctggaaccccttcagttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaagaagtgggaggaggaca

SEQ ID NO: 57778 - DNA, 2185 bp, Oryza sativa
gccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtggactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttacttttagatctagcggaaacttttgagaacctccgctccgcccgcataaagctgaaccccgataagtgtgtgtttggtatacctgcgggcaagcttctcgggttcttggtctctgcccgaggcattgaggccaaccccgagaagattcgagctattgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtagttagtgcagcattggttgtggagcgcgatgaagacaatcctcatttcgtgcacccccactctgtgctaacttggcccgggagcgagcggggaggagaggcccccgagtcggacggtggcctacggcccctgacgaccggagccggccctctgcccgcttgtcagacggtgctaggtgcccccgaccctcaggagggccccaaggccactgcgggaaggccacacttaacgccctttgaccccgaggctaaccctgtgctgactcgacccgggaaagagcagggagaagaggcccccgagccgaacggaggccagaggcccctgacgaccggagttggccctttgcccgattgtccgacgatgccaggagcccccgacccccaggacggccccgaggccactgagggaaggacgcccctttcatcatccgaccccgaggtcatcggcacagaaaacaagtgcgcccccaaaggccacttgaacgaagaaccccccgggggtacggcccctagcagagaggatcagccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtataggacgggtggtaaaatgggcaatcgagctttctgagttcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgaccggagacgtccttagatatctggtccgcctcgactttcgagcgaccaataata

SEQ ID NO: 57779 - DNA, 868 bp, Oryza sativa
atttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcctatggcatcgacacgaacagcgctgttttggttcgtgctcttcatgtcttgggctctcgtgtagaatgtgtacccattgatctcatatctctggaatgtcgcgatcgacccagacggtccccttgccaggaaggcaagtagttggttgatcgactcgttacccatgagatgttgtcgtagccacgtggggaaagtatcaatgtgatgccgtgtaatccatgcatcggacttaccgatgttcctggcgcgaactagagccaagtgctcctcgatgtaaagagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctatgcaaaattcgatgacctcctctgttccataacccttggcgatgcttgcctttggacgagcacggttacgaacatacttcttcagaatgcccatgtacctctcgaaaggaaacatgt

SEQ ID NO: 57780 - DNA, 1121 bp, Oryza sativa
ctcccactaatcttctggtatacacaaggctcttcttcatttttgacaaagcccaacaccttggctacttcattaaaacaaatattccaactccgagatgcttgcttcaacccataaatggatttctgcaacttgcatattttttagcttattgtggatcaacaaatcccttgggttgtgtcatgtacacatcctcatcaagatttccattaatgaaagttgttttgacatccatttgccatatcaaaaatcgaaataggcagcaatcgctaaaacaatccgaatagattttagcatggcgactggtgagaaggtttcatcataatcaacaccttaaatttgtctaaaacctttcgccactgtcacgcgcggaatttctatccaaaattccaaacgcttacatgtgtgtaaaccctcgtacaagaatcagccaaggcacacaataacaaattgataatagagtgcaatcattactctaattaataagcgaatataaagttattacagaggtagatagttcctctcaaacaataaaaatccatgcagcggaaaaataagatgaacggcgcagacgactccatcccacaagcagcttgaccagggctacacctaatcctccacaccttcagcatcactgtagaactcttcgtctgatgaatgattgcaaggtgagtatatgacatactcaacaagtcacgcagcaaatatgcaagtgcagggaataacaaagaatggcataatatagtctcatttgcataaatggcatttaataaatactccagaatttaataaaatagtaaagtatttaattaaacagtattaatccaacgctatacaacatacccgttgcataggcccaaccattctgaacaaccaatcccggctacacagttctacctccaaaccaggaatataccattccaaaccaggagctaaacaaattattatcatcatcatttaatatggtgagaggtatgaaactaaacattattagacccgcccataaccgcgggcacgactattcgaatagttttactctggccatgtcgcgcccggaaaaattaccttttcccaaacgctagtgtattaatccccgtcccaggaaaagccgaggtacacca

SEQ ID NO: 57781 - DNA, 1533 bp, Oryza sativa
aaaaccacctaatgttgcataattaatcagcgaagaatctacctaaattcatactagtggaaccatgaatagagtacccactagttggggttttgtttatcctagggtgaacaaggtaataataacaatagcaataataataaggtcataacaaaggtaaataggcatggctaaataatacagtgataacgcgggaattgaaataaagcgataatgcattaatttaaatcaaaataattttataaactaggattcaatatgctcaatgatgatgtgacttgccttgctcaaagagaacggccttccgaaccttcggcgacgatcgcaaaccacgcttcgggaacctccggaacgatagaagctacacgaagcacaaaagcaaagctacaaggctataaagaagcaataacaatacataaaaaggaagtacatggttctttaggttataacaaacattaggagacttgaacgggtcgattcagagttcgtatgaccaaggtatgatcattcgaagtttaatgctgttacatggagattgacggattattgtgattaggttttccaactataaaacatgtgtaagcgctagcctggaaaatacaggaaggctgcgctgttgacatgcagactccacatgtcaacctaaaggaccacagtagaccgagtacacagagacggtccacgggtcgacggaagcggatcccgtgtgtcaaccgaggcaagcggtcgacaaacggactccactagacaccacacgggctgcacacgtggaaaccacgcggctaccgagcgggcacactaacacggacactacacacacaagcgaatgactaccgacaccagtacacgggtaccggggtcgacaaccgcacaacgggcacgggcgacaccgaaaggattaggacggggcagcgagaggatggatccttaccaccacgcgacgaggcgtgggaacgacgacggagaacgggcgcggcggagacagacgggaacgacggagacgaatggcgaggggacgacttcggcagtgatccttggacgaaggcgagacgcggccggcatgaggcctgacgacgtggagccgaggacgaaaacgacgatggggctgcagcaaccttgacgaaacgcgggcgacgatcagcacggcttgacggagggacaaacgcaacgacgaccgagaacgacgggaggacgacgaccggaaccggcgaggaggcgacgagggcagccggcagcagctgcacggagacaaggacggcatggaacacgccgctgcgatgccgacgacggtggcggcgcagcgagacgatgagccggcgaggatgaacggtgaagacgacgacggacaccggcggtgttccgccgatggggaggcgaggccaggggcgaccttgccgctgcgacgctggaggaggagacggcgacgtcggccaatgcacgggcacggcgggaggggctgccggaggcgacgtcgacaatgaggaggatggataggccggcacgggtgacggcattctggtgaaacagaggagc

SEQ ID NO: 57782 - DNA, 1568 bp, Oryza sativa
gatccggtaagcacctttgttagttaatttcaccattagttgtgatttgttttcatatatgtctagtcaaggcagccgtggcggcctatcgctactaccagatctccaggatggtggtgtgtactgttcttagtttatatatgaaattctgaatcacagatccacactcagatgagtatacactatttcttattcttcttccttttaatctctgtacgtacacgtagataaaaattaatcctagagttcagaatgaaaaatactgtgatttggatgaaaaaaatgtcatcaacagatggtagattaattgtcctttgcatgcgtgaatgttgttccaggatagtggtttgtgatggatttctttagttccttgaaatttgaatgaataagcccctaatctttttgttgcttgcaggtggtgtccggccgcgccggccgtctgcagaacatgtcgactcaacgccacaatccaacggcaccagcggagagaatatacacgcaaggggaaggatccttgtttgacaaactgtgatttggatgtacattattacttttcaatctgcgattcagcatgttcaatttgtgttcttgatcatgttttctcgtctgtgaggctagttcttttggaactacatatatctttgagaatatactaaaacttttggatcataatacgtgcatgcagcacgaacactgagttctgcgacagggtaaaagcaagtaataaaaatagcatatatactgctactatcttaaaaaatagcatatactgctactgctaaaaatggtatatactgcaattatcttaacaaaagtataaacctgcaccttaaaaaggtatatgttactaccaccttaaaaagaagtatatatgtatattgctaccacctaggaaacagtatatatactagtcttaactgaagcacagtacttaaactactttggtgaagcacagtactaagtaaaaaaaagaagtatatactattaaaaaaaataagtatatactgtcataaaaaacacgtatgtgggatatttatctgtatatatttctctacatcaaaatgaagtatatggcagctgcctataaactgctgcctactacaaataaaaaaaaacagtatataccgttgcttactaaaaacaaaaacagtatatactttcatgcagaaatggcagcatatacatagctaggaaatatactgcacgaaaaaagagtataaactgttacctactactaataataaaaaacagtttactaaaaacagtatataccctatatgggctcttctggccccagcttcctccaggagacttccatgtgggcccctaaatcagtgacatacattctaggcccatttgtgattgttaaattggacttttgggccttctcatgcaattgcagatcaccagcagactttcgactgattgattgatatatttccacatccttctcttcatttatgagtgcttctcctgcatacatgttagtagcatagcatatagtggaagtaattattttatttgggaattatgcattgcaaccataggtagtcttcatatattggata

SEQ ID NO: 57783 - DNA, 3716 bp, Oryza sativa
caccggaattcgcaccccctcgcgctccggtgagttcaaccgctatcgccgccttcggccatgaatgccgggcgtcgtggttcatctccctctctctaatctctctctcttccttccttagggcaccccgaaacccgtccgccggttgccgtcgtcctcccgtggcttgcagccgccgttcgccgtcgtcttcctccgcgccggccaccctcggtgaggtttcctctcccatccattcccctccctctcttcctagccgccgcttagtgccgccgccttcgcgtcgcctttgcgccgtcgcctccgccgcctgatgccgtcgccggcaacgcgttcgcgcgcgcacgccgtcgccatcaccgcggccggtaggccggccttgagccaagccgagccgggtcgtcgccgcccgtccgatcgaccccgagggcgatctaggccgtttggactagagattggactagggattgcttagccatgcttagttcaactagtgcacaatggggagaatcctattaatgtttagactgttggttctaatggtattgttggattagtgccaccgctttggtgttggttaattaaaataaatcacatggtgggctgtgggtgcatggttttgctggtcgcacccatggcagttaaggacaggttcgtgggatgccctggaagaacttatcgtacttaccacaagccagcatgggcaacggctgggcttgtaacgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggtgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggttgaggtttgggcctgttgcaatgtgggatagcgttggacagtggatagttaatattaattaattattacaactgtttaaatctttcaacttctgttttttttaatgctcgctttatgcaaacgaaccactttagctcttctttgataattccctgcatcatgcctctattccggtatgacttgctgagtacagtgggtagtactcagtcttgctctatttttcccaaccccagagtacgagtatgtgtcagatgcaggtttctctgaggagtaggcttcgtccgtgccgtcaaggatgcctgtggagtggtgttccccctgcagttctagtcaaggcttagctcctgttttctttctttctttccgctgcatctacgtgagactcttatcatgtttgtaagacgtggatctgaatgtccacattgtcgtttgtgtaccccggccggtcatggacggggattttaatgcacattctgcttggaattgtattcgggaatttctgggcgtgacatctatccgcctcaacagcaagtccaatttgtcttctattgccatggcaccctacttgatgagaactttctcaactagaccaagagctagatgggggaaaccaggctggctctgataccagattgttaggaacccactacttccaactcaacaacaagcatccaccatagaagcaacaactgctttggggacaagagaagaagaagctatggaatacaagtgctggaaacttctagaaccgaggggggggggggaaggctggagattggaggagaggtagagtagagagatcgacgagggtgcccaccgaccgcccaagtcgccgccgccgccaggagcttcagctccgccaagtccaaatgatctttcgatgccccctagtgttgccgatggtgccgcttatatgctgctcccttccgtttgcttgggcctcttggcgatgggctgaccagcccgtgtgcggcccacccgggatcctgacatacattcattgtggattaggtgcaagaagaggccgtaagtcaagcaattcgattaagatgggggaagtaggaagatacagtaaacccattcatcatgagcagagatgaccatttcatggttattgagatcgtagagagtaatcaaattagttcactcagatcaaacacaaagacaacaggccgtgtaggatatggaaaaatggtgtgcccattaatctaatcattttatcgaaaggagtaacgaattaatttatactgcgaaactgttgtttcagaacaggtccatatcctgtcgtgtggtaacacaactggatggaatcataagatgaaaaggagcagcaagaccgtcttgccggaaattttctggtaatttctgaacttatttgtgcataaaatcctcgtccaggaatcagctgaggtacataaactgacaatttaatataccaatccatcataataatatcgttacatacttacaaaagaaaagaaaagctgcggcggaattacggtctagcgaaggttcggctccactcccacaggcagctcaattggggtataagccaaacgttttctccctctggatcattttaatttcttcaactgaggttgattgattattgcaagatgagtacgtggaatactccacaagccacacagcaaatatgtgagtgcacaaggattccgaaggatggcataatataggctcatttgcaaaagtagcatttagcaaacatttaggagtagtaaaacaatagagtaattaatcatcaatattaatcaacactgaacagcacaaccatgctgcacaggcccaaccatcctaaacaaccatacccagctgtacagatctaattccaaactaggagctaagcaaattattacctgctatagcatcaataattattatgagaggtgtgagactaataacgaaaaacattgctcaacccgcccataaccgcgggcacggctattcgaatagttttactctggccagagatgtaccactgtacccacaagacacagccccacaacatgtcactatgtccctcagtaccaccacggtacctcggaaaggagctgtgacaatacccctcgcacaacacaatccaccacagggcacctttcctggatcataatcacccccttataaacaaggcatggactcccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgagctatcattaagccatcattaaataatagtgaatcataagttatcccaatcgctgcactgcacggtgtctagctttttccccacggcatgcaaccaatccaacgcatccacggggttgttggagctagagaaggtaggtggacggatgcggaggaactcggcgagtttagagtgttgtgggggtggtggtgga

SEQ ID NO: 57784 - DNA, 3639 bp, Oryza sativa
ccagattgagagcccttgccaaggtgagtaaggataaggaacgggttgctcggcattataacaaaaaagtggtgcctaagtctttttctgaaggagagttagtttggaaattgattttgccggtaaggactcgagacaacaaattcggcaagtggtcacctaattgggaatgaccatttcaaatacataaggttgtgtccaagggagcttacatgttgcaaggacttgacggtgaggtttattgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacagagacaaacgataaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataccataaagggttagggttgcagtaaacagcatttaaagacatttagttgctcaaagctattttgtaaacgcgatcctagaactatacaatattatttatcaaggccgtgaacccacacgaacctgccttaacccaaggcctatgatgattaagaccgaactggcaacccgaccctgggtcccagctcgtcccaagccaacccaggccaaccattccaccttttagttgttaagcaggttttaagaattgaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccgcctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaatttcacaataatccaacaattccaaagtgtccaggtgatatgaatatcccaaagtctagagttgtaaaaccacctaatgttaactaattaaatagcgaagcatctacctaaaatcatactagtggtaccatgagtagagtgtccactagtggggttttgtttattctagggtgaacaaggaaataataacaataacaataataaggtcataacaaaggtaaataggcatggctagataaaacagtgataacgcgggaatttaaataaagcgataatgcaataatttaaagcaacataattttataaactgggattcaatatgttcaaagatgatgtgacttgccttgctcgctttcccaaacatcggcttcaacctccacgaagagcagatcttccgaagctgcagcatctacacgaccaacggaaaagaaaaggcttttactctaataaactccatataacagaagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggagagggcacgcggaccgggtccacgggagtgggggccacgcgtcagcctcacggtacacggtggaccgggcgcacgcggctgacgccggccggcgccgtgggtcccacgcgtcagccgcacccgcgggcgcgggcggctgacggccgggccccacctggcaaccgcggggcgcgcccgaaggcggccttgccggcacggccgacgggaggcggcgcgcccgcgcccctatggtcgccggcggcggccataggcacggcggagcggcggccgagagaaaggagagaagagggaagcgaagcggcggtcctcggctcaccccgggtcgacggcgacgacgggaacggcgaccgaagcggagagaggcggcggcgcggctcgggtcgacgaggacggcgatgctccggcggtcggcgggcgaaacggaggagcggacgaggtcgacgagaacgcggcgaagccgaaggaggcgatgccgaagcgggaggaggtccggggcgacgacggcggcgaaccggagctcggcggcgacggcggagagggaggacaacggcgcgagctcgaatccgacggggagagagtgcggcgagtggcggaaacggaggagagaggcacggggagcgattatatagcgtcgggagggggagagagcggccggaggggaaggaatcggccgcggaaatctcggccgccattgatgcgccggcgaggattgcgggagcaaatccggacgaatccgaggtagagagagagggaaaagtgggggaaaagagggagggaatcacggggagtgatttccccctctttatggcgcgcggggacggcgggatgcggcggattcggcggtggcggcggcgctagggcacgggcgggcggcgggcgcggcgcgaggtaggggatgacaggtgggccccacccgtcagcgagggtggcgggcgggcccgcccatcagcggcgcgcgcgcgggggaaggccgatgggccgcgggggagaggagagggagggaggaagttgggccgagccggcccaagaagggaagggggggaaagaagacttcttttagggtttttctttttataaacctttttaactttgtttatttcttctcaattattatttgtgctctgaaaattccactaaaatttatttacgcattttaggcttttaggaaatatacaaaaatcctccaagccttatttgacttttatatttgcacattttaattgttggaggctttcacatgaattttaattattctttgcacaatttcgaggatgtattttagagtcgttttgggacgcgacatttatgaacgagcgcttaatggaaaatatctgaagaaatattacccaagtgtttgggtcaattcatgatcggctggatgctgccgatacatgttagctgatgtgttgacaccgcctagagatggccgatataagttatattgcccttagcagtttttattatcttaattggttgtgttttgccgatgtatgatggccgatgtcgcgtcccaaaacgaccctaaaatacatcctctaaattatgccgagaataatt

SEQ ID NO: 57785 - DNA, 704 bp, Oryza sativa
caacaagtataataaataaaataatgtacttccacttagtaggtagctagagagcatgcgtagacccagaggttggtgcttaggatggtggcggccacctcggcgaccttcacctggttgccctcgaagaaggcagcgtaggggaggagatggtcatagcagaagctggagccgtcgcggtcggcctgcagggcggtgtcgcagcaggagcggacgaacgctgccgcgtccgcggagggcgcctcccctggcgccgccgcaggtggcagcaccaccactggcttctcctccttcgcagcggccgcacatggtggggataagccgccggcgctgacgaccatcaacaccacgaggacggtggccatgctcgagctcgacctgctcatttctgtatattatttatctctctccctctctctctctctctctctctctgcttgtttcgttactacaggatgaattacttcataacaacgaggtacaatttatactagtaggctcgattggtcgttaactaattaaccacaacctttctttctaatttattcaatggctgttctagcatcacggcatgtctttttggtgttgtgatgtagtgccatgcttgcaattataaactactatattaatgcaactaattgcccatatatagacagcctgctcgctttttgtttcatatccattcacttaggcgcctagcattg

SEQ ID NO: 57786 - DNA, 3386 bp, Oryza sativa
cgatcgctcttgggtgtggtttggtttcacacgcagttcaggtccagtgacaggagatgtgatctgaaaattactcttggttttagcctagcgatttttccactagcatccaaccagtcgattagtactagtacaagttcttacatcagcttcttctggagactgacacttcttatctgaagttctgaacaattacaggcacattctcttcagacattttccttcaaaaactctcttcaaacaagaaaatccgtttcaaaaaacagtaaccacggaagaaacaagtgtccaatctagccacgacagttgagtcatttgacaaaggataaaacgacccgttcaaactttcaagcttgtccaaattcattatcagaaattatatttcttttcctgaaactatggaacaaagcattgcaaggtggctagctatcaacttcatctgcctatctcttgtagggtttgactgtgcaagcattccctaactaatttaaccgtcaatagcttgctgcatcggcagagtcgcagttcccgatactactagcgctgttcctctgcatccaccggccattgccggtttggtttggtcagtcttttgaccggccggccgcgaatctcttcagtcttcagtttcactgttcttctggccagggctgcagaggtaaccgtacagtttaggtgtgtttttttaaaccgtaattaggagtgttaattaatgttataggacggttactgacagtacacgcgaggagattaacttaagatataaaggacttgaccgttggcagttttggcatttgatcctgtgagcggcagagaccggatatactagctgatggttttctagcgggttgaagcagattaactagattattatagtatattatcaacatgattataaatataacaaattaaatagtttgatagctcagaacaaggaatctatgcaatgcagtaagtttttttagaaaatttatttttagaggcacagaataaataattcgcgacaatcaaccggtgaaatatcttaaaaagaattcagcttgtgttctctatgaactgcttgtgtgtgtttcttgtacaatggagttgactgaaaattacttggaaaatcttgacagacttgtactaactgggcggccacttggtcagagctgaagttggatatcacaaacacattttgcattccacaatgtgacaatggtttactgctgtactcgatctcaaaatttaagatcaagttagagtcatagtccagaatgttccttgtgaaatttggtgacatgttttagttcagctaattattgttttgctcggagatgtgaatgaaataaattaaataatcagtggcatgactcgcatgacactgtactaaaaccataatgcaagaggattttcacatgacaaagcctgcaagttgtacggtttgtgagaaactccccagagtataacctgtgatttagtcatgttcattctgatccaagtagagcttgctagcaagaacaatgtttttctttaatacatccatgctaatcttaatcgtagattctttctacctagtggactagtatgtgccacaagtgtcatgttacaacctgcaacctctagaaaccaaaagagatgctagatggcattgcagattttatggttttcttactgtctagtttatgttcatgatgaaggtacaacaacttgtacttgtcgaacagtactcatcgtgtttgttaattgtggtttaagtgacaggagatgctctcattaattagtgccgattatactggagctttcaagtatgtcacgtgtataccagggcaaattgcgagtattatacaggtgaaaaaacacactcgaaaagcttcagtccatgacatgcctgagaagcttaattagactaacagaaacagccacttgtcatcaaccaagtgtgcatcgtgttaatcacttaattagctgttgtttaaggacaacatatgcttttaatttcacctcgagtcaccttaattagaagaagcatatcaagtcaaggatagcttaattagtgatgagcaacagaacaagagaaagaccaaaatttcaatgggaaaaaaagggaacaaagaagttcagagaatctgccgctactgagcaaatgatttgctaccggtttgatctttcagaaaaaagaagtatttgctaccggtttggttctttgtcgtgatcgcaagtaatcttaccaaccaaataatcagctcatgaaccacaaaaaaaaaacctatatcacatttgcaacctaccataattcagaagagacaatgctctgaacctctttgccatgaagaataccatacgtttcgcctctctttaaccaccacgttgaatgaaaatccatgtgttaattaggcgacaagacgaacggtatcaccgatcggtgagatggaaaggacgatgccgtagatccccaaatctgaaagaaccctgccaaaaactaatcaagtcaatgctgctgctgctcctgccattgccaaccgccagaagaaaaatgattagagcagcaatcacacaggctagctggttaagcagagctgaactgatgcagaaaatggagtagtttataatgcattagccggtacagcattattgttaagtgcgtgatcacatgttagaaggctcaacagccatgttctgatgtgaaacctatcctctgctccatcagccattgacatgctggattcctggccgtccaaaactgcaaaggatctgaaaatgtgaactgctgtagatctgtttcagaagcagagaaaattgtcaaatgccaactagccattgatttgaagcaataatgattggcaatggagtttaacagatttgtttgactgaatattttcaggtgaaggcagtatatgttttagatccaatttcttaggatctgaaaatctccaacccatgcttaacagactttttcagttatccgaaacagaaaaggcgaacagaatcgcctcattgactgaatcacgtaacactatctactttccataactcctaaaaatcatggtctacttaagctgatgaagataaagaaaaaaggttcactgcttaaccatttaaagccgaatgttgaccgtctcaattagcaaagatatttgttttctgccactagcttgttcaatcatctcatatttgcaaaattaattagtcatagtgctctaataaacatattgttttttttgccacttaacttgttcaatcatctcatatattccaaattaattagtcatacagctctaataaacataactgtagccctatgattatatataaaagaaaaatgaatttgcagggctattgctctgaagatctgcattaagccagactctggccagcattttccccaagatggcattagcaatcag

SEQ ID NO: 57787 - DNA, 2461 bp, Oryza sativa
agaagtggcgcaagctctccgtcgcgccgaaagacgcggccgccaccgccggcaatggcggcggcggcgagagcaaggcgaagaagttcctgaagaggacgctgtcgttcacgacggcggcgcgtcgccgggggggacgccgccgccgagggggcacctggcggtgtgcgtggggccgacggcgcagcggttcgtgatcccgacggactacctgaagcaccgggcgttcgcggcgctgctccgggaggcggaggaggagttcgggttccagcaggagggcgtgctccgcatcccctgcgagtgcccgccttcgaggccatcctcaaggccgtcgagaagaacaagaaggacaacgccgccgccttctgctactgcagctacgagtacgccgccgacgaggtcgccctcggcgcccccaacaacccattgtgcagatgaagaggaacgtagtagctgctggtttttagcatggctgttgttcatccatccaaaagaaatggattttttttctttttcttttcttttcttatcgatttgtgtttttaagtgttgtggatggtgagggatgatttgatagtatctcccccctaagcttagaattactgcgtaatattttttttcttattttgttgagttgagctgatgatctgaattgggtaatgcagccctcatggatgaaattaatggaaaatatttatggttgatatggaaatggagtatcttcgttttgatttgttgaagtgccagagagaatttctacctctgccggtgattttttgatctgttcaaatggagaatgccccatcagtaagaatttctacctctgcctttcagtgcttttgctgttattgttcctctatagtgatagtggtagtaccgtagtacatctcaccgccattgtttatgtcaatcttgactatatagtgctcgtgcacgtctctgtaccatccttttatttttggagagaggctgtactgtctaatggaatcaatgcttacttttggatcatttgttatagtttgttcaaacgctgaaatttcattgtatcagtttctgaaaaaaatatcagagtagtacctttgttttgccaagcactgttcaacacctaagtgcaaagaaacatacaatcagcaaacaattgtaggctactgtagtaccttcaggctatagcactgtgcttgtggccttgtgagtgtactcgatgaactccataccacaaattgcatgagatttcagctgctcccagattctgactctgactcatagccattgtcctgcactccactctgaattttaaggattttccttctgaaggaaaaggttggccgcgcaatatcttcagacttcaggttctgatgccctctggattcctcttttatgttgtggttttcattagacaatgtgagcatgcattagtgacagtttttatctagtaggaatactcatgtgatcctatttatccattacgtaatgcagctatgagagatgatctgttctctgatgtctgatttgtctcattgtctgatcgccttcttcctttcttgggagactgaacaaaaagcaaaactttttctttctgcaaggaacaaaaaggaaaaacttgagtcgcttttatgaacagaaaggagcaaccaactgattccaaattggcatcagttttggctttgttcctttgttgctcttgcccaacttggtttggtccaagaaatgtggggagagacctctttaaaagatgccaagtgatgcccatattactccaagaaaagcagatgcaatggatgcatcgatctgatcactcaccgaccttatatcttcatctttctctgaccttttctctaatccagcaatttactagcatatctcgatcaaatgttgcctcgcactccaatgaataccaagcataggttgaaactctgactaggaacacaagattgttcaacccaatgaggcattttaaacttagatgctgatcccctgaagtccaccacgattaccaaagtgacaatgtgatgaacaattcaagctgctttgtcaagaacatgacctcagctcgtgtacacgctggtctcgatcctatgcattgcttcttgatgcaatgcatggcttgtgctagtcaagatcaagattgtgacaggcagaacaaaaacccctgaccactcactcagcacatcaccacgttccacgtccagtttcggagagggttgtactcctccgttcctaaatataagcatttataggttgtttaataaagatgaggaataatggaaaatatttcctttgagttacctcattgattaaaattcaaattttgaattttgaattgtttgaattcccctcctaagcatccgattggctgaaaatggttggattctcgtgctttgaaatcggtgtcctagaaatgcttatggctatgtttagttcatttcaaaattggaacgatgtgacagaaaagttgaaagtt

SEQ ID NO: 57788 - DNA, 1045 bp, Oryza sativa
aaaggaaaaaatgacttgtgacagaagaagactgctttgttgtcattgaaattatcttatcttatatgcacaggcagacagatttcttgctacagcattataaattggatgagaagaatgggagtgcgcatgcacaagaagaatgggagatttcacggcaagttggctttggcgtacaaatggtccatacttcatagaattacagaaggtcagaagctctccttttcttatagggctgtcagctctctgcctagactcaagcttgagctaagcctatttcacctttgagctttttaagcaagctcgtccatataagtagtacaacgaatattttaatgacaacctctttataagtataagtattttccatgtaatcacactaataaaaagtagaaaaatgactaagataaatatatgatgccaatacatgctaatttattgtgtagataggtgctaatatatatttatctattagcttatcaagttaacaagatgaataaataataaaagctatacacagtaagatttggtaggacctcgagctcgccccggtaaaactcgtaagctttggcttaggctttgggtctttagctaaactcaaatcgagcttgattttttttttggacagctttactttcttaccggaattgagctccataacgatagaagccacaacgaatttatgttcaaatcatcacctaacgatagaagccacaacgaatttatgttcaaatcatcacctagttaagatggattgtagttgaatttgcatgtttatgaagtgacatattatatattgatctatcctactaaattttttaaaatttttgatgactttttaagtaacatgtaaaaaaatggatgaattgagttttccggattgtagctttataagttgtaacacgacaaacgcacttttttaatcttcaaacacttctcactatcttaatataatttggcagaaaaaaaagaatttatgttcaaatttatatccagatcaggcggtgtacaatggtgtttttgctctggaagtatgcaccctgtt

SEQ ID NO: 57789 - DNA, 2578 bp, Oryza sativa
tcacttgtaaaagtgatgcaattcctttctagacactgaactggaggcatttgtttgagttttcacgtttgtgaattaggtcaacttgcaattcactaacaaatgttgtgctagtgagtgcaaaaaatggaattcttagtgtcgcctagggggtttgtagtttaaaatgtgttgcaggaaataaacatatcgtgtcatgctatttttgatactggaggtagtaattagtagctgatgttgcctatgctgtccagatgttgatgccggagactgatcttggttacaaggtcactcatttatcacttaataccgacggttcatcgctactacttgctggatcacataacataagtattctgtatgtgcatgagagggtttctgaagatggtgataaggtcatatgcaggtacataagtccactatagctttatcttatgttattagtattgtactggtatttttcccgaccatcttgcaattatttaagctgcaataggttgttgcatatatacatgcagcatattcatagccgtgaacactaagagtaggtttctctgagtactcttatcatcagggtattgaagaacgcaactccaaaattttatttcaccttgctctttagatttatgacctgaatcattatttctcttcctttttttaatatcattactcatatcttctttctttcattgtattgacttgtacatatggaccttacaacaggactgtgccagttgcttctcagatcttacctagcaacaatgatggcatcaaagtactgcaaacatcgtggcacccttttagcagtagtcattttggagtcttgacatcagatgctgttttcaggtttgataaatgagtatcgatgctagatggaggaattccactttatctatgcttccttgctatttattggatttgattggaatggaaatacgtcttttacatccacacttaaattaattgaagacaacacttgcttttaaaaataattattgcatgacccttttatagaagttttgttattatttctgcaggttatttgatctgtcatttgatttagagcaaccagagcaggagttctatttgcaaccaattctacctggcaaatgccagaatgcttcatcaattttccagtggcattctcatatgggagtgatcatctgtgggatagattttcggtatgtttcttgaatattgatcccctaaatattgtagaagtcatctggaaaaaaatatagtaaatgatctacagtgtctttattagctgaaaacaaaaccagaatgatttttcatccgatgggattgttttgtaatttagcaagcaatatcatagcatagttaatattaaaccacaaaataggatattagagtcctacccgaattagccttatagaatctactccctccgtcctacaaaaaaccaacctaggtggtgtcccatccccacctaggttgcctttttttgggacggagggagtacttgtttgcttcacacatgggattaaccttgtagtttctttatttacatctgtagcaagatttagggtgtcacaagtcatattactacataaatgaacttggcagctgattgcatggtttctacgcccaaaccctttttttctggaacatctaataatgtttgtccccactattcatgaaagagttactggaatacttttgatactttatgcatcactttctttcatgtcaccttttcaattggttgtttcgacatatgtaatatttttagtagtttcggcatacttcgtatgtttaatggctcatttatgtgcttaatttcacatgtaagcctgtccttttacaggttttcatcttattcagcgatggttcaatttttgtgctctgccccattgttccatttggaaggtaagtattgcatttatttctgccctcccccacccctcttttctctctattgggaagaaggcttacaacaatttgacagcatgatggtcctaatttgttaaaacaaaaaaaatactgtactaatttgtttatgggaaataaattatggtccctgcagtttcacactttcactttgtagtcttgtatttatgaaatgcgaccttaatgatatgatcatatggtgccctttctttatctgcatattggttttgactttattttttttccctgtgatgcagcgattacaataagaagcatattcaagaaatatatgaagatgttaattcatttggattgaaatcctcaaaccaaaatgttgtcaccaactcacgtttggcaattgcttggttggaagcaacgtttcctgacttgtcacgtcagccagctgataatagtgcattgatgtctagagctcatccatacgcatcattagatgattctctaactttacaggtctgcttctatttgacttggtgaaatattgttcgaaccaaaagctagtggactatgctaatgcaatgaccagagaaatgtgaatttggtgctcatgcagctggtcataatcaatccattgttttttagtatatgagatttattgttttgtaggagttaggagctgattggtttgcgaccagacatttccacaact

SEQ ID NO: 57790 - DNA, 778 bp, Oryza sativa
gagtttgtttggcagcataaagatggaactactgtgataaggctaaactctttcactcatcatcctcttcctcgtcatcatcatcagcaccagcagaggagttgagagcattcaatctttcgacaagactggccttcctctgttcgtaggttagcttcttgaggttgtatctgagacaaagatgcaagttagttacaatcatacatggacatcacaaataatctttccagaaatcatcagccagattcatgtacctcttgtgggtcgccggttccttcttggttgatttggccatggtaggatcagcacggatggcagcatggaccttcttgtacagtgcttccatgccatcagcatcaattcccttcttgaggtactcactgaagtgggcttggaatttctcaggttcctcctccgccatagactgcaagaagtacataagtagaaattttaaactgatgagaataaaaatcaagcagactgagctaaacagtaacaaattttccagcctgcttataatgttttagtcaatattacaagcatcaaggcagctacataactcctaatacaacacacagcaatgtcaaaatagcacgaacaattgatctaatagtgccagctcaccctcatgtagtcagccacgtgcccaccgtagatgtacttgcggtgaatatcagaatcaagctgcttctcgtccttcttgaacccagcaaacctcttgtcactgtgaggaatgtcaagaccaccatccaaagctccctgcagaagaaaagagaag

SEQ ID NO: 57791 - DNA, 4069 bp, Oryza sativa
ggaggaaggcatcagcatcaggcatgggacgatgggagatcacatcgaccgcgttcgtggtgctttacactacacgtgcgtgcttggtttagcattgagctaagggccggtttagatcctctaaaatgattaaaattttaccgttttagaacattttttagcaaaataaatgtaaaaagtaggcaagttggcatttgtcatttgatagtaatctgaagaaaaaaaaatcaggccccgtgcataagagaggcggcagcaattaatggcaaaactttaccatgcatctaaatactaacttataaaattgcaatgctaaatctttttccatcaaaacttataccaaaaaatttaccgcagcaagttgatctaagcagacaataagccagtttttctgtgtatgatgtgtctggtaggaggtggcacaagcgcacaacacaaacgggcaaagggtgaaagggtttcacctacaaaatgcttttgattgcttcgttttttttcactgtttatcagcgtacagtaacaacaaaggttgaactgtatatttccagtttttttaaagaaaaaacctgtatatttccctttccttattctatgggccgacaaatccctcatatacggcccatcactataagcccagatttatgctacaaggcccatagcgtcacctcgccacgaaacggaataagatcactttgacttcctcaactgaccaccgaatctaaatcgtatccctcaactgcaataccaaaaatcttgacccccccccgaacttgcaaaaccggtgcaatttgactctcttagtggttttggatggcggtttcactgacgtggcgcacacgtggcagtgttgacctgttctttgttccacgtagcattgacgtggcgcttatgtggcattaaaataaaaaaaatatatgcggggcccatttatcattcacacaaaaaaaattgtgggacccactgacatgtgggttccacatgtcatcttctctctcactacccttcttcctcctctctcccttatttctctctctctccccttgacatgagccggcggcaggcgggggctcggtggtggcatcggggagcgggtgccggagtggtggctgcggtgggcggtggacctcgagcgacaagcccgggagcagctcctccttgaaatgggggtggacctcgggcgacgtgcgacggaatgcgtcgggggagatgggagcacgctcccaaccgccgctcctcgtccccactctgtgttgtgggtagtgaggagggcggcggccgcggcgtcgacaacgaggtgggtggtggccgcggtggaaagggagcaatagctcgcgcgccccaacgcacggcggcggactggccttgagcgctccagtgtcgacctggccatgatgcggagcggcgattggagctcctcctcctcctccaacacgggcccccttgtcacaccctgaaaatcaaaatatttaaattgttgtttaattggaatttttagaaataatttaaaagtcttgaaaagaaaatctaattttaattaataaattccaatataaaatggggccagattaaatttcatttaatactttgcttaattctataattcctagatttttctgggatttatttgagctaaggaagtatttttaataaatggaattgcatttaaggaataatttaaattgaaaaaggttttaaaaagtctcttttggctttgggccgaaagtcggcccaaaaccgctctctctctcctcggcccagttcggcccagtccgcagccgtcgcgtgcgcgcgttcggacgctgacaggtgggtcccacctgtcggacccatcgtctaccttcggccgccgccgcccgaaaccctagcgcgccgccgccgccgttcctttccaaatccggccgttcctttccttctccggccgaattgtttgaggggaaacaatctccgggatctcctctaccttttctcctttggaatctttggctaaatcgttttggaagttcgtggaatcgagttcgtttcggatcggtttccctctctccaagccgagctttccttcgccgttgccgccgccttgggccttcgccgccgcctctgagcccctttaaaaggacccccggtgtctcctctacccgttgccaccttcgccttcgcctctcgtcgtcggaaaagccctagcgccgtgtgccctagctttgccgtcgccgccgccgctccagccgtgcgccgccgtcgttttagccgtcgccgtcgctcgggaagaccaccgtcgtgctcgccaagtcgtcgccgtcctcgtccgccccttcgccgtcgccggagatcgtcggagcttcgtcgccatcgtcaagccgaagagcttcgccgcttcctcctcgtcgccgtcgccgtccgttgaccttccgccgtcgttttggtcgccggtgagttcgccgtgccgcccgcttcgtcttggtgccctccgtttgcgtcctcacgccgccgttcgccggcgagcgtgcgccgttcgagccgtctcctccgccgagccgccgccgctgtcggtgacgtcaccgctgacgtcatcggggtcgtccgccgtgagccgccgtggacccgatcgatctcggccgtccgttttggattggttcgatctcggccgtccgttcgtgtgaaccgccgccgtgcgcccggtccaccaaaccctagcccgctgacgcaataaaccctcttttccttttcaaaaataattcattattgcgtcataattcaattttaaccgatataagtgttttaatccgatggaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctactgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcagttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcagtggattgtgttatgcgaggggtattgtcacaactcctttccgagatactgtggtggtattgaggcacatggtgacatgatgtggggttgtgtcttgtgggtacagtggtacacctctgatcagagtaaaactattcgaatagccgtgcccgcggtatgggcgggtctaacaatgtctttcgtgattagtttcacacttctcaccatagtaaatgatgcttaaattggtaataatttgattagctcctggtttggaatggaatattcctggtgtggagatagaactgtgcagccggggtggttgttcagaatggttgggcctatacaacagggtatgttgtatagcgttggattaatattgtttaattacttaactgttttatcgaattctcaaatgtttgctaaatgctgcttttgcaaatgcaaccctactatgccatcctt

SEQ ID NO: 57792 - DNA, 3324 bp, Oryza sativa
caatgaggctgatggagtggaggattaggtgtagccttggtcaagctgcctgtggagtggagccgtctgcgccgtttatttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaagttggtatcagagcccctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatcaaaaaacttgtgctattaattggataaaggtcttaactccctcctttcacttgtctttagatgccgcgttacaagcctgagtacctgtttggtgttgagggttttgtccaggagttgcgttcgatgtcctttgtcattggatttgggactgcccctttttatgcccagattcctcatgatcgtcatgaagagaagtgccgagtcaaagtcaccttgaacagtaatagtgaagatatccccttagtgatgtttgaagctggaggaagaaactacatccatgcatgtcaggaggtggcaaggatcgccataggagagctccgtgatcgctacagtgatcaattggccgacactgagtatcgctaccatcctcgtcaaccccagggaagtgaccgtggcagctatcttgagactgaaggaattgagaatgatgctaccacgaagcatttggttgagatgttgtgggctatggatgaaagtcgtgcggagactgtgttagccgctcaagatcgtgaagaccggaatcgtggtaagatttgtaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaagatgataaagacgagccttcaatcgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtctttagtttgtaataatgaaactcagttaagatcaataaaagttaaagtaattctctgtcctaagtagtttccccggtttctcttcttgtgccctgtccatgccaatggtgaacactcgcagcaacgggaatggtcccaacaaccccaataacaacaatggagagaatcccattctggcccaagttcttgctcaacagacacagcttatgaacatgatgatgcagcaatttcagaatcaggaaaaccaaggaaataaccatgcacctccccagaacaagttagcagaatttcttcgtgtgaggccacctgttttctctagtaccactaatcctgttgaagctagtgattggctgcatgccatagagaagaagttggatttacttcagtgcactgatcaggagaaggtctcatttgcatcacatcagttgcatggccctgcctctgaatggtgggatcacttccgccttaacaggactactgctgaacctatcatttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatctccggaagatgtgcgcaatgatgaagagcgccaggagagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacgacagggaaataatcagaagccgcatcttactttaggaccccagcccatgccacagggaggttcttcgtctgttgttcgtccgcagcgtcagttcttcaacaacaatgctggcaacaacatccgtaatcaaggtccacgtcctgttgcagctccagcacagcaacaacctgtcaagagggagcaaggcagcaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcttatctatgagttttgtgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacaaaaaagtaactctcaccagctatgatggtcgagttgtaactgttcatgcattgtcatctgagtctttaaggtcaagactgaaccagataactttgga

SEQ ID NO: 57793 - DNA, 1098 bp, Oryza sativa
cgtcgatcctagtaacgtggatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcagtgtattgcgatgcatccaaacttgggttaggttgtgttctgatgcaagatgggaatgtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagttaaagtatatctttactcagccggatctgaacatgagacaacggagatggttggaattaattaaggattatgacatgggaattcatgatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcattgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgagagaatctgtgtccccgacaacaaagatctaaaagatgcagttttgaaagaagctcatgatactttatactccattcaccctggtagtactaagatgtaccaggatctcaaggaaagattttggtgggcaagtatgaagcgtgaaatcgcggaatatgtagcagtatgtgatgtttgtcagcgagtcaaggcagaacatcagaaacccgccggtttgttgcagcctttgaagattcctgaatggaaatg

SEQ ID NO: 57794 - DNA, 874 bp, Oryza sativa
agatgcagagatcagttggccaaactcaagaagatctccacgagcccacgcatctcttcttgaacacagagtatccggatattgttatactataatatgtcattgcactttcagttcaaatttggtaaagatgcaggttcgaagaatatatgtactctactaagcattttgattcctaagatgacaactcaatatgttgattcctcgtgcgtattggaacacaagaaagaatatcataatcttgcctctttcttttgcatatatggctttaagttaagtcacaacgaatgccaaattttagtagtaaaggcagttcatctatggagacaatagaggtagcagaagtgtgcaaatatagttcttcatgatgtaaggtctacagcaagtagtacaatcgctaattattacgtaatttgctatttgtgttcatgaaagtacatatgcatcgagtagaaatttaaatgagtggaccaaatactaaaagagcgcacggaaaaatatttggttgtgctcacccttgacaactcgcttcatctcagagaagtagtgctcagctctcctagcgagattttctttaatatacactgcaagaaaagagtgtgatggaatgtattcagattcaaaatatggtacaagtaagaaaatattttaagagagagaattcaaatgacaaccttctgagcctcgtatatggctgggttaactgtgttagaagaaaacaaaatggtatcaaccttaaattttagagttggtcataacaaaaagtacatataaatagtttaccattacgaagaatacttgatgcatcttcacagcctgaagcactgggaattcaaacaacaaaatgataattgaaattgggtatgttctgaac

SEQ ID NO: 57795 - DNA, 746 bp, Oryza sativa
ccaccatgatcactgtctgagccactttctgggccatcagaatacttgtccttaggagcctttcttcggggcttatcatctttagattcattgcgagaactatttgtagatttcttcttcttccgatcatagtcgctgtccgactcactgaacgaaccatcaccctccgagtcagtatctgaatcatccatgcgcttaccctttctaggcttttcatcttctgagtcatgtcggcgagagatcgtggcaggccttttctttctctcatcacgatcgttcttgccatgttttgttgtcttcttgccataatcaccatctgatcagactctgaatcatggcgagagctctttccacgccttgcattcttatgatcactctcagaatcagactctgaatcatggcgagaactctttttacactttgcattcttatggtcactctcagaatcatcatctgtatcatggcgagaattcttcaagtgtttactgtgcttcttttcatcatatttagcctcagaatcatcttctgaaccatagcgagaattcttcttcttcttcttgttatcatcatgatctgaatctgaatcatgaccaagtttaatcttcctagaacttttgccatgactctttgcatcactccctttatccttcttacccttctttgcatgccttctgtcatcctttaaagtcttgccatcttctggcccatctatttccaaaccttcatactcctttccaagaacaagc

SEQ ID NO: 57796 - DNA, 744 bp, Oryza sativa
ccatttatcattcacacaaaaaaagaattgtgggacccacggacatgtgtgtcccacatgtcaccctctcctatcccttcttcctcctccccctcctcccttctctatctctccctctttctcttcgtgcgtggggagcggcggcggcggcgacggcgacggcaggcaatggacggagcggcagccgacagtcttcgcgcctcctctatcgccgccgttgcagcagcagtagggattcggggatggtggcggggcgagggcatggcggcgagggcaccttgagcgcccgctcagcgagggcatggcggtgagagcacaacagcgacgagcaggatgattccgacgatgatggcgcggggcggccacggcggggagggagcaagtcgggcgcggtggcacgaaggaatgtgcgcagcgggggacaccgagcgcaccgaggaggaggtggaggagcgcgaaaacgctgccgccccggcggccaccgagccccctgctcctgccgccaacttcccaagcctccacgaggccgctgcgggcgcggccggtggcaaatccaagaggaagaagggggcggtctgcggaaggtcaacggacggcgacggcgacgaggaggaagcggcgaagctcttcggcttgacgatggcgacgaagctccgacgatctccggcgacggcgaaggggcggacgaggacggcgacgacttggcgagcacgacggtggtctcccgagcgacggcgacggcta

SEQ ID NO: 57797 - DNA, 759 bp, Oryza sativa
ggtgtttaattcactactgcgaatttgagatcacgtgcagttatactagggactgcaagacaagaactgcatgtgatcttggtcatctatttttcttatggagggtttgaagctacaacacaggagctacagtaaatatgcagtatttcttttgtttgaatagtatctttgattatctgcccgtttgatttacatccaatggtcctagtgtgactgcaaggtccagtgtcacgccacattttgttaatctttaccactatattttataggttcaggtcgatccatatgtaagtgtcaaatacaactgtgagtctgtgacttcgattagtcatgaatgtttgtttgtggacggtcgaccaacattttgctaacgaggtgtacttgcttgttcgttgccatgtttgtatcgtgccacgggttgccctgaatatacatactatgctacaaccaaaacgcgacgggttcaattgacagatcagccaaacctttgttggcaaccttgtatggcttggacgatcgagccatgcggcctgcgatctccagctgtccgttcttgccatgcgcgggaggagcgggcgggaaccgtacgacgacgtggcatgcggtgtccggttcggcactcggcagcacagcggcatcgatcggctgagacacgtggtgatgggcgcggatagcatgcatcgacacggatcgtgggccctgcggagggcgcgtgggacggatctgggacgtgcgtctctatccggttgggccgcacgg

SEQ ID NO: 57798 - DNA, 2114 bp, Oryza sativa
  unsure (1)..(2114): unsure at all n locations
atttaagactatcattttaaataagaaaaaaaagtgggtgggtttatctaatttaagatcatttaaaaaatgatattgaacattttcttaatcgactttgttgttcaattcctcttgttaaatatggacagcctgattgtaatgaataaatgggtcattttcggtttctctaccctcttcctggtattatccaggttagtgctagggttaaaaatagtatctgaaatgtaacaattaggaactaaacttagtccctgtcacattcgatgttgggacactaatttggagtattaaatatagaatacttacaaaactaattggataaataagagctaatctgcgagacaaatttttaagcctaattaatccataattagcacatgtttactgtagcatcacataggataatcatggattagttaggctcaatagattcgtctcgcgaattagtccaaggttatggaatgggttttgtcattagtctacgtttaatacttctaattatatggattagttagggataatcatggattagttatgctcagtagattcgtctcgcgaattagttagtccagggttatggaatgggttttgtcattagtctatgtttaatacttctaattagtgtgcaaacatccaatgtaatatgcactaaaactttgtagcctcatccaaacccttaagacaaatatacctaaatctaaatgcaaagaacgtggaggattggttgtctcatataaggaatgatcccataaaaatgagctattagaggattggttgtctcatataaggaatgatccataaagctattgatccaactatcacacatcagaagcgatttaaatatattgaagcagtagtgagaaaaaaaatagagcagagattatgaaagaaatgccagtacaaccaaagaagaaataaaatggacgatgaaccacaagtaacaccaaaggatgtagtgaacaaactaacaacaatgagctctggacaagtaagtaaagtaggtaagtagtaagctatatgagatttgatgagaaaaattggttgccaactgctgaacacaaccaatctatctggagatatacaaatatcaatagatgacataaaagataaataagagagaggcttgacttcaatacttcggcattgtgcaaatcatatgataatacattagtcggtcaacgaataaaccagagaagtactattccagaattttaaaatatattacatcatttaagaagagatgtttccaggggcattatccaatttttaagaggatatcatgtaattggagagctggaatatcgaagttgagggggtaaatgagagcttgactcagattccggatacgcttaattggtgagctagaacatcctagtttgaatgagcaaatgagctgaacatgtaatatctttgcgttctgtgtcatatgaacgagtagatgagattataagagaagatttcctgtaattnttttaggtttcttgttatcataatttgtaggttggatcgtgctttagttttgataagtaaatgtaattattagatggcaaatatgacccttttatttttgaanggaaaatacgttgtttactgggtcttttcagtgagccttttaggctaaatattcttgcaaaccacgtcatgatgatggtcagtgttgtatatcattcctaattggtccctgttatctcgtctacacttgactactcctgctagttttgattggtgctagctttgaaacttgcatactctctctgtctaaaaaaaagccaatctagtactaagatatgacacattctagtatcacaaatctggatataaagtatgtccagattcgccgtactaggatatgtcacattttaatactaggctaatttttttttggacggaaggagtatgatgagtagcattttttttctatcataacaggtaagtacatggtatattgtttatgcatgctccgtctcccaagaaatttacattacatattgatatttgtacctttgttatgttattgaacgaacaaatgttgctgctcttgctatacggtggttcttattagttactctctccgtcccgtaatataagagattttgaatggatgtgacata

SEQ ID NO: 57799 - DNA, 854 bp, Oryza sativa
ttttatctcattaaaatatgtttatagctagctaatagtccgccattgtacctgctctaagctagataatcattgcgggtgccctaggacaaaatgagatgcagacgtcgctgcgccgcgcgacaggagcagcagcaccgaagacagcggtcgcttcgacatgtccgatgatcaccaagattcccaaatcccaagacgctgcacaatctggaaacctaccgggttgccttgcctctctctttagacctcggctggctcggctggcctgcttggggaagatgtccgaactccgaaccgaccattagtgcaaataggtttcccggtcaaattcgatcagaggtacgaacgtagcgtaggcgtagcgcataatttttcaactgttattatcatcaaaagtaatatattcactccagcatatgcagaaatcaacggcaaaattttgccaacaaaaatgcttgtgatgctgttcagcactaagccactaaaccacatgggcacagtgttaaatcatatatttcttgcagacacaaggtaattatatccaccagaatacatattgatcattcacacaacaaaacaacaagtatgaaagttcatacaaacataagcaaacgtacattcctgaggcaaaaggttctctactgctaggagagatttactgctgcatcaagtcttcttctggtaggactctgaaaaacttgagggagcaggacatcgatcatctgctcggttcatgtaaagatgcatccctcttctgcttgaagaaaccagagatggctgcaaaggaaaatactaaagcatggtgagattatacattagttgcgaaggaagatgaaattcatccaatgtatttg

SEQ ID NO: 57800 - DNA, 803 bp, Oryza sativa
taacttctgaaaccagaatcttgctcaatggccatgaaagtgacagcttcaagccggcgcgaggactgcggcagggtaacccgttgtcgccgctactctttgtccttgtcatggatgcgctgcaaggcttgctcgccaaagctacttcctgggggcttcttgccaagctggacactcgacgttccatcccaaacacatccatttatgccgatgacaccattgtgttcctgcaaccaatcgagagggaggcaacagcggtaaacgccattcttcagcttttcggaaaagctacagggctcaagaccaacctcagcaagagtgctttgacgccgattaggtgtgatgatgatgtgttggtcggagttcaacagctgcttgggtgtagggttgagaatttcccgatcacttacctcggtcttccactctccctgagaagaccgacgaaggcggaagtgcaaccgattttggatcagctgtccaaaaaagtggccggctggaagcccaaactgctctctcccgacggccgtctgcgcctgatcaaatcggtgctgaccgcgctgccagttcatttcatgtttgtgcttgtgctgccaaaatgggcaatcaaagagtttaacaagaaatgctgagcgttcctgtggaaagggcaagaggaggttaatggcggccactgcctagtggcttgggatatcgtctgcagcccgaaggagtgcgggggattgggagtaaaaatctggaattatttggccaagcgatgcgaatgaatggctcgctagacgattggagcaaagaggaaggccgtg

SEQ ID NO: 57801 - DNA, 2130 bp, Oryza sativa
ctttgcaatggcgatcaggagagctgtgatcatttgttgctgggttgccctttcacgaataggatctggggtctgctgagaacgtggctaggaactcctttccccctgcctggcgatgacgactgggagttcgcggactggtggattaaaaccagactctgttttagacgggctacaggggcgcttttgactccctttgtatcctcatctgctggttcgtgtggtgagaacgaaacctcaggatctttgaacaaaaggcgagaacggcagcggagctcttcagtgatattaagaatgaagttgcagtgtggagggagaccaacattttgagagaagtcggctaaagagcccgctggtggcggattgttttgttttcctttcttttcggtttctctcgactgtttaatgtcgatttgtaaatgttttcaaacccttccttcaaatcttaatacaatttgggcggcctgccttgggccgtcccagctaaaatgaggcctgccttcattcagaatagaaaccaaacaaacacagcatgtaattcaaataacaagaagagagtgcacttcgatatccttattttgtttagttgtttttcagatatatggtttccttcccaagctatcacctactgtactaaacattctccgagaaatgaaacggcattagagaaattttccaccagggattttgtctcttttgagaaaatttctcagtgagggtcgctctccagctatgcacttgctatgtcatactttattccctactgtgttaagcatgctttgtaatctcactgcacggatcattttgtttcgagaaaagaaatcacccagaggcctaggttaagaccctggaaaataataactaaagaaaaggttatcggtagatcacttaatataattacatttagatatttggctcggatatttctgtatagcactgtactgcttggaaatcattagaaaatttaattatgtgtcgctgtcaagaatcgtatctttcatttgaccagaatcttgagccattatttgctttggttaatgcttttcctttgtacaggccttgtctcgaatggggactctttggatatgccatggttggatgtcgcaggtgtcagggtccacctgacctcaatttgtctgtatagcagggcaacatatatacctgtctattccaagttccaacaggatatatatcagttgatcatgtgatgctagaataatcttccttctttccaattcactgtaatgcaaaacttctgattttctgaagcagctgttgctatatatacatgcataacaagagctcaagtatacagtcgcaaactctgttgttattctgtggtttcagcaagtaaaactgtaacactgtaaactgcagaagttcgatgcgacaagtggttcaatacatcttcgtctactacccgtcttgaaaatgatccatccatccctgctgcatcctgattgcttcagatggtggctacctgcccgcctgcctgccattggtgtcgcactaacttcaccagtttagggttatagttacttaaaaaaaattggaagtttgaagaaagttgagagttttgcactaacttcaccagttcagggtgttagtttctgaaaaaagttagaagtttgaagaaagttgagagtttggaaaaaagttgaaagttagtgttaatttctgaaaaaagttggaagtttaaagaaagttaggagtttagaaaaaaagttgaaagtttatgtgtgtaggaaagtttttgatgtaatatgatgtgatggaaagttaggaatatggaagaaactaaacacggcctgttcagatgcaaatatcatggtgatccctcccatgggcttgcaacgaagtttacgcggtctctgatgaaactcgttggcgagattggctggtttgattggcgagattggctggtttgatggtgtccctacgtgtaagttcgcatgtttctcacggccatctctttcacactcacagtcacaggacccggaaaggcaacgcttttgtttctttagcacggagcaatccccgccgcggacgcaccgcacatggttgatttttttaaaattttttgaatcatttaacttttattttaaaaataaattatttctaaacttattt

SEQ ID NO: 57802 - DNA, 789 bp, Oryza sativa
tccgcgcctatttgcttgccagttgttgatcttggagatggcggcagctcagcaggcgcaagattcagctggttcgttgctttttttccccttttatttgggttgcttgttgattttggagttcttttttttttttgcttcactttgcatatcttctgtgttgaatttgaggagttgggtgggagtttatctgtgaaggtcgcgatcttggcggtgtttgttcgtgtggggatcgtggtaaatttgcgaattttcatggttttctggtcaaaattaaaattagcccaggactgagattttgtacgacgctgctgttctgatgctgtaaaatctcgaccttctcttctctctcttatttcttttcgttttttctttatttttttgttagggttgattggagaatagcaattttagatgccatttatccccaaaatcgattttgctgatagtgatttcttcacttgttagttagcatgtgctcaagcttctactctatttacttcgtaagttggtaaggtatctagttgtggcaaggtcagtaacaaagtttgagtaagtaatgacctaaatggtagttcatgatgtattaggcgaccaagcgttcatcactgaacaaaccaacatggataatttacagtgtagtttattatgggagcttgttgctgatgtcctggtcttacagaatcaatgcaacttaagcaaaagaaaaaactagaagtgcctccacatatttttttcactaataagaatttctaccgtggttctttgtttgttttaacatgttagcag

SEQ ID NO: 57803 - DNA, 722 bp, Oryza sativa
aggcccaagcccaacaatctccatgatccgattgcttttacagttcatcagccatcgctatcgcaaattcgcgagtgctccgccgcgcgtacggtctgtcgtgtgtgtggttctcttgtccactccaatggatttctggtggatcagaggaaggcgacgacgccattgtggaatcgcgtgcttagctcgacacctggtggagctgctacgcaaaggagcaccttctcatcgtgttcttctcctcgaggtgtttcaggctccgaaggtacaggattcttcaggttgatctaccgataatcggagtgattcttctccttcttgttgactgtttatcgttctttgttgcgtgcttcattgcaacagcacgtgctggaaggagaggaaggaagttgtgatgctctgtgattctctgggaggtttcttggctccattagccgtactcggggtgatgtgatgctgatgttgtatgggcacctcgaagatgtggtatcttttccatgaggtttatgagctgctgcatgctgcgcccaagtgccaacactgtccggctcactgttgaggagactcttcagaagagggttcatgcatgcaaggtgtttgttgttggttcccaaaggaggagggtgaggaattgggtggtgtttgccaagaggaggaggaggagtagcaagaggcagcgttgatggaagagttggttcttcgatgcatgggtctggcctgat

SEQ ID NO: 57804 - DNA, 780 bp, Oryza sativa
aaaaaggggtacaaggcttgcactcactgtatggatgaaacaaaagtacgtatcttaaacactgtaggaaggttgtatacatgggtcatcgtcgattccttgcagcaaaccacccggtacggaagaaaggcaagcacttcgaacataaggctgaccaccgtacgaagcctaaacatcgcaacgggaaaacagtgtttgctatggttaaagatcttaaagtagtgttcggaaaggggcctggaagccagcctatagagagcgaaaatggtcacgcggcgatgtggaaaaagaactctatattttgggagttaccctattgggaattcttggacgtacgccacgcaatcgacatgatgcacctcactaagaacctttgcgtaaaccttcttggcttctaggtgtatacggaaagtcgaaagatacactggaagcacgtaatgatctaaagcatatggaacaacgcgacgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaagtctcatgactgtcacgtgttgatgacacaactgctaccagttgtaataagggctatccttccagacaatgtccgggcaacaataacaaagctatgtgcattcatgaacgcaattttgcagaaggtcatcgat

SEQ ID NO: 57805 - DNA, 7486 bp, Oryza sativa
ttttgagttgatatttccaccttcatttttcaatataatgacgcatctgctttgtcaccttgtgaaagagatcagtattctcgggcctgtgtacctacacaacatgtttccttttgagaggtacatgggcgttctgaagaagtatgttcgcaaccgtgctcgtccagaggcaagcatcgccaagggttatggaacagaggaggtcatcgaattttgcgtagaatttatcgaagatcttcgcccaatcggggtacctgaatcacgccatgaagggagactacggggaaagggaactctcggaaggaaagcaataatgacggtagacaacaatttattctgtaaagcccatttcacggttctgcaacaatcttcattggtagctccttacatcgaggagcacttggctctagttcacgccaggaacatcggtaagtccgatgcatggattacacggcatcacattgatactttccccgcgtggatacgacaacatctcatgggtaacgattcgatcaaccaacaacttgccttcctagcaaggggaccgtctgggttgattgcgacattccagggatatgagatcaatgggtacacattctacacgagagcccaagacatgatgagcacgaaccaaaacagcgctgttcgtgtcgatgccatgggacacgatggaacaactggcacgtattacggtgccatcgaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacacaagtctttttcatgaaggacatgtctagcaaagaaaaaaagggtagagggcctgacgagcctaagcgtcacgtggttctcccaggcaaaagaaaaatcatcgcagttaaggacaagactgacgaggattacgatcaggtggatgggcaaccccctttcacggtgacgattaaccctagcatcctcctatcaaatgaagacaccccttactcacgtagcgatcacaaggagggaccaatagtgaggagaaagtacgtgcggtcaaccgtcaccgccgatgtattgccgtaattattgtgtacacgatgtaaactattttggatgtattgattatccatataaatcaattgatgtatggcatatgttaattacgcacgattattagaggttttaacaagtttaaatcatgtatatgctagttatatgcgatacttacaatttttaaaagttttaaatcacgcaggtggcaatttcatatgttaattagagtttttaacatttaatttactatcattcatatgctaattataactactagagaatttttaaaagtttcaaatcatgcatgtggcatttacatatgttaattagagtttttcacaatttaatttactatcattgcatatgctaattatatatgactattcgaatttttaaaatttttaaatcatgcatgtggcatttacatatgttaattagagtttttaacaatttaatttaatataattcctatgctaagtatatatgatgattacaatttttattaattttaaatcatgccgtatgtatatacatatgttaattagagtttttaccaatttaataatatcattcatatgctaagtatatatgattattagaatttttattaattttaaatcatatatttgcttattacgttttatccacttaatttattacagacaacaataatttttcgaagtaattgtcattaatctttgtactttaaataattgtaatgcattatcttctattttagaaacacatatgtaatggaaaataatattcaatgcgcttatcagtagtcctggttcttaaccctaaccgggtttaaaaagaatttggaaatagcgggaaaagatctttagtcccggttggggacatgaaccgggactaaagatctagggctatatatattcccgatgcgcgccctcgtcttctccaccaacacttagaagtttttacccgatcgatctctctcggcttctccttcgccgccactgcctagggcatccccgcgccgacaccgccgccgtatctcgccgtcgtctcgcgctcgtcgtcgtcgccgccgcctctgcctccttctccgccgccgcatctctggggtgagagccaccgcgcgccgcctccctctcgatctctctctccgatctcgatctctatctctccctctcggttgccgccggccgccgagtttcagacgccgacgccgacctcgtcacgacacgacgccgcgccacgagacaccgcgacgccgcacgccgccgccgcgccacgccgatgccgcgcgcggcgccacgccgccgccgctccgctgccaccacaccgccgtcccgctgccgccacaccgagaacgtgaacgagcgaatgagcgaacgaacatgaacgagaacaaggtgaatgaacgtgaacgagaacgagcgaacgaacgtgaacgagccaacgaacatgaatgagaacgagcgaacgaacgtgaatgagaacaaggtgaatgaacgtgaacgagaacgagcgaacgaacgtgaacgagccaacgaacgtgaatgagaacgagagaacgaacgtgaacaagaacaaggtgaatgaacgtgaacaagaacaaggtgaatgaacgtgaacaagaacgttgtcggacgaacgtgaacgagccaacgaacgtgaacgtgaaatgcaattataggcaggttaatgaacgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcggagtcgtccctcaagccggagtggtagagctagccctcgaaggaattcgcccaggcaagtgacgtaattatatatatatgattgttatatttgtaatgcaattaagattattagatttataattagacttaattaacatataagattgtgtagtgttctaatatacgacagttacacttagaatacatgactaattgagttttagtataagattattggagttttaatataagattattatatttgtaattagacttagtatataattattgactagctagggtcctataatatacgtcacctagacttagcatatatatcactatttgagttttagtatatgattattagatttgtaattagacttagcatgtaagattgtgtagggttctaatatacgacagttacacttagcatacatggctatttttgtcttagcatataagattatttgagttttaatataagattattatatttgtaattagacttagtatataattattgactagctagggtcctataatatacgtcacctagatttagcatatatcactatttgagttttagtataagattattagatttgtaattagacttagcatgtaagattgtgtagggttctaatatacgacagttacacttagcatacatggctatttttgtcttagcatataagattatttgagttttaatataagattgttaaaacataaatgtctcatgacttagcagatgtttcctgtatgaaagatggctgatcgcaatgatgaacagatattgtacgattcaatcgcggagggaagaagccagtactggaacgaagaagagggaaacgaggatccaaaccagtatttgaacgaggaagggaacgtggagagagatgcggaggggaaccaggaggagcacgtggaaagggatgtggaggggaaccaggaggaggaggctagtggaagtcaaccctccgttggacagaggagggcacgtgggcatgaggtgccgcgaagaagcttgagggtcggcacatcgtaatggaagtggaagaagatggacgacctagtgccccggcagaagccgccaagaactatgtacgtcacagcggttgggttgtgcgggataacgtgcctgtcagtacggtgtactggcgaagaacaagggcacgcggagatcatgagagctttgtcctagattcggagaaagagatgctgtggaccacaatgctcgagacattcacccttcccgcgggtacagaggacaaagtgaaaaagtggactctgaagaaaatgacagaacagtttcagagtttcaagggagagctgtacaagaaatatatcctgaaggggcagacaccgaacttcgacacattcccaaagctaagggatcactgggacgagttcgttgcatataagacagtgaacaagggcaggcgatgatggaaagaaacaaagaaaatgcagccaagaagaagtaccatcaccacttggggtcaggccgctatagcgtcgtgatgccgaagtgggaggagatggaggctagcttgcttgagaggggtatcgaaccggccaccgctaattggccggaacgatcgaagttctagtactatgcttacggtggaacgctcaacccagctgatggctcactggtcttcggcgatcagatacgagaggctgcgcgtcgactaacagacgcagtggaagcctcttctcagggcacgttccgaccagatagagagagggacgagctgtcactcgccctgcagactccagagcatccaggatgaacacgagggaaaggggtgattccttggaagattaggttcaaggaggacatccacacgtacaagagtcggatgaggagcaagagagataccgaggcgaagattgcagatcttgagttcagggtatcgagctacgagctcagcatgcaagaggaggtggcaaggaaggttgatgaacgcatggccgcacatcggtccaatgatccctagccgaccattcctcctgcaatggtgagcccgtcaggaaaccgtagcagctgcgcctcaacggggcaggtaggatcacagagcatggacgccatgcaaacccaggacgaatccacctgccccgttgatgacatcactcaacggacaccatgtgagctgcatattcctttcaagaacttatcaataaaggtaagctcgtagtttatatattttagatttgcccattccgctagttgttgcttatatatgttgattactaataaataacctctcaccacatgaaggtggcgtcgggcatagccatcccaacggacccttcaggtacttaccactgcaggccgattccagcaggatactccaaggtcgaagttgagttggtcgaaggaacgtacgtggacctcaagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccagcaccgtctccacctcaggctcctgcaccgactcctcctcaggctcctgcaccgactcctcctcgagctcctacaccgactcctccgcaagctcctcttccggcaccttcaaagtcaagggccccccaagctccaccgcctgcccacacaagggcaacgaagaaggcgaaagctgacgccgccaagaacaaggacccggggtacgattgcacgcaagaggagcttgacgcttacatggcatcagaagtcaagagacaattcaagcctcgaagtccagaaaagaagattcctatagacccgagtgtcatgaacttcttcaggggtatgtctgcacctgccaaggaggccattaagctatcggactatgagcgaacgctgaagaaagcatcttctggaaagtccaaaccagtccctcagcttggagagcaaccaaaccaggagattgagccgttagtgaccggtaaagaaatgacgatagaagaatttattactgacaccggtctaactacggatcaattgctaggagtcgcaccaatcgaaaaggcggaagtgaaatacatgtacgaactcggtaaaccgcttgtcaagcctgagctctgcagtccctacccacacaaatgtacaagttccatcagctgtacatggagatgagcgccactggtagagagatgatcggagcgaggatcagggacatggacttcttgcaaggagatgacattctctggatcaatttcaagggaatctacgaactataccaactggatgccctcgacgtctctattatgagttgctggattttgtaagtatatcgttcagatagattcttaatacgtctcctttaattaattaggtccttgtatataagtagactatagaaaataatatactcccttttatcgctgtagaatggagattcaaaaggcccgacggcggggagttttcgatactggattcatcgaccctcggaaagtaaacgtcgcaatgctcgaccaatatccgcaagccacagaggacaatctcgtccatctcctgaaggtgcagcattacaagatgttcatactgttgccctacaacacagagttagtttaattttactgtcttcctataccaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttgacaaggttttcgaacttatagataggtaccgtcataagttcctctgttaattaagaaaatcttgttatgttaattgctactacgaatcatagctttaaactccatgtagggcttggtatcggttccgtcatttggattcatcaacgaacaaatctttgatcccaagggtgaattctactacgacggaaacacaattcataggtccttagcttgtgagctagcgactactacatcgaaatcgtagctagctaggacatataatggattgtaattaatacatgactacatatgtttctatatgcatgtgtacacattttctataatgtaaatatattttggtcatacacacacagatgcatttgcataacatatatatgtataaatacatatatattatgcatgtacatatgtattgaaacatatataaatataatataatatatatatgcatatattatatatgcatatatgtactgaaacatatatatgcatggtttatatatatataaaccatgcagcaacagggccatgaaaaaaaaaggtcagctcgatctttagtcccggttggtaacaccaaccgggacggctgagacatctttagtcccagtgggggttaccaaccgggactaaagattgatcgttagttacggttatttcacccgggactaaagataacgatctttagtcccggattggtag

SEQ ID NO: 57806 - DNA, 3096 bp, Oryza sativa
aggagtatctggtgaagtggtgaccaacatagcataagtcgcttccaataatcatgtcatgccagttggaacacatacgagatacgacatcgcgggtcccgttggtatcgactgggtaactactggacatagtacaagtaggaccatataatgggatctagctacaatacgatcaatcaatatgcgcgccactagccaagtagccattgcacacaaaagaaaaacttttctggaattctgcgtgttttcataagcttgccgttcttctttacgtctgggattagtgatctagagtatacatcaaaggacggtttgttttccatctgtctagctatccacattacacattcatatactatactgctaattgtgcttagactaacactagatattgtcccaccaatacggatgcgataccaccagcaattattaccacaaagaattcagcgtcgacgctttgataatttggtctgttgagacttgagacggcgactgatagtgtgctaatagctccaataattgtataaagtatacgatgaatatataacagaggtgttgatcggtacgtatgtactatgacagtagctagagtttagtctttagtgaggacatcgttttcttgtattattaggttgaaatctaatggggaggcgagtggccagcaaaaccaactaagctgtgggcctgtggtgctggcacctccaaattgaagtcgttgccatctctctcaagaaggggcggatctaggaggattaataggagagtttaaacaaactatataaatttatagccccctcttctaatgaatgtatggcagaaaattttagtggggtctttatggggactcccatgattacaacacaggtagtgggagctcgagaccccatagaccccatggtggatccgccactgctctcaagtctcaagtggaggagatcgatgcagccgccgccggcgtgcggaggagggcttttactgcgcccggaagctgtaggtatcagagacagttcggttgtgtttagtttcactggcaaaaaaaattgtcaggtcacatcaaatatacggacatacatttgaagtattaaacgtagactaataacaaaacaaattatataatccgcatgtaaactgcgagacgaatttgttaagcctaattaatccgtcattagcaaatgtttactgtagcaccacattgtctgatcatgacacaattaagcttaaaagatgcgtctcgcattttacacgcaaattgtgtaattagtttttttttcaatatttaatactccgtacatgtgttcaacgttcgatatgacagggaaaaaagatttgccagtggatctaaacacccccttcctccgttccaaagcacaagtcggttggagcagctacaacaacagattataagtcagctatgaacacatatcgagataaaagagggaagagatgagtagcggactacagatttgtagtcagctgcagtacagactctaagacgcaatgtatatatgacaagtgggaccagacattaatagtgttgtatatgtttataggtaattattgtatgaattggatattaaactgatttggatctaacaattgactatactatttaaacttgctcttactaaaatcatacgaatagcaaatttattacggattttctcagctgatttctccagtgatttagattactaccaatgatgaacattatatcatagttaatgagctaagtacgccaccgatgaccatattaattttttcagttttctgacctggaccactaatgattgcctagtgtagagtccgtacacaaagtacacaacttcgcgtggctacccaaccataacgaacctgacaaatgtcgccactgctgctgctgcttctcttccaatctgcttatgcaatactcacatgattagcctagcttcacctggaccggctcgaatgctcgatcgctgtttcttcaaggtacttattctattatgaatacggtatgaattatgatcaggatcagctaactgaagattctgacgattattctacccttcttggccgggcacttgcaatcgacaagttgctgatgctctgacctcaacttttaatagaagtttttccaggaaaaataggcgaaaatgattgttttgattatcgaacattataatgactggattgcatggaatgtgttgcatatttgtaaattgtaatcggggatgcatcatgcatggaccgttgatcagaaattcagtgtcctttctgaacttgaaaggacgcgtatggtagtacacagtacgtgtccgtaagtccgttgtacgtactttctactagtattagcttggatggtatatgcagatgcatgccgtctcgagctgattaaactgctgcaactgtctcctacttatttccagtttttccctgaattattggatcgaatggtgtaactgaatactcgatctgtcgatcagtaaaagagagagcagtttattccaaaccggccatgtataagctagtgtacttgtctttactgcttcttctactaacgttgcaaggtagagttttggattattctggtaagtagtaaaaaccattattcagatggttttgatagattaaggggtgagttctgtctgataaatagtgataatagagacgaaaagcaaaccacataaatatagtagggactaaatacgaacatcttgctaactttaattcttcgtgcaatcccctgttggtagcatcctacgtacaaaatcgacgttttcatatgattctttcaatgacgcagccaaattataggatgagatcacgagattggctgtgtgcattctctcatgaatgtagaggccgagtttcttaatccattatcttaaaaatgaattataggacgagaattcgagcagctgattggttcctctccactagttgcgtccaataatgcagcgttttcccagtgcaatgatgcactttgttgactgatccaaatgtcgcctgtcaggcagaggattataccgatccaaggaaccactcacatggtcaggttgtacggctgatttttgctattgttcaatttggggaatttttttagggttagcctactca

SEQ ID NO: 57807 - DNA, 1277 bp, Oryza sativa
cctatcaaaccatacacgtggagactgcttcacattactacaaatccgggcttcagtgacgggtcatctgtgacgggccaacgcaactcgtcaaagataagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacagatgacatgtcatctgtgacgggtgtagtattatgaaccatcacaaaagagaccactcatctctgacgggtctttaactaacacacgtcacagataacgttatctctgacgggtggtagttatgacccgtcagtgatgagtgaaaattcaaatttttaaattttgcaaaaaacctcggattgaaacatgtcctatataaaagttgtagctctcaatgatatccacaactttataactaacaacatttctattagagatcgtttacatccccgaacatgcattacaagtgatcagatctacttttaaaaacaaaattttgagttttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagttatttagggtgttaaatatatgttaaatgattcagacaagcatagacaaaataataacattgggttagtagtcaatatgtgttaagtaggtgagttggtaagggagctctatatggaggttgaggtcttgagttcgaatctcacttgtagcatacaagttatattgcgtgaaaaattgtgaatttgtaggtagtgatgtgtaaccatgtataggatggctagtaaaattcaaaatatttttttgaggttttttgttacgtttaaaattcaaaaattgtatttcttgctttgtcatcagtgacgggtcgtaagttacaacccgtcagagatgagtcatcagtgacggtcaggtagttactacacgtcagtaatgactcatctgtgacgggtgacaagttttaaccagtcagagatgacttatataccggtcacagatgggttatctgtgacgggtgtttcat

SEQ ID NO: 57808 - DNA, 1371 bp, Oryza sativa
attgcaaatacctgtagccagtatcctctggatgctgaaggatgtaggcatattcttctcttctgctaaccttcctcaagatccatatgcttaacctcaatagtggcgataatatagtgttgcctgctagaacctgtggggtaaccagaagttatagactggatttctttctgaatattgccatgttatcatttaccggggtgaagccgcagtttgcaaatgaggatactgctgtgaagatggaaaacgtccatattttgatatctttactcttcaggagttgtcttgtatctgagtcaatctgagcaaaaataataatgactaaggagctgcaaacaacagctgctatgaagtagcctgtcactatatgagccaacatattgcggcacttctgtttcatggttctgcttccctgtacccagttaagtgatatggttgcttctgattggaagccttgtgaactattttgattgctatcatttacagcatcaaaggattcaatattccttctcgtcgaaggtgatctttttgggaggacttcgtttgtgttggtctcagcattgttgaagtgcagcgccagcattgaaatggatacttctcctcccaatatcatcagaagtattaacacccagagttgctggttagaaaagtcttccatctctactgttgccatgcttgagactgctgctgtggacacagaagtgaacatcaaatccaggtcccttggagttggcttgtgtcgtggcttgaggatcttcagagcaaggaaaccaacaaaggatattgagatgaagtacacaagttgaactattaatggattgctttggaacatgaaaaaccagaaacagcgtctgaagaaacacactgcacatttggagagggaacgaagcctcatggagataaacacatggaggtgcttaactttctctgtaatgtccctaaccacttggaacttgggctgtgggattttcatggctaatggcagatgctgtgatgtaactaggattgaactgaatggatgcatcattggaggtttgtgggcatagtgttcagtatgctggagttggctactggaaggtgtttcttaggtttcaatgattctgtctttgccaccattgctcactgcaaccaagttctggatcttaatatgtaggatggtgtaagacagatgtgcccattttgcagaatcatgatgctgatggtgtgtacagggccccaacccaggcatgattggtgtatgcacaagcatgtgcttagaatattataatgcctaactactatatgttcttgagtgaaatgattgtcagcaattagaatccttcattcacattttttgagtcataagaatatcctcaatttagattagctgtt

SEQ ID NO: 57809 - DNA, 2133 bp, Oryza sativa
gtgacagaagcatctctatgtgaagtgaatcaggttaattagcctatgttgatttcttgtgatgaactttcattcacctgatctgaaactgccaacacttggagtggagggtgagctttgtgcaaggatgacagtggaaggttcctgtctatgtgaaaatgaatatacaaacaaacggaagagaaagagtacatctttatacttttttcctaccctcagggacctgcaatgttcagctggtactgcatctaagatctaactaagtttccaggctttgcctcctttcatgctgaacttcttgagcctcccaaagaacatcacaaaaatgagtatcagtttgccagagtcgctccatctccctacgaaaccagtccatttatctgtgcagagatggtctggattgatctgtctactgcaactgtagcccattgagaaccccacatttccatatgcactgcaaatgtgggcagatccgtcagattccacgaaagaaaacattactattttcattgtgtattattaagattcagaaatacctgacaagtgttactttgtgttttgctgtttcatcagataaattgttaatttacttggtctgcattttttttctcaggtaagaaaccatttagtctgacttgcctgacaacttcgacaacaatgctagcacactgaagttgagggggtcttctttgagctttcttctctcggtgatgcagatggcaatgacaaagatggtcaggtaggagagttgtgacaaaagtgtactctcgagcagtctgattccctggttctctgcattactatccttagtagtggaattctcttcaaatgggaaccacgtcgtgtacggaggtagatacctggaggcaagatgaagcagaatatgagacaacaaacggtacgagtttaaacagacatcagttaatttgcagcaatctttccaattaaagtttcagtgattagttgcttattttgggcattgaaaatgcatgcatgtcgatgcagctgcttaacgaaatgcgatcagaaagtcacccttgggtggattatcatcttcggatgttcaaaagcagatcattattgagaaataattcagggaaggagttgcagctctgcttgtctaaggtttgatctttcaggtgacgtgcaagaacattctggtgcttggttatattctctgtaaatgatgcgacaataagatgaaaacatggctcaactgactggaagcttggattcacaagcatatggccttgagagaacaatatgggaacaactgctggccggtgaagaaattcctttgcacgcgctacgacaatcggcaggagatatcaccctgctttagccatgcaggtcattttcagaggcacacatcccagttcctaaaccaggctgcaaaagttgacgaatgacgactactgtgctccactattttgtactccatgcatcaactggggaaagatggcgaattttatggaattgcatgtgaaaattgagccataatcatctggaagaaccaaagattggaacaaattctagcaactatgcgcctcccattttgacatgaacaaaattagaagtaatagtcatcaacctcccaggtgaccagatttgctgagaacgcggagagcatattctcaggttgacagaaggtgtggcatgtgatgcatgcaggcttttgaatggagacttggaatattaatactcctacctttcagcaaattgattgtggtgttcttgcaagttgaagtggtgtgctgcgttgtggtttctgtgaagctaggaggagagctatccttttcttctttggcaaaaataaaaaaaaatctgtcaaaaatctaggagaaagggtcaacgcacggtcaactcctacctatggtcacgaactgggaaatgggacagtgttttgacgtttgaaactactctccatcacatgcatctacctacctaaggccattctcaacccaataattaggatgatgtccatagcattaaataagttgctacttaggacaaaaaataatatgcaagtgaataaatgaggaaagagagacatggtttctacacaacatccaagacatcatgtgagataagtagcattaaattgaagtatgaaatagtggtgtttgcattgga

SEQ ID NO: 57810 - DNA, 1875 bp, Oryza sativa
gagcacgatgtagaacagcgcgcgcaccgcattgtgccgcagcgtgtccgcgtccatcgggcggcgtcggctcgccgcctcctctcccgacgacgtcgggttctcgacgtcgccgccgtcgatgtcggcgagcgcgacgtcgccgtggctctcgacgcgccgggatctgtccatggcgtcgctccgcagcttggaccacttggacgcgagccccacgagcgagacgaacacctcgccgccgaggagcatcaggacggtgagcaccacgagctggccgttggagaacacctccatctcgacggtggacatgctcgacaccgtggcggccgacacggcggtgaagaagcggtcgatgcggcgcggcgcggcgccgggctcccgcaccttgagcaccccgaggaggccgtagccgaggcaggagatggcgaggaagtaggcgacgtgcatggacaaagcgccgccggcgagcgcgcgccgcgacgtgggcatattggagcacgcacgcggccgccgtgtgctcgctccggcgcggccggtgcaacggctggctcggcgagcttgtggatgagctccggcgatcgatcgtgctgccgcgctatatatagtcgtgcggacgtgggaggctgggagctatggctgagcaacaaaataggccacgcgtcctacgtaccactaaccatttgatgtcatccaatttcgaatagagtaatactccctcaattctacattgattattatataatcaaaaccagaatttctaaactgattatcatatataatcatcctttcatttaagtgtggcattattgtatctaggcatgtaaatttagtctacatgcatgcatgcagttacaaatgctcgtttcttatgcatgcgagaaagttgaagtatgcttgtttctattttttccatcacatagtcatattaagtgaaatatagggaagttaaggttttcatgatcttgactaaaaagtttatataataattaatatagaacgaagagagtaaataagaaaaaatgataaagtatttcgttactctctccgttctgagctataagacatttttattttctgcaaagtcaatatttaaaatttgtgtactaatgattgaacctaaaatatatggatagaaactaaggcccagttttttagctactaactactagattatggcatgcatatttttaaaactcctaaagattaagattttctttttgaaaaatgttcttcctatatagaaatttcctctttgatgatattcgatcagtctgttagatatcttttaatttagacctctcatcatctttaatgatgtgcatttcttttcctgaagagctacaaaagcacatccaaaacatggaaattgtggaaaccctaagaattcatttcagaaagaaatagaatataaatgatatttgctcatatattccaaagacttgtgctattggaaaatatgtgctcaaatattcctaattctctatgccagtccgccaaaaagattatccataatattcttagtccttagaaagcgagacaaagaacactgaacattgtcttgaaaaaaaaatgtatacttggtactcagagctttgtggttaacctagcctacaaatttcctatgtttttgaggattttatctttttaaaaaattttaagacctacggccgagagttaacagatcgacttggtctgtatgattggatcctattcattcttgccttaggcttttacttaaactaattactccctatgctttttaatagatgttcctattgatttttttatacacatttgaccattcgacttatttaaaatattatatagaaatatgtaaaagatataaattatacttttaaaaacttagtgataaga

SEQ ID NO: 57811 - DNA, 1178 bp, Oryza sativa
aatcggaggtgcctaaaaggtttgcaacttcatccttcaatgtttttttgtcatattacatttgcagctatgttttgcacacttttttgtctccaaaatttagttgtaagttgatgagggagaaaatttgtgtggggaagaaagaatatatagaaatttagttgatttgctaaagaaggttttataaaatagttgagaaggaaaactatagtgaaagttaatcttgaatactagaaaacaaactaaaattaaaattaaaagaagtaaaacacattaaaattagtttaaaactttagaaatagtaaataagaattatttggtgtaatattttatgatttttgtatgaataaagatatgtcattattgtatgactgttgaaacagtttataattatcttataattattgtatgactgtcattattgtaagaataattatttttgtacgattttttttcgactcatgtagatggatcggcaatggatgtacgctgaccggcggtccaaagagtttattgacggcgtgcactattttttgagagtggccaaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtacgttggatttgaaggaaatcaaacgggcgaggaggaaagggatgctgatggtaacgacgttgcggatgatcttggtcagatgttgtaggacgccaaggaggactgcgaaagtgaaaaggaagcccataaattggacaagatgttagaggaccacagaacttcgttgtacccaggttgcgagcaggggcacaaaaagttggataccactctggagttcttgcaatggaaggcaaaaaatggggttagtgacaaggcatttggcaatttattgaactcgtcaagaacattcttccggagggaaacaaattgcccgagacaacgtacgaggctaagaagatagtctgcctgctaggactggaagttcagaagattcatgcatgtccgaatgattgtatcctatatcgcggtgaggagtaagagaacc

SEQ ID NO: 57812 - DNA, 1391 bp, Oryza sativa
ccctggaaagagagagatgtcagaacaagagcataacacaatataagaaattaccctgacagtaatcaaacaacactgacctaataatcttttcatgctgtgtatcatgagcataagcaagcatctcactggccttctcactggctgtcccaaccataagcaagcccattccaataccagctgcttcaccagccacagcactgtccgtgtaaagacattttttatgtcctcatatatctcctcatctgctgttcccaaagctgcaagcccaaggcccaaacaggctccgtgctggatcacctatataatttgcttagaagtaagcaaaatatgcatgacatgaatgacatgagattaaaaagacaggaaaggaataaaaggacacctcagcactggtattgcgaaggctttcacgaaggaattgtttgatcccttcaccatggttagcatgaatcaaacccagggcatatagggcacctccttctgagtatggactaccaccaccaacggcaccactttgaggtaggtagggggccatcaaagctcgcccttgttgaagatggcctctgtgaatgacacctagtccagcggttgcgctgaatttagcccaattggttgccctgcttaaccactcctgcaagaaccaacatgagacaagaacagacaaaggccaaaatgttgcataacagtaagacaacaaatagaaactaaatgtaccagattctctcttaggaaggtgtctacagttgttccagcatgcatgattgcattggtacatattgttgcactgtggcaaacactgttcctcatttccacagcctgctttattgttttcaaaattaaaagatccgacctgttgagacaaacaagttgcatcaaatcagcaccaggcatggaaatttgcaagactggttatcaacggttagcaagtactccctccgtttcacaatgtaagtaattctagcatttcccatattcatattgatgttaatgaatctagacatatatatctatctagattcattaccatcaatatgaatgtgggaaatgctagaatgacttacattgtgaaacggaggaagtaaatagtacgctcagttagcaagtaatagtcagctcacctattgtggctatacaaaaattgcagtgtcaactggatagatgtctcccctgacagtattccttttattttcgcaagcctatcagcacgtgctacctcatttggatctactgtgtgagaactaccatttggtgtagctgtgtcatctctcatctgaacatccccagctggttctgtgctgcccgtacccgcattagcagcttgatcatccggtaaagccgatccactatcagggttagactcaggagtttgtgaagccagacgattcctc

SEQ ID NO: 57813 - DNA, 1028 bp, Oryza sativa
  unsure (1)..(1028): unsure at all n locations
cagcggtggcaacggtcgagtgggtgggtggcggcgcgtcgtctcctcactctttgtccagtctccagttcacgagagagagaacgcgcgtctctcgctgggagagagagagagagagagagagagggggggggggggggcggcggccgggatctgagggaacacgagtttttcaactcgcggagcggcggggatgtgcagcgttgtgtgcttgaggggaggtagtgggttggggttgggctttgatgttgttatgggctttgtggcctgtgggctacgcgaacttggcagtgggggcatgaataagttcactttagatctcttaatttgtcgctgaatctgaaattcatgcttgaatgcaaaaaccaggtatagcgtatttcccatcttacaataccgtgcaaacaagttccctcggtagtattgtgctcggttttaactgacgtgactcctttggctaagtcttcgtctcacatgatattgacgtggcgcttacgtggcaattggatcccgaaaaaataattaaaaccatgggacatacatttcatcctcgcttgtggggccacatgggccacaccaatttttattattttgtgtgtagctgacatgcgggggaatggtgacagtagtggcgatatatagagaaacagacaaggagagtaatggtgatatggaatcaaacaattcatagttttggtgatatattttaaaaggacatgactacgttgaaaccgcaagttatattgtcttgaccagagattcatcttagagctggttgcctactagtataccaaattatacatatctttttttctttttacagttttttattttaaattacttatacccgatatataatccaattataccattgtgttcattgcaattaaatctttacaacaggattttacattactatgttttgatgaaagaaatgtctatgttgtaaattacttttattatannnnnnnnnnnnnnnnnnnnnnnnnnnnnnnnnnnnnnnnnnnnnnnnnnnnnnnnnnnnnnnn

SEQ ID NO: 57814 - DNA, 1145 bp, Oryza sativa
  unsure (1)..(1145): unsure at all n locations
cgtgtgctctctgcaaagcaccaggtggagtggagggatgtgtggtgttttgggtttcggctggagccgtcgcccatcaggttctcctcgtgggcatgagctttcgttcacaggtggtgtaccagtgttggtgtagccgcagtcagagtgggtgatcgccgagatggggtctatttggttgtctgctgattgagaatgtgcatactgcagctggttgaaaccgtcagataccagagcgacatgcgtgtttatcttgcctttaggctttgatactgatgaaatgtgagtctgatcctagagatagcataacctgcatgtggtcgtttgtagcgtggcctgcaggaggtcgtttgtagcagctgggataccacgggcaagggacgagctgttggctttttgcaaacgtgtagtacatccattcacggtagagccagttaggccagttaggttcagtatagagagattcacatcagtccttgatgtggactagcttcatgagttgtgaaactctagagttgtaataaacagtggtgtgctgatggatctagatggcatattgatgatcgaatacaattatacagcagtagatatatattttgagttgcctttgctacgtattgtgattctggtagtgtattcatcctgccaatgattcctcataatacccccaaaaattgtagggatacagaatctgcagtgacatgctgattgaatggtgaaaaatcaagtttttttgattatttcattattgcagcaagcagcatatctgtgtttatattgcactgagcgaaggaagctgtatacatttgtttccccttgaaaaggaatggagtctataattgaaacatctagatagctatccaatatgaatcctgttctacatctagcctatagtttcggtctcttagtttggaattacattaataagataagatttttgagcttcaacctaccataataagcctatagtttcggtctcttagccttgctgaactttatcttacaattcttctatggggtggggattttcaagagaactgtattgaatagcaagttcaacttcaacataccgtaaatccaannnnnnnnnnnnnnnnnnnnnnnnnnnnnnnnnnnnnnnnnnnnnnnnnnnnnnnnnnnnnnnn

SEQ ID NO: 57815 - DNA, 772 bp, Oryza sativa
gcgccaccggcgccggtgttgggcagcacgagggcggggtacgtcggctgctcctgccccgccgtcgccggcggcggcggcggcaccggcagcgccgggaagaacggcggagcggggccgggcggcgccggcgtcggcggcgacgacgactgatccgggaagaacggctggtgcagctgcctcctcgccaccgcaacctccaaaccatcactcccgccattgacaccacacacaacaatcccaaccaccaccaactccaagaatcgccggagagacggcattgccacacacaccgccaccgccgaagcagcagcagcagctagcaagaacaagctaggtcagtgacgccacagatctcgcgaggagagagaaagaagagagagagaggaggagaggaggaagaagaggagtggacgtcgtcgtggtggatacagcttacatggaggaggagtattttggctgctttttgatgattttttttttgctttttttgtttctttttctaattgtgattaggcaattagctaagtaagggtcactatgagggtaggtgattagtgaagggtgaagatattaattagggagagggagagaggtggtggttgatggcttgcttggttttgttctcattctttgtccgttttttgggctgtttaataatgtggagatgaagagggtagttggagaagagtgcaagacaagtgagagagcataggcaaagtgtggaaggagaagcacaagcacgagcagaatgctactagtcactcaactg

SEQ ID NO: 57816 - DNA, 864 bp, Oryza sativa
ctatgcatttttatgaatttaatgagacttgaatggacttaatcggagctcggatgaattagatataatttttagaagattatctgtgtttattactataacaaaaagtccttaaataatttatcgcgcaataaatcccagggctggcgtcatctaaggggggggcggctgcgccgacaggtgggccccgcttgtcagcggctcaagagagagagggggcgccggcacgtgggccccactggcagtggcacaaggcgggagggggtgcggctggcaggcgggtcccaccggccgcggctccaaagggggggtggcgcctggctcggctcggctccgagccgaccggccggccatggggcagcggcgcgcgtggagctggcggcggcacacggttatcggcggcggcgcgggagtcggaggcaacggctggaagcggcggcgtgggaggcggcggcgtcggccgaaggcgacggcgagtgcgtggagaggggcggcgcaaacgagagagaggggaaaagggaggagaggggatcctcaccggcgagcacggcggccggcgcgaaggatgaaggcggcggcgatgacccaacgagcggaggggcagacgggcggcgattgcacctacggaggaaaatggagaggaattaggggttgggaggaagccacggcagctagcgtggccggccggagatgggaagggcggcgaaattcaccggcgcacggagagagaggcgttccggcggcaggattggatggggatgcggcggccgaggtagctttggcggcggagaagctaacggcggcggcggattggctcggcggcggcgctagaggagatcggcgcgggcgcggtagaaggcatgc

SEQ ID NO: 57817 - DNA, 2388 bp, Oryza sativa
gtttgaggagaaaaactacgatgcacctcgttatgttgtatactcgttccgtcccaaaaaaaagacaaccttgtaatatgatgggatatatctatccagattcgttgtactaagatgtattacatcctaatacgatgttggctttttttttacggaggaaataggtaagagtaggagggtggttaagagtaaaatgtgaaaaaaaattgaatgagaagtgattgatagaacaattagtaatatatggtaacaattattttttagataatttttttggagaaaaggcgcaaagcgcccaactttttactagaaatcatatgagttcatacaacaataaacaaaataaacgcgaaaaggctggggattttccagcttatatgaggcgcaaacatgcaacacgcatagcacttagacagcgcaaagtctacacacaattaacaagtctggcaccgcggacaattctgaaggattaagacaatttttttaggctgtgtttagattggcccaaagtttagaatttggttgaaattagagacgatgtgactgaaaagttgtgtgtgtatgaaatgtttgatgtgatggaaagttggaagtttgaaaaaaaaaactttgcaactaaacacacccttagataaattttaattctaaaaatataattactatgagatcggatgtgctgtattttaggacggaaaaccgaggcggctacactggaaggccgctgaaacctcggctggtttttgcggtcccctcgcgcggtccagccgctgctcggcgttgctccgacctacctgagctcccgaacccagtccaagccgggttgtacgggaaccaccgacactttctctgtcaaaactagctggaactattacatggcgctcacaccaacacaatgacaggtagcgacccgtgatttgggtggtggtgatcgcaccaacccaagtgtactccaccgagaaccagctccgtaaatgggacaaaacccaaccccactcactaaggctcatgagtggaatcactccaaaggtggggttaattgcatttggtcttgtggatatgcacgtgatttgtccctactgtttactaccactctttctgatctatgtagataagaccagaaacaactttgtaacagaattatcctatctaggaatacatttatatcgctctcttttatattataggtcatgctttaattttttttatagctaaactttttatagtttgattgaatttataaaaaaaaaatgtaacaacattttcaacacaaaacatacatattatcaaaataattaaaactactaatttgatattgtagatattattaaaatttcctataaatttaattaaacttgaaaaaatcataaaaaaatcaaagagatatgtaatataaagtagttaatacactagtaagagacatgagaaaaaactacgttcaccatatacaatatgcctcaaatcaaaatataaagattacaacttagtgtagtaccggagtcatggatgcatgaccctattcaacaggatacaaatttttaatatccacgaatataagttcggtgttacgtgtgcagtggtgtagtggtgcgcagtatccgcatatgcgtttgctgtgtgcccgcgaaaaaaaacagagtactgtttaccctgacacgtacaaagcctgtaaacaaacgtgccacgtcatatcgtgcggcgcggaggaataaatacaggaggtgcaagcggcacgctggggcagaaggcaggcaaaaggcacactcattcgcgggccgcacgtgcagcggcggcgcggcgcgggtggatcgccgacggcgagaggagcaatggtggcgcccggcggcggaggaggaggggcggcgtcgtggccgtcggagggggaggtaaggtgccccgccccagtggcattggtcgctctcgtagagcggtgcgggtggttccgatcccgcgcggccccgtagatttttcgcgtttctgcttcagtgctttgtttgatttggggggcgaatgcttgcggggctggggatcgcgacttctccggcgaaatattgctgcgccggcggcagcaccggcggggcggtgaccccccgtggccatcgatcgatggcggcgtcacagtgtagtagaattacctgctttcccactgcttggttggtggtcaatctacatctaattaccatgtttgcaaaaacattcaaatatgcacctcttttattattattgttgttgttgttgttgttgttgttatttggaaaggaatcgattttagtttttcagtttggtagagtggtggtgcataataaaagagaggaaagtatggattggcagtacacgtgagatggtaatgttagctcgaattgatgtggcaaccatggtccatggatgcta

SEQ ID NO: 57818 - DNA, 1680 bp, Oryza sativa
tcatagtactattcaagagcacattttctcatatatcaaagataactagataaggtattctattctaagtaggaattgcgtcagaaaaaaagggaaattacagggcacaaggtggctgtccacatcatctgcatccatgctgactggaaggatgatcactcattctgtttcaccttctcctgttcttgataccaacctttatccttatccaaccttcttgtgtttttcaccccaactgctgggattctgggagcatattagtagaatattacctaaccaatttgcacacactagctgccaaagatgccatccctaggaagccatgttggaacagaccacttgaagcatcggtgctcacacgacaaaaccataaaactccagcagctgtttcttttcttgttgtcattgccagacatgggagagacggcagaaggtgttgaagcaggcgagaaatatgtgagcataccacagttggctggagttggaactcttctctccaatggaggaaaggtgagactgatcatagtatttgatagccctgatcttcagcttagcttgtgttctgttgttctgataaatattctctaattttcttgtggatatactatttggcatccaagcatgatttaaatatagcaaataaacatcaatacatagaagtactccagggattggctgttctgtttcatgatcaaatctgagatctctgcataagtataaactgcgtaacatggcatagtttttccaaatgagtatcagtattaaaccttcacactatgcagtactgaaaaaatatgtttgcttttggtttcagaaagagaagaattagttgtctcctaaatttgtcattgtgtatcaaaaacagaaatgcatctgtcgtccattgaagggaagagaatgtgcctcttcttctcggctcactggtgcaggccatgcaggaactttaccccaaagttgctccagatatacaggaaactcaggaatacttgcaagaatatggagataatcttcatatcacttgaccgcgacgagatcagcttcttggactacttcaaaggcatgccatggcttgccttgccttttgacactggcctaaggcaaaaattatgtgtgcaatttgacattgagcatatcccagcattgattcctctgtcaacaacgctatctcatggatttcgagtcgaagaggatgcagtgaagctggttgaggagtatggagtagatgcctacccctttggtgcaaagaggagaagtgaactggagggtatggatgatgccaggagacaaggaggtaatcttctgcaacttcttggatgcaaggaaagagaatatgtcataagtgcagatggcataaaggtgaccaaaatcataacctataaattcgtaatttgcttgtttatgcattgcgtatgtttaggtaaaatataaggctaaatgatgcagactatgatagatggtgccagtatatagatacatgctatgacagtaacctgctaacaagaaccccaacagattgcactaatacaagctaatatatgagcacagtcatcaaaatcttaatgattgtataaccattaaactgagtaaactggcaatgctagattaataatagtaatctagtcacaaacaatgaaaccaacaaaatatgaattaggtgaagctttatgaagctacatgaga

SEQ ID NO: 57819 - DNA, 1589 bp, Oryza sativa
ggtaaagtgttcaaaacagacggaaggagaataatttcaaaatatggtgcaatggcattcccttttacagaatcaagagcttatgagttggaagaagttctcaaaaaggaaagggacagcctgcctcaccgagtgagagatcaccgtcatgagcatgagcttgagttggacatggctaaggcttatgtatgcgatgagtgccaacagaaagggcaaaactgggtcttctcttgcaagcagtgcaacttcgatctccatccaacctgtgcgcaagaaagtactgatgtaaacatctgagatatttatacttcaaatatactgacaacaatgatgtatgcgtttatgtatattgtgtccaacagatctagtgctaatgggcactggaaaaaaaaaacttttaagatctagtactacgggactcaacactcaatagaaaaaacagctaacgttctgtgtccctgaatgcaagattaacagatggaatctatgggtgcacattccaagttccaacaacaaaatagttatgtaatgatttttttcaatagaagtattcatatgtgactatatataatcttggcaagggatgttccaaagatttatgtaactcatgcactcatgaactgatggaccatctcatatagctatccacgcagctatttcatcaaacaccaagcgtgcagccgtgcaggctcaacctcaagactttaagagaagaatatcatcttattttcacgaacagcaatagaaaaacatcacgaccgcaatcctcatataccaggcaacaacgaggtagtctcagaactgtagcgtgattggattctgaacggctttttcagatttgaacaacctatacagcgatccgaagcacttaccacaacttcacaagcacttcgaccaatcgaatgtggccacagctgaaaactctctgagatttctcaacggagagcctgaaaacagcgacatttcctcgatccacgtagccttcgcggatttggcaggaaaaatcaggggagaggatgataaaagagactgaacaatttaaaacgggagaattggacggcagcaaatttagcaaatatccccttgtacatattcacaaaagggactacatttgttaaatattaaactaaggtcctttgtcatttccaataaactctttgacagcctcaacccattgcagccatggtttttcacgtcaaactttaactgtctgccttatttaaaaaaaaatttaaaacataaatcacgagtaaaatactatttatattttatcatctcataataacaaaaatactaattataaaattttttaaataagacggacaattaaaattaggcgaaaaacttatggttgcacttgaaatgagacggagagagtattaagtaagggtaaagggtccgtacaattggttatttttttctaatatttactttgttgttcttatttcttattaggagtattttttttttccaaactactaaacgatatgttttatataaaaatattcatagaaaagttataaaaatcatatttacctatacaaaaattaaaattaaaacttaattaattatatcctggtgaatcattt

SEQ ID NO: 57820 - DNA, 3075 bp, Oryza sativa
aagatatgggtaggttttgcttgtcttttgctctttgttcgttccaggatactgcagtaagtttcatttcttcatcagtaagtttcattttttttgtcaacctttgtgcggccatagaagatgaatggagaacttggattgcagcgggcttgattgtagcttcgtaagcggcggaggcggccgtgtgctgtagccttttttcttttctgtcttctcgcccttagttttcgggggcgtgtttgtaataatgcacattcttgcactctttcttaatatactctggccggcatccttttgctggcccggcaaaaaataatacattttcatgattaggcagttgaaattagatttggagttaggattctatactttcaatagctttttctaccaagcaattgcaacttttaagtgattgtgccgtttgttgccaccatagtgactgtgagtgaaaatgcattccaatgaggcctgcctggagggaggagcgatggggcgtgaggctctcacctaccacccggcggaccaccactccggtgcccgccggccaccatccaagccgcagttcggctcgtggcgcgacgtcgtgaagaaagataggggccttgccgccgctgaggaggcagcttggacggaggtccggcggaaggggagcacggagcattcactgcgggcaggtgacccaacctccaacaaacaggacagagcattcaagccgaggaaggagttcagcaaccatgacagggcattcaattcggagaaggagatccctcgctggcttctggggcgctgcttcaagtgcctaggattgggtcatcgcaagcttgactgcaagggagagacaaggtgtttccattgctggtacccgggtcacctagcgtgggcgtgtccggagaggaaggcggtctctgggggcaatccggggcggcagtgcgtctgggcgcagagaggtggccgtctgggagaagagaacaacaggggaaggtgaagcaggtggtggtaagggaggtgccgccggcgaagtcgaagatcgtcaagccggccccacaggcgacagaaaagggcgcggtgatagccatggcgggtgctaacctgggcgggtaccagatctgtgcggccacgccgccgcagttcgtggaaaagtaccgcatcggcgagcccgactcgtggctagaaagggggcgggtggtgctgtcctggacctccgggatggagcgccatgagaggtacctccaggaactctccctgatggcgtcggtgctcaagggacggccgcccgtctcgccggcagagcttgcggagacaatcgagctgcacacaggcgtgcagcagcgttacttcagggtggaggtcacgcgcccggaggatttcctgatctcgtttcggaaccagagggagaaggaggcggtcctgcggtgttcgaaggcgctgttctgtaatgaggtgcctgtttcgttcaagccgtggaacagatgctgctgggcggaggcctcggctttccagttcttcaccaagatctccctcgacggccttcccccgcacgcctgggaggaggaagccatgcacaagctggtcaacagcttggacggtcagcttgccgagctgatcccggcggcggacgcgcgctgcctcggtctcttcgcttggttcaagaatccgtccgaccttccccaccatctggacgtggaaatcccggaacgcccggccgcagggcgatggcgggaggggacgagcgcgacaccaccttccccgccgcgggagaagccggccctcacctatccggtcatcatccacgtagaagaagtcattgaccctacgccgttgcatactccgccgacctccttcgacgacaactccgatgatgaagacgtcacccggcggaacactttctcctgctgggcaggtcgctacgatggcgctggtccctggccgacggaggtgggaggcggtcatgtctacggcggtgcgaccggttcggcgggaggtctaggcgcgcgctcctttgcccccatcccaggggaggtctcggccccgccaaggcggttgcttcaacgcctggcgaccatgccggcggcggggcagtcggtgacagaggagagccaggatgatgctgtcttgacagctgcggtggtgggggtcattgacatggcagcggcggaccgggttctagaccgggctgacattgttgttcaagacatgaaggcgggggaggtgttggcgtcacagccgcattcaccgacgttggttttgcaagcgccgggtgtgtggttctctccgcaagcggtgcaagcagtggagcaaccaggggccgacgtgggaatccctaccccgctggcggcgcctgtggttgcaacggcaaaggcgcttatcgttctggacgacgactgcagctgggcgctcgtggccggtggtgtgtcgcctctttcatcgccgctccaactctccctggacgagttaaccggcggtgaactgtcggcgctcggcacggagaatgatggcgaccgtgctgagctcagtgatgaggtccgggaggccactgtggaccacgttcacgttcacggggacgacctggcttcagggcaggaagtcgcattaactccgaatgggggatatgcattaacgcgtgttgcgtcggcctcgccgcgtattagagcgagccagtcgtcttttggcacgttggccaagaagctctcttttgaggatacgatggctgaggtgtcgctcgtggagcatgggtgcgagcggccagcattgaaggcgactggcgacgcgctgagctcaacgcaggagagcaggagtgatcgtgggtttgaatcggcggcaaaggcgggagagttccgtgtctatgtgcggaagcaggcccagaagaaaccgagccatgagcaacctgggccggaggggatcggcctcatgggcttggcaggccaggatctggggcaggctgacctgggacgggctgtggctggcgtgggacaggaaatgtcggtgggccaagttgtatgtggcgaggacgagccacctcaggcccaccaagaagaagtggcccacagcgacgacgagcggccggtccaggaaact

SEQ ID NO: 57821 - DNA, 1297 bp, Oryza sativa
ctcatgtgcggacaattcaaatccgtcagctactacgcgttggtttgtgctttgattggctcaccatctcttctacttctgtatgtcttttgcctcgctgaaaatctcagctgctattgagctcccaattgtgccactgacaggtacatgtaactgttcttaacgacattgacgcgctcacgcgcatgcgccgctgcactggacacgcattgcacgctgccgcttgctttctatggacttcagttaaagcttgagcgtatggctgaagaggagtaagagaaagtcagaaagattttatctcgacttgttagcacgtttttccaaattattaaacttacctatcaaatggtatgtttcgttgaaaattgtctttgctttaaaatatcaaataaatctatttttcatgtttaaaatagggagaatagctaatatggtcactaaagtttcgctcctgggtcattttagttcttaatattttatattgtccaaacaagtcctttaaatttgtcatgtgggctaatatagtccttggtcccaccaaaatcgccacatggacatgccatgtcaccttcctatgcaaaatctatatgatttgtccaatttacccttacgcataggaaaataaaaaacaaaaggaaaaagttaaaaaaaatatatggtatatgcaagagcaaaaatatacctcaaaatggtgaaaaaaggaagtattttttcctatggttatgtctaattcacccttatatttatttttctatgatatacgtaagggtaaattggacaatttatttagattttgcatgaatgatgacatggcatatccatatgatggttttggtggacccaaagactattctaggttttatgacaaaggttaaggatttatttagaccatttaaaaggttagggactaaactgatcctacagagaaactttagggactaaagtagctattatctctttaaaataattaaaacttaggacctgttcagatagatatcatttcaaaccataccaatttttggtaaaattgtgaaaatatgtgcatctatttagtttcttactaaactctgataaataagtaagaaatcctactaaaactttggcaatattgtcaaattgccaaaaatttggcaataccaaaatttggtaaggtttattttggtataatccgaagagaccattaattattcatgcactatagttcaactttaacctgttttttccacagcggttttaaactgttcaaccagcattttgccaggatatttgacaccctctcaaggatgtgaggttggta

SEQ ID NO: 57822 - DNA, 1099 bp, Oryza sativa
  unsure (1)..(1099): unsure at all n locations
ggaggcggaggcggaggaggacggggtgagcgcgagggacggggaaggcgagtggcggcggcgggagcgcggggtgcccagggcagcgggggagtggcggaggggaggcggggatgagggcggcgaggacggcggcggcggcgcggtgatgcgggtcatcgccgccgacgaggtcgagtgcttgccgccggagaaagagaaatgcggggtttggggtttgggatggcaggtcaggcctacttgtccatgggccttagaaacaaataagtgggcttttgggcttttgaagggaagtgaaccggtccagccagtaatggcatgacatgtgggacctacctgtcgggctgttccactacctccgtccaaaaatattatattttgagatgcttctaaaaatacattttttgaaacatactacagcgcagacgctcacaacttacgcacactcacccctatgaatacacgtacacatatctttcccctacgggcactttcaaaagatgagaaaattgcttatagacattagtatattaccataaaaattatatacgcgtatgtaaagcttttattagtattttagtaacatcaggtatttgttgctacttcctccgtttcacaatgtaagataattgcnctatttttgtatttcaggcatgcatggtggatcctgaccataaaacagaactggatcttgacacagaatttctgacaccaatgtctttgcgaaagctaccgagaaagctcactcttacagcacataatacatgcaaaggcacatgtatatgtgtggctggcaatttacaaaatagaatgattttgtagtgaccatctacaaatgaatcgagccattggctaccgcttacatcaattcagagacttgtttattgataagaggaacaagccgttgtaaaatactatatgcctgccgcatctactttatgacacaagaccgtgatgatagttaaatgtacttctgtatagaaagttgcttgggatgttcgacgtgtgctggtgcatgaaaaatctttattttttttgggtaacttctgaaacaaacctattggtttttttttacaggtgaacacaacgccaatcatgt

SEQ ID NO: 57823 - DNA, 1273 bp, Oryza sativa
agcattattattcaaggtcgatcagcagttcatcctaccgatatggaagttgatgataaccaaaataaagatgaaagcgctgaaggatacaacatggaggatggaccttccagtcacaacaaactaaatccgttaagtgcagatggtctagtaggaaacagtcttcctaattggcatacatacaatgtgcaaacacctgatctgaatgatatgctattgaacaatgatgggaatgcaggaccatcagcttcatactatcaacctagtcccttcccttgtgatgagcctgcatcaccagagtttgtaagtgcccaggccccggctacacctggcctaatggaagagactgttccttccagagtgcatgaaagtcctgttctgagtccacagcgaaaagcttcaccatcaagcaatgatgaaactgcaaagacagctgaaaatgctaatgatcttgtgggtgctgagacgactgaacttgcattgacaaagcctgtgcaaattgaatcttctggtgctgtacaggagattgattccttgagtcaacaatgtgcaactgaggaattgccaccccaagctgaaacctcaaacttggaagctaccatggacaagtcaatgataaatactgatggtgtagctgcatcaggtgaagctacagctgctaaagaaaccactgaagtgtcattggttgaaaattctttagagctatgcgctgatggtcctactgaacctgtgattgagaaccaaacacagtttaatgatggatcagttgatgtgcaaggtaaattgactattcgttgattttgtttttaaagtcattgtatttgataaaaaaaaggtgaaatcatctgctttttgattatttgttttgcagggggcggtcagcatgcacctcatgctatcttagcaactgcagattcccaagtgaatgtagaagcatcaacacaagaaatggcatctaacgatataccaagtgacctaccaaccttggaatttccagaacgtgagaaaatgctgtcagctccagacgttgaattgtaccaggcaaatgacttgggccaggtaactgcagaaaagggaaccactgaatctgatggaagtaacaaagtaggtagtctcactagcagaaaaagacacttggaggacagtttgccagctctcgaaagtgcaactactgaaaaattgtctagcagaccacgtggtaaaagaaccattgatggtattcctgatgatgatgatttactggcgtctatattaggtatggatgaacctcctc

SEQ ID NO: 57824 - DNA, 766 bp, Oryza sativa
  unsure (1)..(766): unsure at all n locations
nnnnnnnnnnnnnnnnnnnnnnnnnnnnnnnnnnnnnnnnnnnnnnnnnnnnnnnnnnntctccaacaatatattttctggacatttaaatatttaatacaacttcatccatcagattgcaccaatgcctatacttttatttattctgggtctctacaacagtaacagaaatttgtacaccttctcgagaaatttacactcagaagaataaaaaatacaaggcgacaatgaaaagaaacagctttagaagacttgtatctgtaaaaacatttctgtatacaggcttgaaaactagtatcagatccttggcgccatcgcattgcattgcaccagcctatcgcccagcagctctcatgaacttgtcatatgggcttgccggtggcagcctgaacgaccggtcagattcgcttgatgccgagtcgctgcgtcgcattcgctccttcctcgtcgactgcgtctcaggctcagaccgagcagatgactgcaacaagatgttgatgagtttttcaggacattttcaaagatttcagtagtgatggatagattttttttttcctgtcaagatgaacatgcctcgtttgtttccagtccattttctgcagtcgagccacgggaatcggtcctcgagtgtttgaagctcaggagaacagacatactctgttgcttcttcatgactagggcttcgcatttgctcctcatttgatcgtanggtacaagggttgcagaaacctgagcattaacaacctgccttgctgtctcatgaacc

SEQ ID NO: 57825 - DNA, 777 bp, Oryza sativa; identical to SEQ ID NO: 18859
  unsure (1)..(777): unsure at all n locations

SEQ ID NO: 57826 - DNA, 5635 bp, Oryza sativa
cgaaacactgcaattttattatcaagcagtcagttaggatagcaaatgtattggtgcaactagacaacggaaccatctaaaatccaatatccagaaaaactgatagagctagacaagcatatgaaatttgtgctggttgtagcaatagatagtgtttgtgacaactactatactaccactactgggatgtggcaacccacctaagtggctctactgaacaaaacaatcaagatggatggcacgaactactgcaaaatgcaaccgcgaaaagaagagatgctagcaacatcaaatgggaagcacgacgaccgaaatgccaaaatacattatcgtttaagcaagaaatctacatgacaccatagatccctaccggatcgaaatggatcccgagaaccgagcatcatatccatcgccacaaacgcaaataacctcgcagccgcactaccaatcacccaccgagctaatcaaggacacccatgaaccaaaccgcgacgcagcgaatcaagaacgaaacagcacagcacgcagcgaccgattctagcagggctgcaaggaggttgagaggatggagtgtgaggatcttaccatgtcgctcgcctgctgtggctgctccgctgcggcggcggcggcgcgtggaggagcgaggagaggggagaggtgggagaaggaatagttagggtttatagcggcggctgccctcgagcccttttatccatccactcgaagaagaaacccgagtcgcgcgagcgcatcgggcggacggatgcggtgcgggagatggatcggacggctcagatcgtcttgaggggttgctctccgcggcttgatgggcctcagtctgtgggcctgggaaaggagataattcctcgttggaataagtccgttttgcgtcccttttctgttacgcttgcgtgaataatatccctcaaccggaaaactgggtataacgcctccttctctgaaaaccagagtaaatcacctccctcgcggtttcggagacggttttgtcctacgtggcagctttgattctgctgactagctgagtcagcttatgggtcccactcgtcagcaactctcctcttcccctattatcttttacatctcccgtggcgccagcgagacaagcgctgaatggaggactggcggaagtcacggcggcggtgttccggctccgtccgcgttggaccagcgacgcgcgcgcttggggaggtgaggcggcgacactaccgatctcgcttaagatgggggatgccgaagctcggggaggtcgcggtggcggcgttccaactccatcaacgttgaaccagcgacgcacggtcaacaacccctgtgccgcatcctcccgtgccaactctgtgtctgccggcgtccatctccgtcgggatgccagggacgtcggggacatgtgccgccgaccacgccccaccatagtagaaaaagtcggaccgaggactgacccgatgagcttgtcggttcactggttagaccccggttcatcggtcggaccgtggttctatgtattaagtaaattagtgttcattccgttcagtaacataatcacatcatcttatatattcttatgggtattcaatttgctgctgctccgtgctcctccaagtagctctgtttagccccttgacgctatattcttatccagcctgacattactgttctagtcaaaatgtgttctttcagaactgtgtaatcatccgtccttatgtctggtcactcactcactcgatgtttgtatcttcaggtcttttgttaatgtgaccaagaagaacgcgcgagagacaatcagtgtgctctctagtctctaccccttctgtgtcagatgttgatttgataaaactaatttagtattataaatattaatatatttgtttataaacttagtcaaatttgaaatagtttgattttgaccaaagtcaaaacgtcatataacctaaaacggagagagtacttagtagttagatccacgctggaagttattctgctctcttaccatgtacttcctccgtcccaaaatgaagctatttttaaggttggcacgggtattaagaaattaggtgagaatgattggaggaagtgtgtgattggttgaaaagagaaaataggtgaagaagaatgttgtgattggttgagaggaggaggtaggtgaagaaataggtttattttgggataagacactgtattagaaataggtatattttgagacggagggagtatgtgaattgtgggtagtacacatgacggcaccatatgtacgttgcaatacagcagaaatgatcacgagatgcgacattgcttcacattttgcatgagtatgctgacgagatttcagtatgcttcgttgttatattagaggattagtacttttaaggtgttgcaggtagtgttagcattctcatgaactcatgcttggcaagttggcataatccgatcatatagatctacatgaaattttgatatgcctgcattgttcataaactgattcctgcaagccgctgctcccgtgactcccttctagttgcggtaccgcttatttttattatcttagtttggatgtcaatccattaacccattaactttgactaaaaatctaaaatctgcttcggaaatgttgctgcgaagtggctgtcgtttagattagttcatgaagagctaccaagtaccaagtgagattcgctcgctttggcttacttagttgtaacaaaccaatttaaaagacgaattggtgaaaattggagcattcgaggcagtaatatgtgaaatttgagattgatttggaggcggtgtgtgcattgttagcattacaaaaccagttgtaaagacaaacaggagaatctaagacaggaatgtgtgaatttttttttagattttatagtctttttcaatcctcatgctggacaatcaacaagaatgtgtgaaaatattttattcaaagagttctaactcatgctggacggtaaactttagttagaaaatagtgatggactcgtatttcctgccaaaatcactatatagaaaccatatgtcaaaatctgtcaaaactaggaactacatgcttcacattgttatcaacataatgaatgagcaagcaagatgtcaatctcaaactgaatgaatgacacaagcaagcgatcaaacttcatctagcgagtaaagagcccaaggcagctccagttcagaataaatgcaggcaagaccagcagatttgactgcccattgctaaaaaggaataacataaaacaaagacaagtgaagaggcaggcagaacacaattatatcaatatccaaacggcagcttctcacataaataagataactgatagctcaaggttgagaatcaaaaaccgaaagaaataggttctttgagcagagtgcagaacataaacaaaaatgcctgttgcaaattgcaagactacaggtaaacttaaatgccatatggagtttgtttggcagcataagatgaaactactgtgataaggctactctctcactcgtcatcctcttcctcgtcatcatcatcagcaccagcggaggagttgagagcattcaatctttcgacgagactggccttcctctgctcgtaggtcagcttcttgaggttgtatctgcagcaaagagatggcaagttagttacatcatacatggacatcacaaataatctttacgaaaatcatcagccagcttaatatacctcttgtgggtagccggttccttcttggtcgatttggccatggtaggatcggcgcggatggcagcatggaccttcttgtacagtgattccatgccatcagcgtcaattcccttcttgaggtactcactaaagtgggcttggaatttctcaggttcctcctcagccatagactgcaacaagtacataagaagaaaatttatcctgatgacaatcaaaataaagcagactgagctaaacagtaacaaataatccaaactttatataatgctttagtcaacgttataaacatcaaggcagctacataattcctaatacaacccacagcacgaacaattgatctaatagtgccagctcaccctcatgtagtcagccacgtgcccaccgtagatgtacttgcggtgaatatcagaatcaagctgcttctcgtccttcttgaacccagcaaacctcttgtcactgtgaggaatgtcaagaccaccatccaaagctccctgcagaagaagagaagtatatccacatgagctactaatacagatcaacaatccaaaggttatattgacggttgtgtttctaaaagagctgatgaatttgatgttcaagtgacaaatcaactattattacagcagccaacagttgagatcaaagcacaacacaccttgagggcaccaaagacacggtttccagtggttgtcctaatgaggccaacatccaagagagcacggaaaggcctcctttcatcagctggttcaacatagtagtcctccccagtggcctgaccaaaggaatcatacatatcaagatcaagaccagcatgagcatatagagtaaaaaaattataaggattatatttgtacctcaacattgccctcgtactcctggtccaaaccacggagcgtgagcacacgacgagccagaagcaagccagtgcagtaagctacacaatgcatcaaaacagaggaattaaattgtatgcatacagcaacacaaaccagcattctgcgtattcattcaactgaggaaactacctgccgcatagttggtgagaccaacttcaagaccatagcgaggcagctcatgggagtaggcagcagccatcacgatatcaccagcaatggtagcatagacaatttgagctgtgatatctttgtttgtctaatgtactattaaggcatacagtatgataataacaaatatatagtataataaccagaatttacgaggaaatgcataaatatcatgatacaaagaacaaaaaggatacaaatctcacaacgaagcggtacttcggtgtgttgtacttgttcttatcttggttggtgagcctaatcctggccctgtagtcagtcttgccctctgcaaacaatgacaaatgagattaagtacgtcaaaaccttgacttgacttggaaacgcctcggtctcttgaacttgacttacgcctccgtctcttgaacttgacttggaaacgcttgtggtaggcattggtcttctgggtcttgacaaaccctccctggagagacattatcatattaatacaaacagcataaaaactgaaggcaagcaaacatgtgaaatagacttaaatttgagaacttcctaaacgcatatcgaaacactgcaattttattatcaagcagtcagttaggatagcaaatgtattggtgcaactagacaacggaaccatctaaaatccaatatccagaaaaactgatagagctagacaagcatatgaaatttgtgctggttgtagcaatagatagtgtttgtgacaactactatactaccactactgggatgtggcaacccacctaagtggctctactgaacaaaacaatcaagatggatggcacgaactactgcaaaatgcaaccgcgaaaagaagagatgctagcaacatcaaatgggaagcacgacgaccgaaatgccaaaatac

SEQ ID NO: 57827 - DNA, 18594 bp, Oryza sativa
  unsure (1)..(18594): unsure at all n locations
aaagctggtaataccaaacaaaccactcacagaggaggattgttgaaatcacaacaatgcaagctcatcgttttgcttatgctgattataaaccataacggtttatcaatgataaaaaaaaatattgtagtaaacctttttatacatgtgttcttagcgatttataagtaaatgctgggaattgaattgcgatgaagaagacatagttgtacaatatttgcaaatacatcgggttgtataaattcaccattacaatacatagttctacattctgaacagacaccacacatcacacagatataggtagtataaactttaccaactagtgttttttgaagcaaataaaagcaacattaccactactgtacaaagttcttatttttaacagttcagacagctatttcacaatacaaaattaattggcttagtaggggacacgcaatcctatagatgaacatgagacatctgttccaaggatctcacgtttcaattgtgctagggcttagcatccagcttcatgttgtggagccttagcttcctctcgtctgaaagtagctttgcaaaccgtgtgagcatatctgcataggtcgtcacatggtcaccatgaaggtttggctctggctcaatgttgttcttctcacactcttccttgcttagtggcttcttgagaaggttttcgcctatcttaaccaacagttgaagatgatccttcgtcgagaggtcattggatattgcccctattgggatgttgtgatcctgtaatggtgaacaaggtataaatgttttttatacaatattttttagaacatgtcaacaaataaataactaacttggatggcacccatgacaatagattgtaaagcatgggtcgcgtacctgaatgcgcaatagttggtgtgaacatccgattgcttgaaagaggtctgcaacgagagtatcggccatatctgagctggcatgaaagaacatgttgagcaacggcattgtatccttatcaactagccatcgaaaaatgccccatttggcaacatttcttgcatcaaacatgatatcgtgctcaggcagacccgtgcccaaagatatcaccagatacttgcggtaatccaagggctcggctttcgggaactcctcgctcttccgcttgatctgctttgttatctcacccatagtcaccaaagtctgccaaattagagacatcaagataagttagcatcttaaatattaccatgtccagtttggcaacaaaggttgatgtgaagtctatacaaaacacataatgaaaaaaggcatattgcgttactgggtaaacattattgttgaaagacaaaagtatagagtttttacacaggaatttaaacccaacaaaagttgacaatttcagaaaaatgatgaagaaaaaacatactggattgtttgctgccatgccaccatcaataatgttgaagctttgcgatgcacccgtgtgatccacggtttcaaaatagtgtgcagggagaaaggttggtgctgcagatgtaccaatacatacatcagcaagacaagcattcttcaagggcttacgtctcgcctgcattgtagcatatacattagttcacaccactccaaaaaattgtcatgtgaaatccacacgctaactcagtttagagaagggaccttgaatgtgctgaatattattggcttcacacacttcacatcaaaagtgggaatcacaacatttgtcaatgtttctttcatcctcgtctcgccaagaagatcattgattagtctgtgaaggtattttccatcatactttggcccaatggccatctttatgatgcccaggatgttgaagaaccaaccaaaaaatccagtcctggttgcaaaatccagttgacaaaataccatttatattttcatagctagttaaaaaatcaattaacaagagaacagttcaactcagaaattggttgaccataaacacttagatatggtcatagcttctctactgacctcagacagaaacatacaactacataattgcaaagattgttattagtattaactgaagcctgtaatacatactttacctgtgcggaaagatgtggggggaatgcttgaggtaaaatgggacaatatccttggcatagcatggttgattggcattgcccagtgatggagctgctagcatgcctgcaataagaccacctgtgcttgtgccagcaatggcatcaaagtagtttgcaatccgagcatccttcccatcaagctcctagaagagcaaagcaattcaacaagtaagttactgccagacatgcgcagagaaagaatgttacccaaagagaagaatgactcttaatcatgtagtcgaaaggccagatgaaaatttcaaggtgagaagatgttacttagaaaggctatgaattccattaacataatttacccaagcctactgatcactaagctatactacaattatacatgggaagaaattaacaaatataggattgacctgaagtttagattccaggaatgagaggatgacagcaggaatgatacccttcaccccacctccatcaatactcagaattgtgatcatgtttcccttgcttggtggtgggcatgcacaattcttctccatggcagaggcaaacaagtcagctgttgatcacttgcaaatttctctctctggtggtctttctcaacaaaggagagctatttataggtgatgagggaaaagataactcaggatgaaaaaaaagtaaaatgttaactttgaaccacaagcaatgtttgcacgtattttacactcaagcattcagcatctgccaaactgctggcaagcttatccaagcttgttcatgcgttgtatgtatcttcttccaatggtccagtaagatatgaaagtctcatatcttcgaccatctacgtgttttgccacctttaaaacaccacttttatgttctaattttggctctagttgacaccccatatgagtacacacttttatgccctgcaagtcatgttaacaccaaatggaaactgacaatgcaagtaaacattcacacattctgtcacctgctccctcaccctgacctttaatgctctagacttgtcacattgttgcatcttttaacttttttctatttaattttgtatttagtaggggaaaaggaagaaagattgaaatttgaacattcacacccttcatgcatcatgaggtgatgcacatttgcttgggagtaaacctggttaccattttatggctgtttggggtggaaagaaacaacatataaaagcatttgcaattaaaatgacatgggaaacataacatgagactaagccaagttaaactcatttcaacaactggtgtccccagaaaatgtgaatgggaataactacagtctacagagatagcattacactacaagaaggaaaactagcaacacaacaaaatatctgagtcaatttggctgcccagaatagttggattggttaagagaacagatacaacacaaacaaaaaaaaattgcaatacaactagatgtactaagagttgaacatgatcccagtacactgtactacaagagtatgagacctcaggaaattatgttccatattcttccttgagcttcaagtctaaattgcaattagcaaatgtttcatgttcgaattccaagtcagaaagaacatgattggcgttgtgttcacctgtaaaaaaaaaccaataggtttgtttcagaagttacccaaaaaaaataaagatttttcatgcaccagcacacgtcgaacatcccaagcaactttctatacagaagtacatttaactagttacaaggtctgctagaagaaaggagagcggcatgcataaagtttctagcaatggcttgttctctttggagaagaaacaaggctctggattgatgaaagccgaatacagtggctcaattcatttgtagaaggttactagaaaatcattcaattttgtaaattgccagccacagatatacatgtgccagtgcatgtaagaggtgcagaagaagagaacctagtcttgagcttaagtatgacattggaggaagaaattctgtatcaagatccagttctgttttatcttcaggatccaccatgcatgcctgaaatacaaaaatagtgcaattatcaactgaaagtacacaaatgcatactatattactatacattatcatgtgctcatggcattaacagaacaagatcagcttgtacttatcaccattcctacacgctaataatccatcttataagattcacaaaatggtaggtgaggatagaaatatcaaggcagcctaaccctaatgtaattcgagagtgccgtgctaagatacccgctaactagagagaaatgcttaaaatcattgttggcaacaattcaaaacttctcaatgatattaattcattgccactaatacttagggtacttatgaaatccctcctctccattctggcacatcgccgtgattacgttttgccactcttgaaccacactatacctttgaatgcgcatcgatgcggtaaagactgtccatggagagttgcatcgtccccattgccttctccaccttcttctgtatgcctaattacatacccccaataatacacataaaaaaaggcagtagtaagtactacatcttatcatacgcgaatactggcacaaaggcatccataaaagtaaaataaaaaaacagaaacatacgctcttccagcttatcactgagcagtttctgcatatcgttcccagtaaaactggcagtttcaaccccatccttcgcccactcgcagcatttcatccaatcctcatcgctcaggtagctaggcttcaccagattcttaccagatcccccaacactggctgctgcagtagctttccctcccgtggagctcgccggccgagctctccgggccttgctgagatcacctagggctctgcgctcctgccgccccaccctcgccgccgccccggccttcttgccatcgatcccttcgcatcaaagagcaaagaaatcaaagagcaagaaaaaacgctcgccgcggattttcggagacggtggtgggataatcaccgcgaaagatcggcaggttctcgttttggatggcgattggagcccgcgaagccatcctgtgaaacctaccagcaaaacaaaccgagaagtttcagcatttcttggagcatttttggtgaaacagcctcggtgatggatagtgaccaccgtaaattcgacagaaaccgtcaggattcaagaaatcgcaccgattcggtgcgcgttgcgcgaaatgctagtgcaaagttgggaattttttcgaggcttaccaggaggacaggaggatgaaaccgccggagtggagggagtggggttttgctgcgggagatggaaccgggacatgttcactttgatgcgaaaaaaaaaaatcttactaaaatttagcattatcaaaattttaacaagatttcttatatagttaactaaatatagccacttttttagcaactttactaaaatttgataaggttgaaaatatcattaaagtgaatggccctggaagatatcagaggagtggtgaagcgtattgtgtgtagtagatcaacatgttacgtaagcctagtaggaaagcgtaaaactagattacgtgtttctctctctccaattttttattatcgcagggcctataggaaatgcggcccatgcagcccgtgccaactggagtgggctttgcgtgctttgttgggcccaagagggagtagcccatatgcccactcagcccaacactttagaagccaacgtatatggtgatgtttctttggcaggcagcccaggcttagggtaagcacacaacactgatataaaagcttaggacatcgagaacaaattgggaaatataccctttttatcaccggttttaaaatatacacgttttgaagggactggtagaagtatatcattgtcgcaaagcggagatgtgaactcgcgtatgtggatatacaaacaaggtcacgacttcgcatcccaatatgcgaactcacacgtccgccgcgagttcgcattcttgctttgtaacgatagtatatttttgctaattctttttaaacgtgtatattccttgctttgtaacgatattatatttttgccaattctttgtaaacatatttgtaaaaagaagggtatattttaaaaaaaatccaggacaaggcagctgtgtaccagcaggcagagttggatcatggctcgtgagacatagggttggtttggtttgtggtttaaataggtattactaaattttatcagtgccaaattttggcatgactaattttggtaaggcaaagttgtgtttggattgaagccaaaatagcctaagttcactattgaaaaggcctattttcttaggcatgccaaaatttggcttcaaaccaaatagacactaaacactattaaaattgccaaatattgataagcctaatttaggtctcaaaccaaaccagcccataatgtaaatccgtgtgttagggaatgaattgaacacgtagattagtaggagtacctaagggtgtgtttatttgggaaaaaagaaaatttttgggtgttacatcgaacgtttgaccggatgtcggaaggggttttcggacacgaatgaaaaaactaatttcagaactcgcctggaaaccgcgagacgaatcttttgagactaattaagccgtcattagcacatgtgggttactgtagcacttatggctaatcacggactaattaggcaagattcgtctcgtgatttcctctataactgtgcaattagtttttctttttatctatatttaatgcttcatgtatgtgtctaaagatttgatgtgttgtttttggaaaaaaaaattttggggaactaaacgggccctaaaagtggagtaaaaacaaacctgttaggtgtattggcactcccggttggtgctggttgccggcccctaaaagtggagtaaaaacaaacctgttaggtgtattggcactcccggttggtgctggttgccggcacatggagattgattagcagcgctggcaggttgtgcgcctgcctggtaggagcaggaggagcatccgctttgctgctgaataattcttcttcttcttcttccctacaggtacacaggctgtgctgtcctgatgctcattttctagataaaaatacagcacgtatgctgaagaaacaaccaacagcttgccacgtttccaggacaggtactcctccttccggcatgttttgtagtcctgtcacgtcgctgactttgtatggccacaggtagcaacatttttgttttgttttttttttccttttgagcccgtgtcttctctcttacgcagtgcaggtagacttttgggccaatagtttcttttatattttataataaacttatatacaattaaaacttgtgcacaaaacatatttcctccgtttcacaatgtaagtcattctagcatttctcacattcatattaatgttaatgaatctagacattaacatcaatatgaatatagatatgctagaattacttacattgtgaaaaggagggagtattgcttattatttcataaagcatatgctcacgaaaaacgagcaaattaacgcaactgtatgaacacatggtaaattggtgatctttttttttcttctgtgtttaggaggggtttctctagcacacaaaatgaagcatatattagcgtatgattaattaaatattagtaaaaaactttaaaaaaactaatataatttttaaaacaactttccaataaaaaaattctcaaacaagtaccatttggcagtttaggaaacgtgcgagctgatgagataaaatcccaatttaacttgtcttgttatgacttcgagtttgtaagtcaatttgacctaagtttgatactgatatgagcaaattaagccacgaggtttgagttttttttaatgcctagaacatcctagtttggagtaatcccttcatcaaaattcgttgtgttagcagtggttgggctttttttttttttaccgagggtgtgtactaccggctaaccaacccccaacaatgcagggaattgaaggccctgggagatgggagaaggacgcacaggaggacagacgtgacagcaagcgggccccaccacaccgctcggaaacgcaggacacgttcctttctttgaattggtgacagcctctcgggcgaagtaataactgacagtgaagagcctcggatctcacgcaacaacaactccggacgacgtgagaaccatccatctgcaatccctgcagtccagggacggacggacggagaggacgacgcgattgaccattctacccctcccttacccacgccatcccgctgtgttcgggaggcctaggcgcctagcacgcgaaacgaagtactccaacgtttagtatgattttttaagtaactttcatatagattttttttttaaaaaaaacacaccgtttagtagtttgaaaagcgtgcgcacaaaaaaaacgaggaaggtgagttgggaaagtagaaggagtattaagaacataggggctgtttggattagggactaaaattttagtccctatcagatcggatgtttggacactaattataggtattaaatgtagactaataataaaactcattccataacctggactaattcgcgagacaaatttattgagactaattaatctatgattagcctatatgatactacagtaaacatgtgctaattatggattaattaggcttaaaaaattgtctcgtaaattagctatcatttatgcaattagttttttattagtctacgtttaatacttataattagtgttcaaacatctaatgtgacagagactaaaatttagtccctgatccaaacaccaccttatctccaccctaaattataattatttttttagttggatacgggtattaaagaaaagtaaaattaaataagaaaatatcgtgatcaattgacaaataatgtagataaaaaagattatatttgaagttgttgtagatcctatttgacagtcaatgctacaacaaccatagctacagtatgttgctactataggtgctggctgtggtagcactcaacagagtagctgaatgtgtctatattttaagacggagagagtagtataagtacttgagggagtagtatggtagtagtaacatcgaagtccttttgtaaatacttttactctatacaaagaaattagagtaaatttcacaaaactacacgtgtaagtccaagttgtagaaaaccacacacactttaacacttggcacttaagtaaatatattttagtagtgtagtttcacaaaacacactatcaatgaatggattcaccgcgagatgatgtgactattaccagccatcgcacgaaattaataggatgccatgtctttatcctagatggagcgaccacatcatctcgcgggtgaatccattcatcgatagtgtgtttttgtgaaattaaactaccaagatatatgtacttaagtgttaagtgtcaaaatgtgtgtgattttctgtaacttaaaaaatatagtttcgtgaaatttacctttttttaatgtcctacagccaattttgtctaagaaaaaaaaaggaaaacttcacgagggcacgcgcgtaatttcagggtcgcctcgctgccggcagcggcaggccggccggccagccagccgcatcgtgtaccgtgcctacctgtcagaaaagttcagaggaggaggaaggaacaaacaaggcgcccgcctttttttccgaaaagccccctcgtaaatcccctttttccgcaacatgcccacgcatcgatggagaaagaaaaccgcgacgcatcgggtgcccatatgaaatgaatgaatattccgccgccgctccagcttccgctgcagccgcagcttgctgccaaatttaccgtgaggtgaccgttgccttccaccgcccccacctccgccgcggcctcaccctcacctgcggcgaggatcggtgctctactctagtagtagtactctagagtctagtctagtctactctagttgctgccttcgctagcattcggaggcgatctgaggaggaggagtggggagcagcgaaggttttgatcttttgggaaggagttggattcggctttctgggttctgtctgtcgcttgattccaattcggatttcttgctgttgttgttggggtgttcgcggccgatttgaccccggggaatcgctgcttttttatttttttgaaaagataattctacgcggattagatttggtcaagaagtcgtagtacgaacgcgaggtttgatcttggtttcgatccgaagggtctcggttggctgcgtgggaagggggaggaggaagaaggcgacctgctatctaatcctctaccccctctgctgcgaaaattctctgctgtttgctcaagcatcttgctgcttggagccttggatcgaagagagttttagttcttggagttctgagaattgtgttgcttgagccgaattcgatcccaaaaaggctcttttttgggaggctttgaggaggaggaggaagaagatgggggtgatgtcgcggcgggtgctgcctgcctgcagcagcctctgctacttctgcccctcgctgcgggcgcgctcgcgtcagcccgtcaagaggtacaagaagatcatcgcggagatctaccagcttccaccggtatggcgattactgaatcctgtcttggcatttcagccatttctgatgcttagttgtagtctctgcgatttgggtctgtggtcaaatagttctagtttctgcgaattggagtctgtggtcaaatgtgtggagggagtttgttgattgagggtgtgatgttgttgctgtaggatggtgaaccgaatgataggaggattgggaagctctgtgattatgtctcgagaaatccgacgcggatacccaaggtaacacattttgatctcctctctgtttttactagaattgtcgcgcaatctgttagcttgaatagtttagactgaatttccagtatttctgaaagcagtctttataggtaccgagtagttaccacataatggctgatttacactgcattgctttagtgtgatggtgattccttttgccagagtacaaccgatcaactttcgctagcaccgatcactagctggaatgattttaggctgtttaagtaggacttaccgagatgaatgaatttgtggaactcggaactgattttatgtctgcagatcacagagtaccttgaggagaggtgctataaagatctgagacatgagaatttcaccttggccaaagttgtaccatgtatatacaggaagcttctgtgttcatgcaaggatcatacgtaagtgtaaaggctctattctgccagtcaagcacccatagcaaatgtttgctgctgtactgaccatattattcttgattcagaccattgctggccacaagcacattgagcattattcgtactcttctcgatcagagaatgaatgatgatttgcgggtcctgggttgtctaatgcttgttgactttctcaacggccaggttattgacgactgtaacaaattgcacctacttggtttgctagaaatctgccatctgtttggtttaatttgagttcatgtaggttgatagcacgcatatgtttaatctggaaggcctcataccaaaactttgccaaattagtcaagaactaagggaagatgacaaagggttccgcctccgatgtgctgcacttcaggctcttgcttctatggtaagaaaagtttttacttgattctctgatgaaatggataaggtagtcttatatgttgcgagctagccatttagggctaatttacagtagatttgttggaccagaaataataatgtagaacaaaataaggaactacattcaactattatacaatttgttttgcaaatataacatttttttaatgttggttatattgatattgcttgagaattcccaacagataatcctatacttgcattactggttcttgccaactgatgccattaaatcagtctattgattaaatttaactttttaatcctaatatactcatttaccactttgtaatcaggtccaatacatgggtgaccactcacacatttccatggaacttgatgaagtaagtccttatcactctgtgttgggctagaatgttaagagttaagacttaattctcattcatggttgatagatgcctcctggtgaatatttgttctcttgttggaattgcataagattcatctttggagcatagacaagttgatgccattaatactacagatagacttgttgaataagtggaagatatttgattagtctatgaatagaaaaaaaaagtagcatgatagtttcatttgaagtgcgccagaaacagtaattcagtaagggttctgattagtctctgaattcattcttgaacccaggttgtgtccgtgatcgtaagttgttatgaggttaatcaaactctctcaataaaagaggttgtcaggcttcaagatgatgatgatttggtaatcaatggaagtctgactgggttgccagtatctgggcaaaatagtgccaaagtggcatctgatacaatgtgagaatttctgctaatgtaacggcccatttccacactcgatttgtgcccttgtcatcttaatgacttagtgtgttgacaggtctgcatctgaaaatccagcacattgggcaagggtttgcttacgtaatatggccagtatcgccaaggaggcaacaacagtgtggcgtgttcttgatcctcttttccgcctttttgatagccacaactattggtctcctgaaaatgggattgcattttctattctacaagaaatgcaggcactgatggacaaatcaggtgcaaaatttttcacccatgctatttgtttctctttttgtgccattttttttggttttgttagtgtttaacagcagaaagatttagtgctcttctaaatcttgtttcttaacagggcaaaatggccatttgctgttatctttcaccataaaacacatagatcataagagtgttgccaagaagcctgccaagcaaacaagcattttaaaagttgcttcgcttcttgcaaaacatgcaaagttgaaggcgtcggtgacaatagcaagtgcaacaagcgacttaataaagcacttgcgcaaatgcatgcattgtgctgttgaatcaccaaatgctcaaaatgatgttgacaagtggaacagtgcactttatgtggccttggaggagtgcctggtgcaattgacagaaaaggttcattatgctgtattattcctttgttacattactacattttgctttcatcagagagacattaaaggctgttaattcattgaataggttggtgatgttgggcctgttcttgacatggtgggagtaatgcttgagaatctctcttgtactgccaccattgccagaacaacaatttcatcagttttccgcacagtgcaaatagcagcttccatccacaagtcattgtacaaccagaaggcaagttttctagtgtgttcaccattgcaggagaattttgctattgaacaaaagtgttaattggcaattccttgttaatatttcaggcatttcctgaagctttgtttcatcagcttctcttagcaatgatgcacccagacaaaaagacaagggttggttcacatcgtgtcctatccaccattattgcaccttcacttctatgcccatggtcaggcataagttttcctatccctgtgaagggcaatgattcacagagcattactttgttggctctttctgccttttcttctgaggccgtaatggatgaagtccggatcaaaagcaggacccatgaacagttacaaaacaatgtaaaaccagaaactgtagttggctctgagaacggatacacacatacagaaccaaattcaaggaagagccctggtcttggaattccattgaaagatgaagtatgtactccaactagtattcttattgaacttggtattttctggtcttggtgttttcggatgtccagctgacacattttcttccactgaagcagaatcttaagttcatgaagctgaacagtagccaacttgttctcctcctttcatcaatttggagtcaagcacctctagaagataactcaccagcaaattttgaagcaatgtgccatacctacaatattgctttattgtgttcaatgacaaaggtaggtcacttaatctagttcattcttgttatacaataggcaaaaagaattgttcaagtaacttgacttaacattgttctgcatgccttgaaattatcaaagaatagccaaagggaaagataccgtcttttcccttttggcatggagttatttcatattatataatatttttttatactctatttttacacaagatagattctttagaatattttattgatgtaataggcatggattaacactttttttaagatttccctgctagtgtgagtttgactagtgatgtcaacttctcctttggacttgaaattgtgtgctatatttgtgagattgaccattgaattttcgttgcagagctctagtcacgcagcattagttcgatgtttccagttggccttctctctcaggaggatgtcccttaaccaagaaagtaagtttatcctcatttgcctgctctttaaagtttttgcttttgtatatcaaaatgatgatgcaaaaaaaaagtgacaactagctagggattttttccaaataggaatatcattttttctaataccagtatattttagccattgcgtccaacttcaagtttattatatttcctatcaatctagtcatttgatacctgcttgatttattcttacattttctactgtaaataaagatggtttgcagccatcacgtaggaggtgtttgtatacaatggcatcagcaatgctgattttttcagcaaaagttgctgatattcctcagacaattcctcttgtgaaagcagcagttccagagaaaatggttagttgattcctgattttgaatatgcttgctctatatatatctctaatgtgacatttttcaatttactctgaattcgcttattgatgtttttgtaggtcgaccctcatctttgcctgattgatgattgcagactcgttattagttcaccacagtcatctaacagtgggatagtttatggttctgaggaagatgaaagtgatgcacgcaattttctttcttgtgtaaataaaaatgatacacagttaaaagaaattgtgatatcccacttcaaggagaagtttgaaaatctatcagaggtatacattcagatttacattatgagagcgtgttttcttgatttctctgttcacaatcaagaagttatttgacgattaagtgtcttcactgcaaattgcagaagtttaatggtatagaagagcagcttcttcaggagttttccctggatgattcattccctctcagtgctccactattcatggaaacaccacactcttgttcgatgtacgctgaaaaggatgaccattgttttgatgaggtccgtactgattctctatagttaggtgattttttgttatttatgaattgctgttgtattaacttttttggttgcatctgcgtcccttgtgcttccaggaagtcattccttgtgagatggatgatgacgatgacatcgtttttgaacacagtggatcgcaatctgacaggaaaacctctggatctatggcttcatcagatgttctaaacgtcaatcaactaatagaatcggtatgcgccatttctgtctacaacaatggcacatgaagatcactcgctattttctagatctcttacagtcccctcatccgtttgtaatcaaacgacttttttttttcttcaggttcatgagacagcaaggcaggttgctaatgctccagtttctgccaaccttgtaccctacgatcaaatgaagagccaatgcgaagccctagtcatggagaagcaacagaagatgtctgttctcctgagcttcaaacactcgaggaccgattcccgtggctcgactgcagaaaatggactggaaacaaacgaggcatgttcatcttgacaggaaaaaaaaaatctatccatcactactgaaatctttgaaaatgtcctgaaaaactcatcaacatcttgttgcagtcatctgctcggtctgagcctgagacgcagtcgacgaggaaggagcgaatgcgacgcagcgactcggcatcaagcgaatctgaccggtcgttcaggctgccaccggcaagcccatatgacaagttcatgagagctgctgggcgataggctggtgcaatgcaatgcgatggcgccaaggatctgatactagttttcaagcctgtatacagaaatgtttttacagatacaagtcttctaaagctgtttcttttcattgtcgccttgtattttttattcttctgagtgtaaatttctcgagaaggtgtacaaatttctgttactgttgtagagacccagaataaataaaagtataggcattggtgcaatctgatggatgaagttgtattaaatatttaaatgtccagaaaatatattgttggagacatgtcacgagggcctttgaccgagcctacagaaacaggtctacaattgccagggcgaagcacggcggtaaagcgctgactgtcacaaagatagaggttatgggcgaagtcaccaggtggagccaaagacctttgtcccaagccgaaggactcaaagccttaaagggccaaccactcaatgaaggcccacttagcagctcaagaagagccctaaggctaatttgttcataattaccatcataaatatctcatatcatacgagtaaccatgtaaattttgatgtatttaataaccctagggcacatgaacctataaataggccccatagggcatgtactaggggatccaagaaatttccaatattaatatattgtttttacttttccataaagtgaaaataaactatgagctaggtttggcgaggagaggaataagcaaaagagaggataggaaaacaggaaacgggcctgggcctaaagcaaaatgtaattgggctcaaaaaagggaaaggagggctcacgtatgcggcccatatttttgggcctccgcctcctctcgtcgtctctccgtcccgagctaagtccgtaaaaggtcctcgtcgtctccgcggcgaggcgatcccctcccattccaagaaaccttcgcgccctccaagaattccaagaaccctcctcctcctcctcctcctcctcctccaatggagagcaggctactgcgctccgcggcgctcctcgcccgcgccgcgcgcctggcgcgggccgccgcgacctccaccggccgcgccgtcaccgccgagcacctggcggaggtggtggcgagcgccgccggcgaccgcggctttccagcggcgccctgcgccaggccgccctcgcgctggcccggtcttccgcccccgaggcgaggccccgcgccaccgccgaggtcgtccgcgcggccgccatggtgttccgggcggcgcaggaggcggggtcgcccggcgtcgcggaggtcgccggcgacctggcgcacgccgcgcatgactgcgtccgcgccctggtcgagtcgggccctgcggcggagagacctagatgcctgcttcgtctatggcgccgcaagaaccgccacaacaagaacgcggcgggagaggctgatttggaggcacctctactccatccccacgagaggccatcctcctcctcctcgccgatcggggcttctctatcggaggtaagaacaagtttgctcagagctttgtgggatgcagaatctgatgcatgttgcagtgaaaccaaagtcacaagctaaatctaacgcatttacatcataacactgtatagcttttaggcaaaatttgccataggataaggtagattcgtggcatttaccgtgggacaatgtaaaaacatgtctttgccatagaactctctggttttgtgataactaactcactgaaagatactatgatcaatgccttattatgtttggctcaaccaaataggtttttttttatagaaaagacagcttttagcccatgctaagttgcacattagtctgagaaaaataataaaaatatgaacagatgattgtatggtgaattggtgatcacagattataaccatgtatattaaatctcataaagaaccatatctcatacagattcaaactatattagcgttattgatgcacatgactttctgtttggaacagtgagcttaaattgggagtttctacttgcagattgcttccttttcattccttgatttgccaattgtataggtgattgcttcttttccctttcttgatttgccaaatgtagaggagcttgcttcttgttccttccttgatatgccaattgtatagtagtatttagttcttaattttatttgattttcgttttgcagattattgaattgtctgagagtgagagggatttatcaannnnnnnnnnnnnnnnnnnnnnnnnnnnnnnnnnnnnnnnnnnnnnnnnnnnnnnnnnnnnnnn

SEQ ID NO: 57828 - DNA, 2399 bp, Oryza sativa
  unsure (1)..(2399): unsure at all n locations
nnnnnnnnnnnnnnnnnnnnnnnnnnnnnnnnnnnnnnnnnnnnnnnnnnnnnnnnnnnattggtgatcacagattataaccatgtatattaaatctcataaagaaccatatctcatacagattcaaactatattagcgttattgatgcacatgactttctgtttggaacagtgagcttaaattgggagtttctacttgcagattgcttccttttcattccttgatttgccaattgtataggtgattgcttcttttccctttcttgatttgccaaatgtagaggagcttgcttcttgttccttccttgatatgccaattgtatagtagtatttagttcttaattttatttgattttcgttttgcagattattgaattgtctgagagtgagagagactttatcaactatggaatgtttggtgcccttgccatcttcccttatttgacgaggacaggcggactcaagagcgcatactcccccttgagcccaagcacattccatattattttctgtacatggtggatatgtgtgggcctcgatgtactttgtggcaatagagggagagccatgatgaagaacatccttgccttcatcttggctttctatgctcgagcatctgctagacttgcaatcttgggcgtctcactgctagtgatcctttacagtcacttagagctagctcccaatgaaatctacacactgtacatccttttgggggccgctacatgtatgcatttactcgtttgggctatggttagttcctcaggccttgtttcttatttccatattgcaggttttgttgttttgtagttacaaattcttttgttctcacaggattacatgagcagggcccccggagatgctgctgattgatcccaatccaattggtatgcgaaaagagaggagtatttggacagtttttgtcaggaccaaaaattaggagtggctgattgttgataatttgattcattctttcattgggatcttttgctttacctacttcttagggtctagtacggtggcacaattactgatacatggcaaatgtagggatcttgccctttaccatcttagtgttctagtacagtggcacaaatactgatacatggcaaatgtagagttgctcgatgttatctcactcttcaaccttctgcaaatgagttgcgaacatactgatgctcgatgtacattgatggcataacagtcccaattcagtgttgatcctacaattgtgattatcgagtgttacaagttagaagtagaacctttgcatggtgtaaaactgcatggcttctggtgaaattcagcagttcatatattattctctctattctgtgataacattttattaggttttctgttggatatgtgcattcaattgtttattacattagcctgttacagattacacacccagacaaagggcgccattgctgggtttgtttgtttgttttgggtggggtgttagtatgtaaatacagcaaaaatttatgtctgattcggtggtagtttagttatcttgtgacttctgagctgattttagcattgcacttggaggaccttgtgagcctagcagcctgtcagtgccatttctttcgatatattctttgcccccctcttatttatgcagtggacccttgtgcagtcaatgaattgttaggattacttctatgtcttttatagatactactccctccgtttcatattataagccgtttgatttttttttctaagtcaaactttgttaattttaactaagtttataaaaaaaaacttaacaacatataaaatatcaaaatagtttcattaaatctaacattgaatatatattaataatatgtttgttttgtattgaaaatatcattatattttttttatagacttgatcaaatttaaagaagtttgacttaaaaaaaagtcaaacaacttataatatgaaatagagggagtacctcacagtgatatgtttgagggattcaaacttttttctccggtgctaaccgtcccattaatcatctctaattcaaaacatttccatcttatatctaaacccagcgcacatctaaccataccttattagtgatgggtattatggtcttaatttctccaaaaacaagcaacttttgacagtattttggggcgttctcagtaactttaggaggaactaatcaatttacataatgccttaacctacagatcttgttagttgttcacttgttatccggtcattgcctaaaaaatgatacttctccaacccccccccccccccaaaaaaaaaaaaaaagagtaaggtttcctacaatgttatggttagccaaccatgttgtggttagcaaacaagggatcctctttatctcatcttccttcgcgctatctctctcttgcttcgacagtactga

SEQ ID NO: 57829 - DNA, 12844 bp, Oryza sativa
  unsure (1)..(12844): unsure at all n locations
nnnnnnnnnnnnnnnnnnnnnnnnnnnnnnnnnnnnnnnnnnnnnnnnnnnnnnntttagttcgagctatagcagataaaaattggttgcgcaccgaacatgcgcttgctactgtcgaaagtaaacatgctatcggtactatcgaagtgaccaaagctgtaaccggggcctaaattggtatcaaaccaaaccagccctaaacttttgtgtttttcgtgaagattttgttactcgagttcgaaccaaaagacgtaccccacccccgttcgatctatgccacgtgcacgtcgagcactatctgaccgtccacgggataatcaatgccacgggagtagaggtacgagcgcacgcgtgcccgagaggccattgggagctaccaaattataatccctacatatcgaaaacggaacgatataataataaatgattaattgattaattatcctctgcctttgagatcaacggcaaactttaccgttgctttcctgtaggccacccatcttgagatcaacagctgcaacagcttggcctcaccagttactaattagcacctacttaatcaataaaaccatgcgtttctctgcggaaaaagaatcaacaaacaaaataagcggtggcagggtgcgcataacaaaagagatcgaattgctttaagtgaacatgggttcttttaactgaataatatgaacaagagctttggtaaatcactttttatagtatgaaagaagctagtaaaaacataaaatatagatttaaaaaggataacaacgaaaggtacaatatggtgacatatcaaataaagagaatattcttgcatcataaggtggtaattaagattaattggctgctccatcaacgaaggatttttttttcttttcatgttatttctaaatgaatggagattggatgttcattcatattgttggcgtcaaaatgcgagagggaatgtattgtgtattcctcgtgctctgtcatcacagattttgtttcttgatttactagcaaacatgcccatgcgttgcaacgggtgaaaaatcgtaatgatatatttttcatgcataaccatgtcgatgacaatcagaaaatcagaaaattgaaacatgttaaatgtaatagcccaacctcgatgatggttatggcaaccttacgatgtttgctttacctaaaataattgaattattcatataacaacatgcatataatctaaaatattcttttaatctcattcttacaaccaatcaaatcctacactgcctcgtatggtcaagtctacacaaaatagagtcactatgcactcttctctaaataacaattagaatatgtttattttctaagattatttccatataacatgttatcaagaataataatagttatacttcaaaaaatagtatgataattatctacaaagatgtgcagggtctccactatagaagaatagatgacgagtcctggagatggaaaaaaagtggttgcaacctatccaaccagctgtccataaatttagcatttttttctaacggttcttttcctcgtatgcttttttttttttgcttttttctcatgtgtttttttggactattgaacttttttttctagcgtgttttcttttgcgcttttttctgacacttttttctcacgtgtttttttaaaccgtttttattttctcgtgcatttttttctttattaatatacggtagaaacatagttacattagattagattagagataaagaagagatataaaacgacgaattagactttttccgccgcgctttttttcgccttttttttctcgtgcatttttttacgaacggttttttcaccactttattatagtgtcggacctttctagatataatatgattcgatttgttttttaccgcgtcacatataattcctttttctttagaatcagacattttatttatttttttcgccctttttttactgcgtcgacgaagttggattcgtttcgatttttcttccttttttttgcctttttttggatcggacatatttgtttttttttcgcccctttttttatcggaattttttttattttttagcccggtttttttcactcggttttttccctggtcgatttttttttaccgcgtcacatgcaatcaggaatcggataattttttcgccctttttttactaactcgtttcgtttttttgtgccgtattttttggagcggacatttttttctccccttttttttcgctccgattttttttggtcggactttttttcaccgggttttttcgccctttttttactgactcatttcgtttttttccccatattttcttggagctgatatttttttctcctgttttttcgctccgatttttttgatcggactttttttcactcgttgtttttcgcctgtttttttcgtccggttcgtaatttttgggtcggacagttgttttttttccctccgtttttttgatcggacatttttttctccatttttttatcggactttttttcgcctgtttttttcccggttttttttacggacaatggaagcacgtctttatttttaagtagtagagattttgcttgagaaacatctaattttatcaattatttagctgttaattaatcactgtcatgggctcaagccatacaccgttgattctactatgtcacgcatggataaaagcaacggcaaagtttgccgttggtctcgaaggcagaggatgcggacccgtagaactaccgaactaatccctacgtatcgaaaacggaacgatataataataaataattaattgattaattaagtgtcagccaaaaataaaaaataaatgaaaaaaaatgaattacccccataaatcgtggtcgatcaaattaccccctaactcaaaaaccagatattttacacactcaactatgcaaaccgaacaaattaccccctaactcaatccagagtggtttcggtcctacgtgacagttcaatcagcatttttttccaaagtcggtgggccccacatgtcatactcttcctctctccctgctcggcttgattgtagagagagatggaggggagaggaggggaggggagggagaagagagagataggatggggattgaggaggtatgggataaaggggagagaggaagggtatgacatgtgagtcccaccgatttttcaaaaaaaaattgctgactagactgccatgtaggattaaaaccacaccggattgagttaggggataatttgttcgatttgcatagttgagggtgtaaaatgtctgcttttcaagttcatggggtaatttgatcgacggcgatagtttaggaggtcaattcatactttttccaaaacaaattaatacgatgcatgtgtgcgctgatcttctaatcgataaatataagggattttaaacaaatgaaacatatatatctcatccatacaaaatcctccctcgtttcatgctggtgtatgctgctcttctaatcgaatcgtgtcgcgtcgcaagcaaggtttcccaaaccgtcggggtcggggttaccgcgccctggcggtaagcacggttaccacgcggtaactgcggaaaccatgaaaaaccgtacgaaaccgtgcaaaatttatcaaaaatttaaattactttttaaatttatttgaatttaaggagattaccgcggtatttcttttaccgtaccccgtggtaaaggagataaccgcacggacggttaccgacgttaatgtaaccctggtcgcaagtgaaagggtgtgtcagtcgttaggctgttctctgtcttcccatctcgaaggcggacgcacgcaatcgacagagacgccgatgccttcttcagtgtctctactctgtagacgatacgtgagatttactggtgtgcaatgaatagcctatcggttcaggattgcggtggaggaaacgatgaaaaagaacaaggtgaatgcgcacgctcaatcagaagtaagcctgaaacttttttttttgtttttcgctgggcggccgaacttgtattaaggggggcaagtaaaaaaaatacaaaccttgcaagttatcagttttaaaacgctgaggatgaagcatcccggcttgtaacttgcatattggtcacacactcaccggtcaaattaacagccaacaatcaactatatccattaacttgatgttctaactacggagtatatcagagaaaacatgcttctattaggaaaaaataagcactgaaaaatacatattgcattattatcgactgcaatataataatgatgcactaacgaacttgatggatatggaagggaatgctttttttactaatgaccaaaatatccctccttgcaataaatggcaaacgattcaaaatggagctaacgggggcagtttagtaataactttcaccatcaccgcaatccagcaatacgctggaaacgtgaagattgcaaataatttccatttgccaccctacttatcccttatttaccaaacgacccctcgtcttccacctcgagccgcgtcatccaaaaccgcaaaatcgcgcctctccgccattcccaaacccctcgcctcggctcgcctctccccatccggagctccttctccgcacacggccacgccattgccatctagcccctcctccttagcctcttcttcttcttcccttgccccccataaccaaaagtccgattgaaatcaagaaatcctcgacgaccggaggcgatcaagaatccaccggaagaagatgcggggtttccccgttccggtgacgagttggagctccgccgcgctcctgggccgctccatctcctcggccagggacgcggccgaggcctcctcccccatcaccgccgcggagatggtccgggtggcgaaggaggtggccaacgccgccgacgcctgcggagtctccggcaagaagctgctggaggctgcggaagcgctgtccaggtccgacaccgacgcggagccgaggcggcgcgccgccgagcggattttcgatgcggcgtccatggtggccaaggaggccgacgcgtcaggagcgtcgggtctctcagatgcggcccaaaatctgacctgcgcgacctacgcgttctcggtagccgcctcgggatgggggtccttgccggagtccagcacgagcgggagggacgccggcgacctcctaaccgagccccttcttgggtcatgtcaggacaagaacgagaagatgaccggcgagggcaaggacttcagcgagatgaggaatagtgcagcggactctgatccacttcagcaatcggaggtattcaacaatgttttcttgagttcttgattgtgcattcaacttctttctcttgagttcttagttgtgcattcgtcgggtcggtatcttgagttcttgattatgcattcaagactgttcaaggagtctctgcattctgacactttttgcattctgaaacgattgtctctttcttctaaaaaaattgcattatgaaacacctgttctgaaatgattgtgcctatttggtcctttgcagattaaggagtcgtccctttttggaaaatgcaaagaactcctcaattatggttttcttggaggtcctgccctcctaccctatctaggctctggactgaggaaaacagtgtcaccctgcagcccgtctgtcttccactacatcttctcgtcgtggtggatttgcattgttgtcggtgtgatttgcagcagctcagggagagcaatgtgtagagagagatatatggggcttgatcttatccgtatatttagaagttgcttctcgacttgccatgcttggcatcactttgatggttatactctataactatctggagctagctccaactgaggccatcggattgtatatcctttgggggatagctacctttctgcatttagctctttgggttattgttagtctcattaattgtttcttatttgcaagttgcagtttatgttacaaagtattaacaaagaaaagtttttatcccttttgcaggatcacatgaacaaggagacttgaagatattacatatcgatagaatcacttctcatccaaatgataagtagcaatgaattgttaggacaattgatcttgctccctcctactactactacagtcaatggattgtcttgtgcagttaatgaattgttaggataattgaccttactcttacttcctcttattgctgcagtcgatgaattgtttgttaggataattgactgcagtcaatgaattgttggtactattgctgtcccttttttaaagaacagcaagttaatggatatagttgttgattgtcggatggagttacagattgccatacatgatacatgtcaaactgatgttcatttacagctgcttcagaatttatagaatattgctaaagtgtctcatttggcaatggtttggaaagtagggaactctaggtcagagcatgcaagtagaaggtcaaggttcagcaagttttgagtcagtttttataatgccttaaactacttatctggctagctgttccagtcattgtccaaaaatggatgttgtcccagaaagtctgaaaacacttctccctagtatttccaaccttattcttctgaacacgccttgaaagccaatgggagcagcttactaacacttaaaggtttcttagcattcattgtaagcctgtaatatcgtggtaggtatacaaggaatcgtcttccgtagttttttttccccacagtaacgatgcattgctttttagctgataccaaattagaaaaccctgaacaaagcgtggtgtgcagaaatcccagctcatgttctggtcattgagcctactaggaacgccaaccagtaataaccatatagtagtaaaagatttcaaagttgcagtgcaatgggaaaacattttgcaccatcaatccctgaaacatatcgccgattggaatgcagcggaacaatccctgaagcatcttttttttttaagataatggattatattaacccggcttctacaccttagaaagatgtacacagcccaaaccacaatcaagagtatataaacaatccctgaagcattctattggagttacttgttcagaaattgaaccttcaaattttctacagaagttttaatttccaaaggtaacataaatatgtttgctctcacaatgagaaacaagggaacaagtagtctttttacaaatgctgaacgcaaaaaatgaaaacaaatgctggatggtgttcatatgaaaaccggcttttattgcgttagcatcaaaacaaatgctgcgggaagaagagggaggacgattagaaacggcagtggtgggcaggatgcagggtttgtacgatacccgatgataccaaaagacaacagcactaagctccccatgaccccaaaaccctgcaaaagaaaatttgttgtatcatactcctttcgtttcatattatataagtcatttttatctttttttatcaaacttatcaagtttatagataaatataacaaaataaacatattattaaaatatattccctctgtttcatattacaagttgttttgtttttttcatagtcaaacatttttaagtttgatcaaacttataaaaaatatattaacattttcaacacaaatcaaacataatatcaacatatattcaatgttacatttattaaaactaatttagtatggtagatattcaatggtagtatctttttcataaaacttggtattgaatattaatttcaacaaaattaatttggtgttggagatgctactatttttttttacaaatttaatcaagctttaaaaagttgattaggaaaaaagttgcgacttataatacaataaaacggagggagtattaattacgagttgtaattaactaagcatatctgcaaatgtacgagcatattgctaattacgagcacttgcagtgagagaagagaactaacgagacttgggatacatataattggcgaacatatcctatgcatgcaagcttcccatatacaccaactagcaaatgtcatgaaaaattctagaaaaaattgggcatttacttctagtactactacacatatatgcaaagtctcatattcaaacttattatattttgagagaatcccttatatgccactagaatttgaccagttcccttatatgccactcaaaattggcttctcccttatatgccaatagtttaagttttttcacccttttatgccactcccaccactatagtgttagttgactgttagtcaaaggttagtttttttcgtaaatgaccaatatgccctctcaactaaaaaaatgtgtaaacttcaaaaaatcataactaatttattttaaatcctttttgagtgaacaaaattttgtcagaactagtgaaaaatgctctttatattaaaaatattgttggaaaactgcatgtttcatgcttacatttaaaatttatttgtgatggtaatggctaaaattgcatgtgatgtagaaaaaatcaattttcatatgttgtatccaatagttatattagtactaaaatacctattattggttgtatactaattctcaagggcaaatgcgtctttttcaatgaagttaacgatcaactgacgatggactgacggcaatggcataaaagggaggagaaacttgaaccggtggcataaaagtgagaagccaatttaaagtggcatataagggagtcggttaatttagagtggcatataagggattctcccttatattttagtcgtaacaaaaaagtgaaaaaaaatgacagttttgagggtaaaaatctatcataattttattctttttattatggctaaaatataatgaatttgaagataatatttcacgcgtagttcggtaggtgtaatactattataagtatttgtacatttttttttctaaaaatttcagtgatatttgctagttagtatgcacgggaaccttttgtgacatttgctagccggatttgtttatctgtaattatggactcgggagattttttcgatcttcatgtggagcaagaaaagaacagccttaatgaaataattactagctgtatacatcggttaagttggtttacccggacggagcggtagccagcttcccgtgagtagcaacgcctcggagtcggagtcagagtcggaggcgaccgcctttggtcgccggcggcggcggcggcggcgccttcttccatccggcgcaggaagctctcgcgcagcagcatgtcctgctcgccgccgccgtcgtcgtcccggcggtgtcgccggaaaaagaagtagtgcatcattgcaacggccatggatggatggatggatggctagctaggcgcacgccggcggcgagcggatggccggccggggtcgacgacgacgaacgcggcgggccgagcagcaacaggagaaggagagatgagatcgatcgcctaacgcggggcagagcaaaaaccagcagcggtatgtgtatatgtgatgtgatgatcgcgtacgtggtcgcgctcgtgtcggattggaatattggacccgataacgagctcggtttcgggaggacacgaatcgaaggagtccaggttgttttatgccactgccacgtactccgtatgtggtgaccacgatttgaccgctggctaactgattcatgtaccatgttgaatcacacgggaaatgctccgaacacatgttttgatgtatcacatgaaaaaccaagaaatttagagctcatttggaacacaggattttgaaaacgcagtaacattaaggactccagcgaaacatcatatttacaaacgaaaaatgatttgtaaataaaacctttatatacgtgttcttaacgatctaaaagcaaagactgaaaaataaaccgcgatgaaaaaccctaaaatcaactcaaaaattcaaattttagcttataagtataatcataagccaaaaaatggggctacaaatatgcaagattatgatataatgttctacacaatcctgcaaggttccaagccaccgaaatactaattttggtgcattttggatggtaggaaacaaacatgggaatttaaaagaaaattgttcgtatgagctcatgttcattttcctatacaacgggggaggatgccaatctatataagtgttggcatctctattcatttgatccgaagagcccccatagggaagttcatctaaggattccaatcctttattttaaaaattcttcaatccaaaggagcccttaaaatttacgtgttgatttgttagaacaaggataaggatagaaagggagagaatggagtttcaaagaaaattgaaaacacaagattagacctcatgctagcattcctacgaaatagaggcaacttttttatcctatgtatttcctttgaagcaatcatataaagcaaatggcacgcataaagacaattcctttggattaaattcgtccatttttcctccaaaatttcttcgactcaaatttcgttaatacaccatcaaatcaaaccagtcccaaattgaatgtcttctgtttgtgactcgaataatgtatgctcttcaactttttggttgcaatcaaaatttaattttaaaacttaattttaatgttttgtctgtccatattcttatcgctggatcatatcaagtagttccgcttgatgcgcttcaagagtcatgctatgtacatgtggtggaataaaaaccttcgcacgagcaaggcgggggttgaaccaaggacctctcccccgacgagcatggcgcatgccgttgagccaaagacatctttttgtttagtcatgcccgatgtatagtagttacgttgtaactataatacaatgtagttaggttcgaaagttttttactcaaaaaacatggttcgaaagttttttactcaaaaaacatgctaaagacttttagacagacccataaatacaaatatttatactctaacagttgagtcaagttggtcaagctgagtcaagtcagagaaaatagaaaaaaagagaaagccaaccaaagcacaaccagagttctccgcggggtggagcgctaagaaagagaaaagcgttatcgctatacgaaatgaagcagcggctagcacgctaagataaaccacttgaatatatagttttacgatagacagatcaaatacgcgtagttatgtgaaatttattctaaaaattattatcaataaattattcttttagtctctaataatcgttaacttgtattactccgttaaaaaagatacaaccttagccacgaagctaatcatatttatgtccagattcgtagttatgattgagttttttttttttaacggaggggtacgtaattaacttgcatggccgagcccggaatgttccgcccctctctcaaaattcaaaatactacacgtactccacgtatatactacggggaaagaagagtcacgcacacgtgacaggtctcagctagtcaagcgagcacgaagccaaccgcagcagttgggagacggcgccaacatctcgcgagacgatccaacggtaaccacacaccacaccgcctcaaacccattacccatcccccatccaacggcgctcctccccccacccccaacacgatatcctgatattctcccggttttctcgcgagcggaagcccctcttcaaaaatccgctaattttacattaaaccccctccacccatcctaaaaaagtgaaaaacacatccacaccctcgccctcgtaccaacggtacgcacgcggagagccccgcgcgtaatttgtcaattctccaggggctaaattgcgaagcgtgcagcacttttgcttcgctagctgcctctcctcaagtcgctgcgagtgcgagtccacacaacactgtgaactcccccctctcgagaaaaaaaaaaagatccaaaattttttcgcccttgggttcgaaatcttcgtgccttcctcctcctcgcggcctccaattcgaacgccccagttgctcgcgccgccgcggattccccagatcccacctcctccccagctcgcgcggcccaattcgaaggcggttctagggtttcccggcacgaatttagggtttcgggggagcttcggggggtgttgttccttgttccgcctagggtttggaatttggggggcgtggagagatgggataaggagggtgttgggagggtgggagctttgcttggggtgtgtgtgtgtttgggtggtgctgagctgagctagggtttggtggtgaggtgctgaggaagggaggtggggggtggaaaatgttctactcgcagttcatcttggccaagaaggggcccctcgggaccatatggatcgcggcgcatttggagcggaagctgcggaagaatcaggtcgcggatacggatatcggcgtctccgtaggtgggtgattttgctgtttcacaagcttttttcttttcggatctactaccatttttttttgtttctgttcgagcatgttagggcctcacacgtagactgctaaagcattgtctttgctaatgctcgtttgtgctgtaggagggggaaaacattttttttctcgcttatttatggttatatgtattcttactgctcatatgttgcgattaattagtaaaagatgttagcttttttgggatagtgttagttcctagttgacctagttgttgctggcagagcaaccatatttttacaactatgctaatgagctgtctcttcatttttgcttatacgtgctcgtctgctggattatcactgttgtactacagtaataggaaaagaaaccacctgtatcaatgcagtcgctgattagcttcttacaactgatagattggtaaaaagtttcaaccttgagttgcactggtcatttggttgttagtattaatgctt

SEQ ID NO: 57830 - DNA, 4958 bp, Oryza sativa
  unsure (1)..(4958): unsure at all n locations
ctaatgctcgtttgtgctgtaggagggggaaaacattttttttctcgcttatttatggttatatgtattcttactgctcatatgttgcgattaattagtaaaagatgttagcttttttgggatagtgttagttcctagttgacctagttgttgctggcagagcaaccatatttttacaactatgctaatgagctgtctcttcatttttgcttatacgtgctcgtctgctggattatcactgttgtactacagtaataggaaaagaaaccacctgtatcaatgcagtcgctgattagcttcttacaactgatagattggtaaaaagtttcaaccttgagttgcactggtcatttggttgttagtattaatgcttcatgtggattttgttatgccatcactagagttgtaaaagctatatgcttttagatgtctgacaaattgcggatatagtgtttttgttctttctcggggacaaagaaaacactaactccctcactagttacaagccacttgttcactaatatgacacaatattttattttattatgtgcttttacagtatccatcgtcgtcgctagttgttttatagatttaatcgtaatagttaagtacagcttattagattgagaatgctggtagcttgccttcaagcagaactactactggactggttttatcacggatatagtggtagagatgagatctctttttttcctctgatgttgctctgttgctaatgctattatatgcaagtcaatccagttcaaaatctgggtttacgatgaccagaattcaatacttctgtgaaggtctcagacaacataagtgcacagggtctgtagagaaggaagcaaaattgtagcataggatttgattgcatgatagctgataatgcatttgtacacagtgaagcttgtgttaaggattggtatctgtgatgcatgtggtatgtaaggacttggttacggaattctagttgaagtgtagcaaacatgagaaagaacatcttttttttagtgccatgatcatgcaatattgtgaagttggttaaggctccgtgatattagctgtcaagtcgtgtctctacacagtgaagcttgtgttaggaataggaatgtgataatttgtaaatgaagcccagcgaacagaaagttatggaatttagaaaagtgtaaagctagttaaatgttgttttgaccaaaaaaaaaaactacacaagcatcattcggacaaatttcaagtaatattggagtgtatatggggaatgccatgagctatccatagattccattcacaactggattggggtgtatatgggaattttattgaaatatgcaaagaggtgcgcccaactaaacaatactccaattcactttcaccatgtacatcactttcctgccaaatttagaaagatatgaggattccaaatacagattaaaataatgttccaaaggtaccaactgatccgtctcattattttttaaagcataccatatacggtcaatatagaggatgcgaacccgacaataaagatatagagagagaggactcaagaaaacctccagtagctgtgtcctgtatgcatgtgcagcaaaatgagtaaaccagaagcttctttggttattttcccatttatttaaaggtaaaagcaggctagagtggcaatggtttgatggagatcaaggctgataacaacattatttccatctccttataccaaatttaatacgtgtctgtttcattgcatgcatattgaagggtgactagtatacgacttgaaccatgtaatttgtaaaataaaataaatacgtgcatgttaacccacttcttacttagaagatcactcaaacctacataagtgtatgtagcatgtaagagccatcgagcaatgtaaggttccatgccatatatgcatgagttatatattgaagaaggaaaagaaatcatgttttgttcgcatatgagaaaaatgcaagctgtcgttgtcttctcatttcgttcttaccattttgggatatatttgttttctttcgtgcaattactgtgtagttacttttatgttcctagcctttttttttccgtattgcttgcatgggttttagtaatgcctgtgtcaatgcatgctatgccaattggttgccagctatctttggtagcctttaattttctccaatggaaaaatgtgatcaatttacttttttatgaatgtaaatattccactacatcggaaatctagtggtgcggtgtacgcgtgaatgcctttggccttgtccaggcactacatatccttccagctgtcctacatcatcctgtagctgcagctgcagtcccacattgctcagtagatccacccctggccaccacatgtccttacatctaatatgttaatttcttctaaaaggatagcattgatgatagaaagcgctgtcacgccatcattgggcaagcaaaccagcttatagcagttaattggtgaaaaacattcaactccattcctttctccaaagataaaaatagaagtacttagatgccacatgtgtctgttatgattctaaatagtactccactatttagtagtataaatacaggaaaaggtttccattataagtttattataacatcaacacatggacttaaaatcttagagcagctgaagcatggcattaactctgcccatgatacagggcaaaccaccatgtgcatcactaaaacactcactagtgcaattcacagaattttgtgatggaaatgttatgttttcctaacagtggtcatatatctgccatatgtctttttttttttcattttgagcttagtattaataatcatttttttcctgcagattcaattatattccctgaagttccgattgcacttcgattatcaagccatcttatgcttggtgtggtcaggatctattctcgcaaggtgaactacctattccatgattgcagtgaagcgttgctgaagataaaacaagcctttaggtctactgccgttgatcttccccctgaagaatcaactgctccttatcattctataacacttccagagacattccatctggatgattttgaattaccggaggctgcatttcaggggtaagttcattggttttgttgtgataagtttgttatttaaaatgtgcccttcaactctcttaagattttccaccatgatccagtgacattgatcatcatgtaagcacaaaagaacagatcaccttgcaagacaacccagagaaaactggatactcaacatcccaatttggcttagatggttggtccttctgtattcacgccatctacttttcgtcatctacttttcaaaatttgaagccagccatttaatcatattaagcatatctctatttacagaaagatttggtgatggcaattcttcacatattgggttggatttggaagaggtaatctcagctaatatatcttttctccaaaaattcattgaaatgtttgtggtcttcatcctgcattatcttgtatgtgctgtttggatctttttttatcatctcagtcttctccgcattatcatagatgtacttccagagtaaatatttactgtcatgctccataacatggcagttcttcacatattggtttgtttttaggtcataatgatagggaatgcagattatgcagatgaaaactcattttgagttgtacaagaatgtttagagcatgaacattgaacataacaatgattttaccatgtaccaattccttgcggccattgtctatgccttgtcttctggttgtatatttggcagctttggttcattacctgttagtaatcaatatttcttttgagtatagggtaacacatggctaatagatgactgattaatggaagctctctatttctggttgttgtgttattgtgtcctatcacttgataaactgcaattccaaaacaaaactttgtatatcttcagcagctaaattttatttgtttccccctcaggaattaatgctgaacaaggaccagtcaattcaacttgaggctgatgatgggtaaaatcacctcttccacttttttttataaaaaatagctattcaagtcccttggaaattttatctacacgtctctgctcccatataaagggtctttgatcctatctaaaggagcctttgtgggttttcacagatgaggttaagtttctctaggcaattttatgttttcctataacttctgaccttatattgtacacttggactgagtctgaatcaacccagggtctagttactactttctcctgatttgagtccagatggccatactggggtgtgacactgatatatttgctacacgtgttgtgatttttttccatgacatttgaaagtggcagcatcttgcatttgcctttttctgtatttttactttatttacattggtttgtgcctctcttcagcattattattcaaggtcgatcagcagttcatcctaccgatatggaagttgatgataaccaaaataaagatgaaagcgctgaaggatacaacatggaggatggaccttccagtcacaacaaactaaatccgttaagtgcagatggtctagtaggaaacagtcttcctaattggcatacatacaatgtgcaaacacctgatctgaatgatatgctattgaacaatgatgggaatgcaggaccatcagcttcatactatcaacctagtcccttcccttgtgatgagcctgcatcaccagagtttgtaagtgcccaggccccggctacacctggcctaatggaagagactgttccttccagagtgcatgaaagtcctgttctgagtccacagcgaaaagcttcaccatcaagcaatgatgaaactgcaaagacagctgaaaatgctaatgatcttgtgggtgctgagannnnnnnnnnnnnnnnnnnnnnnnnnnnnnnnnnnnnnnnnnnnnnnnnnnnnnnnnnnnnnnnn

SEQ ID NO: 57831 - DNA, 1302 bp, Oryza sativa
gggcggtcagcatgcacctcatgctatcttagcaactgcagattcccaagtgaatgtagaagcatcaacacaagaaatggcatctaacgatataccaagtgacctaccaaccttggaatttccagaacgtgagaaaatgctgtcagctccagacgttgaattgtaccaggcaaatgacttgggccaggtaactgcagaaaagggaaccactgaatctgatggaagtaacaaagtaggtagtctcactagcagaaaaagacacttggaggacagtttgccagctctcgaaagtgcaactactgaaaaattgtctagcagaccacgtggtaaaagaaccattgatggtattcctgatgatgatgatttactggcgtctatattaggtatggatgaacctcctcaacaataattgtgcctggcttttgctgcattgtctaacactaactgtgtggacttgtatttagttggtagaaggacccctggactgaggcttgattcaacaccaataccacctaagacgtcatctttgaaacgtccaaggttgacgtcaaagagtaccacaccgaagagaaaagtgcaaatggatgatgccatggttatacatgctgagtatgtatacgcctcatagccttcaaacaagtttgttgaatggaactgtgtgactgttgttctttagtgttatgtccttaaatttctgccatcactgtcttctgatgggaaacaaatagtatattttttccgtatattcttgtaaattttgtgcagtatatacattgagttgattggtccatctctggaaatcagattgcggactattttgctgtccaaattattttctgctgtgatattatttactgagtttcttccattctccagtaccatacggcagcagttgatcagcactgaggatataaggcgcattcgtaaaaaggctccatgtacccgttccgaaatatggatgatcgagaaaggttccttagaagatgatatattccatgagcccatcttttcctgtaagctacttaaattggtttttattctctgcttcctctttacacatttactgtatgttcaattcaattaggaaagaactgaaacagaagtgaaattagttttgatatatgaggataattagtggttagttttatgctctgaaattctactgatgcatgtttgtgttcccaactaggcatgtgcaaggagctaaacgatttgcaatatggacctatgagattgttgctcatcccaccattcataatatggaaatacatgtacggctagacatgtcccaaactatggcag

SEQ ID NO: 57832 - DNA, 10107 bp, Oryza sativa
  unsure (1)..(10107): unsure at all n locations
nnnnnnnnnnnnnnnnnnnnnnnnnnnnnnnnnnnnnnnnnnnnnnnnnnnnnnnnnnnnnnnnnaaattattttctgctgtgatattatttactgagtttcttccattctccagtaccatacggcagcagttgatcagcactgaggatataaggcgcattcgtaaaaaggctccatgtacccgttccgaaatatggatgatcgagaaaggttccttagaagatgatatattccatgagcccatcttttcctgtaagctacttaaattggtttttattctctgcttcctctttacacatttactgtatgttcaattcaattaggaaagaactgaaacagaagtgaaattagttttgatatatgaggataattagtggttagttttatgctctgaaattctactgatgcatgtttgtgttcccaactaggcatgtgcaaggagctaaacgatttgcaatatcggacctatgagattgttgctcatcccaccattcataatatggaaatacatgtacggctagacatgtcccaaactatggcagatggcagcaatgatgttggcacctctggcgcaaaggacagtggaaatcaccaagatcatgtagtgctaccagatggagctgagtcagatgcgatgcatcctgaagcaactgatgcagcagatactagaactgattttgattcacacatgccatctgacaaacaggttaacaatgttgaaggagtaactgaacaattaactgataatgagaaagaaactgcagttgttgagaaagcaaccactaatatgggtgacagtgctcaagttgattcacttgataaggaatatcttcaagatgttccagctgatctgcagaggagcacaaatacaaatacacctctgtttgtgctagatgacatgcctggtccagatgtggttctggatagctctgatccagtttctgcacaagcagtggatgatatgaaaggggagttgagtgacattgtccatgacaatgtcaatgcatttgacaataaggatatgccgacttctgagattaccgtactggaatttactcaaaacgcttctggttttcctcagccaacagaggatgaaaatgttctgtccgcaatgggtgaaaattctggattgcaagaaaatcatgtaggatctgttatggatctggacaatatggggcatgacttttcactaaaggaatgcagtgtaagtccatatagaagtttccacttgtcttcagacacttgtcagatgacttgtgtttctcttaattccacaatgtagcatgctatacagtacttgcactattttattcagtcgttatttgaagtccatggcataattggtatgctgttcacattgcaggattttggcagtgcgattcagggtgttgacacaggtattgccttttgttctgatacataagtgtaaactagtgtagtagtgttctaatataatgtggattatgtgtacaatgctttgtaggtgcagcagaaaactagctaaatacccatgcacagattttctaataaatatatcatcagttcgaaactcaaaaagtgagcatatttatcctgagaatcatatgtaatttgcaagacgcatattacaatgtcaaaataaaaacaatcttattacaagacgcatgctcagatattctaattattcacagaagggtcaggctgactcaagaagtggcggtgggatttcagactcaccataaccaccattcctaggttcttttgtattagtagaaataaacatgacattaaccttcatgactagtgcaatatccgttcttaattgtattttatatgcaaattttgtgatgggaacttccacacgcccgtatgtgacactggtggatcttactgttctagtgttgcatcgcgagaggtttataagttttatgacttgtgtcatatttgtactctacactttcagattttctgatgtatgatgatgaggtggactgtgatgaggctaatgatgatgagcctaatcctgaggaattccagtctcttgataacagtggatggtcttcacgtactaggtacgattggatttcgtgataatattctcagggtttaatgctcaatatttttttgagttctataatgagttgttacaattgctcttcaggggtgttgcaagatatctcaaaactttatttgatgaggaatctggtctgggaagaaagagtgtggccattgatcatctgttaagtggaaagactaggaaagaagcatcaaggatgttttttgagacattggtaagacggttatgcttttctgtttctccactcaagaaatggaatacctaccttcagctccagtgtgattggaggcacctagaattgcatgatcaagaatacgccattcattttatattgcatgtttcgattagccatcttctcattagacaatcttactggcatcaaccaatttctgtagtcattgtcaaactagacctgcaatggtagcttaaattgttttctcgaatcatttctgttgacattatccttggtacttattgtgttctgttccattcacaggttctgacaacaaaggacttcataagtgtggatcaaccaaactcctttgattttgtcagcgttaagccagggccaaagctcctgaagtcagatttctagatcaaaaaccagctagcgtggcgcgatacatacaatcttaccatatctgtcacattaccaacaacatacagatctcgcatcgccgtgaccgtcatttttgttttgttctttttaatttatcctccctctgtagtatccccgcactaatctgtgtttactaggcttcttgggtaggattctgttgtacccccctccgtgttggctattcagtgtatatatgattagctcttgtaaagttgcttgtgtaatgtgatagcatcagctcctaagtccccgtctattgttgctttgaataaaccttcaaacctgtatacttctctgactttgagcaacctgtcgattaatttcaaatttattcagattcgtaggtcaatcgtgagaaaagagataacctttttttgtttgttttgcctgaagtggaggggaaaggttgctcaaaattctgtattggtattatatcattacaaccactctgctggtgatccgagtcaccagcatgaacgtctgagtgaccattgagcaatgtggggcgtgtgattaaagcagctttgatccctttctagcacatacgtaaagtgacacgctgctgtgtgctctcgctattcgcagaaaatgtaaaagcatcagcaaatgcaagacagaattggcagagaataaggtgtttggaaaatggaaattcttggaaggatgacaagtattaatcgacggccaaaaggacaggggaaagccgaccagaaatgaagaacggagcagcgaatgtcggtgccgaaattgtttttatctgcacggttagcacagggttttcgtgtcgcgcgtctcactagctcactgctcatgaaagactgaagtgaagcctagcaagcattgccacctgacgagtgacgaccatactttgatcgatggatggatgtatgggcgccgcaaggcagtttgtcccattgtccggcattgctgccgattcctttgcctcgtgcgcgcggcatcctccaccaacaacgtccgcacgaattccacgcccaaacaccggcaattcccgtgcaaaatcacgcgacacatctccgcgaactcaacgccacgcacgcgcgcggacgcaaagccgcgcgcgcgagccacgccgttgccttgccaccacggcgattttcatggcgtcgtgcgcgcgagatgccgagatccgcctcgcgtgcccagcgccatcctgtcggctacagtacgccgatcagtggagttcccatgggttgatcagacggacggcgagcccgtgcgtgaacagtagggtgacaagccacacccagccagtcagccacacgaagtggcatatatctcgagctatagcctgacctgacctgctgtttagcttgttactacctgtagcgcctcggctctcaccaagcaagtgtcggtgcattgtttttttttcccttcttcctctctcaaaatataagagtttttatccagatgtgacatatcatagcacaacgaatctagacagagattatatcccgatttattgtattaggatatgtcacatctaataaaaaaatcttatatttatagacggaaggagtacctgttattcattaccattagtagtacaactcgattggttattatttcttccatgagaaatgtcctatatatatagctagtttggaaaatgtttgcttaaattggaaatatgagattagcttaattatgtgatcaaaatcgatgccctttgatctagaggtgtatatatatgtacatatgtgtaagcatgattaggcgaagaaagttcaagtgtgaggtgtaacctgttatcttattcggcggatgcatgaggcgcacatggcatgtgacgccgtacgccgatgttggttgatgcacactagcatggatgatgtgtgcattgtcctcattcctcctccattatatggctagctcttcacaatgattaacaaataattaagctataagcacgtccctcgtctctcaattccttccgatctgagcattttgtcaccacttccctgttccgtctaatttaatgacctaatccaagaccgtatctgggttagaaaccaacaatctcaacgtttcctctcaccttaaaagggtactagtacaacgatgtaaaattgtggtactactacctcttttcctgtcgtcaaaagggagatttttacattaattcccttctcctgtcgatcatccaactcatcaactacttttgacctaatattttccctttttttctctctttttttttccaatgtgcttgcattacatgattacatccatgaaggttgggctgtctgtacggcactcattcattcgttcctctcacaaacactgaagcctgaaaacgattgagaagcaacacaagctactcctagctaggaaggcatgcagacctaacataatccagcatcacttagtgggtctaataaaaaagaaacaaatccaacaagcaaacaaccatgcataacaaaatgctcattgccaccacaactgctctaatctcactgtctctctctttctctcctttctgcactctgtttgcttacaacacaagaagaggaggagggtttcggttcagcagtcggcatcaggctccatgcagagacatggatggatccatccactgtgaaaagggtagtatcgctttgtgattaaagagagcaggaacaaaagggcctgcgaaagctggcccagaaagtgccgatcgaatagattctgtcattaccagcagcggagtatcttcctgcagacatctcacatttgcatgccttctctggaaaagggcacgcgagtttgcatcgtcactgaacagctcgaggtttaccaaaccgttttgagtagggttatcgtcacctacggttttacggttatcgtggtaaccacgtggttatcgcggtaaccacgcggttatcacgatactttggttttaaaaattgaaaaggtggttttgtaaactctgcacagctcataacattgctggcttctccagcctctagtgtcgttgtcaacaagaacaacgaggttgattctgatttctgaaatgtgaagttgggtagtaacagcgaatcagcgatctgacatgcttgctcacttccatggtgattttctgagccaaaaaagagtgaactggaagacagagcgcccaatgcaaatagttgcagttttccgcgtagttaagagggtgtttgggaactagggactaaactttatccccactttagtccctccaaccagacaccacctaaattctgttgtgggggaacctagaggagcaagcaggagtgactcgtgagcaccgaaggttccaatgtaccagagttgcatgcatcggccggcgtccagaagcaaagacgatcgatcggctagaaaaattgaagttcaccgaaaccgatggccgttccatccaccacccggagcgccagaatttttcgtggttagcaccgtgaagaaaaaaaggagaagaaaacagtcacacggcgcagagcgacatgcgtccactcccccggcccgcggtgctctgcacctctgctcggcttcggcgaaggaagtcgcggtcggtcggttgccgccccacgtcgatcgcgcggagaaagaggcggaatcgcacggagaaattgcctccggatcacggtgttctcctcctgccccatcccgcacgcgcgcgtcgcgtcgcccagttggttcggttgatcacctgttggatgcggtgcggtttggtgagttggcctcgcgcgcatgagttgcatcgcacgcgcgttggctgacctagtgacctgacctgctgcgcgcgtgccatcgacttggtagcagttagctactactccgtgcgccgtgcatgcacgccaaggaataatgcatagggaagggaagggaagggaaggctgcaggctgtttgcggtgtattccctctgtccctataaaatatgaatctaggatcaaatatatttagatttatagtttaaaatatgtaatgtaggttagttttttttaaaacggaggaaatatgttttagacctaacgaagtataatagactgtaccggccggccggccctgcagctcacgaattgtactagtacgtgacatacgtgacaggaaagagatctacactccgtatatcgatatcataccaatcgtacacaggtaaaaattctgtatagtagattagtactactaccgagtagtctagtacatggtgccgtcctgcggatcgagcacggcactcgtcaacgtttatctcgagtccacatcgatatttctgacacaccaagcatagagcttactaatttaattactggtctctaggtgcagagacacagatcgatggagattaatccgtctgacctccgcggatcgatcggccttcgcgtacgacgcagcgaggagagaatcacacgggaaacttctgcggatgacggcatttcttccgtgagctaggctccggcaacagcaagtcggcaacagtgttaaactactcgttatacagtacacaacgggagtgagccaagtgaaggctgtgcctatccaccgccttgcagatcgatcgatcgatcgatcgaacgcggttaatttgtactcaagcctccaggtttacctgcagtctactactacgagaccgcatctgacaaagactagtactgtacgagcttactttactcatctcgaggctgcaaacttaacctctgagggacagaaagatagcagcgattagtttagtactagtactactccatagcaaagctaatactgcaacagtaatagtataatcaactagtgctaataatgcaccgtgctgatgatgtcacccagattagcctagctgaataattttccgtcatattatctgaacgccacgcaacgtgtcccgtcgacgcctgcgtagtacacacacaagacaagacagctctctcaggtcgccatggcgatcaccggccatggccatcatcggtctcttgactctcgagcagccgacatggctatgcacagcacagcacacagtgtcactgatctgtttgaaatttgtacgtacgtgcagtgccattgggtgtgtacgttgctgcaattaacggtcgggagtcaaaggcgagaagaagaagaagaagaagaagaagcgagaaaagccatctgacaaagacgatgatactgctgctttaggtgagtaaacccacatcattaagcagcttaatgaatgctctatctaacatgattattatctcatctcgtggcctgataaagtgagagacgaaagtcacatatactactagcagtattatgtgtgcgtgtcagtgtcaagagttatcatgctttagccggtaagagtggctatcttcgctagctacatgtatgcaagtatcatcaagctaatagagtttatatatattgctctagctagctggtccgtcaggtaggtcaagtgtcccaagcgtacgtacgccatagatgtgctcgtgcggcgaggtcgacgcacggccgtgtcgcgctccatcgttattatagatgcaccatcatatctctcgtctatttctccggcgatatgatgcgaccaccatcatcgagccccatatttccatcagattaagcagaccaaggcagcctgatgaacttgattagaggcaattacaaatttatcactgctttgaatcgttattgtaagactgccactagaaaattataaaagtactactagaactgtcattcaaatgacatccttacaaaattaaaaataaatgatagtaaatttgcaaatgtcccgattgattaggagtactaagtaacatcagaatttctgtacgtgctactgtgcatagctacactactgccttggtcattcactcattcacaatgcaattaaaagagtacttttccatattaaaataaattaacttcatatcagacatgataattctactactacgaatctaactaataaacacgactcgtcctagggttgtgttcgcttgaggaggatagaaatgcgcacggaaaatggagtagtccattagcgcgcgattaaataagtactagctattttttttttctaaaagtggatcaatatgaatttttaaacaactttcgtatagaaactttaaaaaaacgtaccgtttaacggtttgaaaaacgtgcgcgtggaaaacgagacgggagtcttgcaaacacagcctaggtttatttaacggcgccccgacctgcctcctccggtcctgcacggtagcctggtatgcacgggcacggcaattcaatgcacgcatccataatagatcgatcgccggcgcgggccacgcacgcacggcggcggcgtttacgccatatactacctcgagtgaaggtggaagaatcgcgtacatggggatcggatcgcctggatggtttgtgaaatccacgggagagtacgtactctatctactgtacagaccgcgacgccgacgcgtccgggctttttggcattggcaggcggacgcacgcagacgcagggcatgggttgatggagtacgtgagattcacacgcagacgcacgcggctccggcctttttttctcacgcgtcccacgttggggggctctgggacgttggactgccaacggatcccttctgtgccgcttgtgatggctgactgccgaggttttcattgccagtaacatctcactcacacactgcagtcgctgattaaatttacccaaaatttactacgagtactacagtaccacgacgactaataacaagtggaccagcaaggaccgtacaatgtaaatggagggggtaaaatcttgagtaattagatgaagaggagtggctatagctcgtggagtagtgtatgtgactggaccattgtatcatatcatccagtaacaaaaaaaaggaccatccggtttgtttgagtgtttcctcacgaactcgatggatccagccacagtcaaagctttcggctttcgtttgcatgcatgcatgcttgctcgatcgatcagctcgctacttactggataccaacacgtctcatgtgtctgccctgatttctagccggctgtttcttcgtaccctagctggaaatcagatgagctcatcatcctcaccgactaattatactcgcttccatcgcacatcaatttgcggcgacgatctgaaactgaaagtaccaattaattaacaacctatacatcatttatatgagtatattcctacgtgtgattgcatatttgtatatatattcagttgctaactcagaacgcaagcacgcttctagccaacaaaccgaaagaacacctaacatttggagacatctgaaccaaaaacgagctcaattttttacactccttaatatatataccactgatcattcagtccccactctaaattatatatataaaaaaacagttcttttcagagtacaaaatacagttgagttactagtagcattctgctcgtgcttgtgcttctccttccacactttgcctatgctcgggtaccg

SEQ ID NO: 57833 - DNA, 7801 bp, Oryza sativa
  unsure (1)..(7801): unsure at all n locations
attgtgctgccgctgctcacggtggccgtgctcgggctgtccatcgcgttcttcttcacgcaccggcgtgggaatgcggcgcgcgggggaggagtaggcggcgggtgcgtcggtggcggggacgccaagttcttgcacccggagagggcgagcctcttcgcgcgcgacgagttcggcgggagcggcggcgccgccgcgccgccggccgcggcgatggattaccgctacgtggggaacgccggcatcgggcggatggacgagaagagcagcgagacgacgtcgtcgggcgacgaggcgtcccggagcaccggcggatcgccggagctccgcccgctgccgccgctgctggcgcggcaatgcgggccgatgggcgcgaggagccccggcagcggcgtcggcgggttcgcgtcgccgtcgtccggcgacgaggaattctactcgccgcaaggatcatccaagatgtcgacctcgcacagaacgctcgccgccgcggtcgaagccgctgtggccgcgcgcgaccgctccaagagcccctcgcccggctcgatcgtgagcacgccgtcgtacccgtcctcgcccggcgcgacgatgtccccggcgcccgcctcgccgcctctcttctccagccccggccagtcgggccgccgctccgtcaagtcaagatccgatagcgtgcgcaccttcggccaaccaccggcgcctccaccaccacctcccttcgcgccgacgctgccaccgccgcctccgcctcgccggaaaccgccgtcgccatcaccgccctcctccccactcatcgagaacacgtcggcgctcagatccaccaccaccaccgacaccaccatcccaagaaacccattcgtacaaccaccacccccaccgacacacacccacggaccaccaccgccgccgccgccgccgcctccgccgccggtgggctactgggagagccgcgtgcggaagcctggcaccggaacgtccaaagaaacccggtccccggcgctgtcgccgccgccgcaggccgccagcttcaagagcggtctacccaccgacgcgttccccggccgcctcgcggacaatgcggaccacgccgccgccgccgcggccggcggcggcggcgacaagttggaggagacgacgccgcggccgaagctgaagccgctgcactgggacaaggtccgggcaagctccgaccgcgtcatggtgtgggatcagctcaaatccagctcgttccagtgagaactccacccaaattcacaaccttattcagttcttgatctgtttttctttttgtctaaatcattttgtggtgaattctttgcagggtgaatgaggagatgatcgagacattgttcatctgcaatccggcgaactcggcgccaccgaaggagccagcaacgaggaggccggtgctgccgacgcccaagacggacaacaaggtgcttgatccaaagaagtcgcagaacatcgccatcttgctgcgagctctgaatgtatccaaggagcaggtctgcgacgcgctctgcgaaggtgaagaacatgatctttctcttaacttactcatcacaattttgccagtttctgatgaactgcatactgcattgagttggggatttttttgagatgtttgcagcagtatctgaattgatgataccttctaactaattggattcatttttctcgtggttcttggttgaacacacatggagcttgtgaatcgagatgtttgtccgtagaatttggttgggctttaaatacattgtctgaagaagtgaatgccagcatacacccgttggtggtcgttgctgaatttagccgtttttaagctgaaactgactagtaattgcttctggatgactgaattaggtgcatagagttatacctgcggtgaagatggttagagataccattgttctgatgtgaaaaccagtctttcgatctactagtattactaccgtagttgcttgatatagtattactacttctctgcacatagtcttgacttgggtgcaaataattgcaagatagttgcattattgcaccaagtttctagtcaagtcaatgagattgatccttcctatagtattatccttactaacgtggtaccaattcactgagcaggtaacacagagaactttggagcagaattgttggagaccttgctaaagatggctcctaccaaggaagaggagatcaaattgagagaattcaaagaggagacatctcctattaagcttggtcctgctgagaaattccttaaggcagtccttgatatcccatttgctttcaaaagagtagacgcaatgctttacattgctaactttgaatcagaggttaattacctgaagaagtcctttgagacccttgaggtgagaattatcgtttccgagtttcctttcatacttattattatattgacatcttacctataactaagtacatgaaacttttcttaacagactgcttgtgacgagcttagaaacagcaggctgtttctgaagctacttgaagctgtcctgaagactggcaacaggatgaatgttggaacaaatcgcggcgatgcacacgcgttcaagcttgatactctactcaaattggttgatgtcaaaggcactgatggcaagactacacttttgcattttgtcgtgcaggagattatccgaacggagggctcccacctctctgctagcaaccaatcaactccacgaactcaggcaaaccctttacgggacgagctcgagtgcaaaaagcttggcctccaggtagtggctggcctcggaaacgagctcagcaatgtcaagaaggcagctgccatggactccgacgtgctaagcagctatgtctcgaaacttgctggaggaatagagaagatcactgaggtgttgcggttgaatgaagaagtcaagtccagggaagatgcatggaggttccatgattcaatgcagaagttcttgaagagggctgatgacgacatcatcagggttcaggctcaggagagcgttgcgctatcacttgtgaaggagatcaccgagtacttccatggtgactctgcgaaagaggaagctcaccctttcaggatcttcatggtggtcagggatttcctctcagttcttgatcaagtctgcaaggaagttggcaggatcaatgaccgcacgatcgctagctcggtgcgccatttcccagtacccgtcaacccaatgatgccacagttgttccccaggattcatgctttgagagctggaatctcagatgatgaaagttcagccacttcagcatcatcaccttgatcaccagtagtctgccaatagaaatttttcgcagagtactgtgggaaacctccatagggcagagggagaccaacggcgacggggtgtcaaatttttttttgaaccttttgtacctgtagattatagaatgtaagaagtttttttgcaaatatttatttctatatataagaggagataaaatctagatcagaggaggaaataagcagttcatgtgtttgtcatcttcagtctgtacatgacacgaggtagtgaaacagcctgtacaatgtactaacaatttcaagtatggccagtctgcagaattcaaaggtaagctgaactcagatgtacttggaacagaaaacaaaatacattgaatcctagtgctggactgctggtggtgccaagaagaaagaatcgattgtgttttgtcaccatctttcctgcacaaatggtccataccacatacatacaaccatagactttacctgacaatttcatcattttacagtaaaagaacctctcaattacttcatactctgttcagttcagaaatttcactgacgctcaactcagaggctgacattctgaagccatggaaggctcaagtaatggctggattttcttacattctaacccgtttcaaaaaacttatttcacatgtagactccccaaaaaaattatcacaaaaatagacctagaactcaatgccagagtcctcggctcgatgatggacgtctcaatgccattctcgttgacgctgaggatttgggccagtctccatgcaacagatctcccgcaccatcatcaccatattcaagtctttgatgttaaaaatataaaaaggcaaataaatcatgatttatcaaatttccccacaaatttgacaacctaataacaaattaaggaaagtaaatcaagatacattgattcatcaattttccatgaaatttgacaccaaatcaaataatagggctcggagaggatgtggagaagagaggaaagttgttcataggtgacaaagggtcggcgccaaacaaactagcactgaccctcgagtttcatcgccaggatctttggcgcggaaacattccacttcggtccaatagccttggcgccaaattatgggtctattttacaataattttttttaaaaagtctatttaccaaatatgtttcaaaaaatgaccaaattgtaaaaaaaaaaaaccagcaagtaatggttcaatcaacttcccattttgagcatttaaacatacataatgcctgtagcttaactaactgaacatttcattttccatgtgagctagaattcccatggcttcatggcatgcatagtagaagtagtactccggggagagagagagactcaggcctcgtttagttctcaactttttcttcaaaccttaaacttttccatcacatcaaaacttttctacatacataaacttctaacttttccatcacatcgttctaatttcaaccaaacttccaattttagtataaactaaacacaccctcagactctcagagacggtggtttgggtggcagctttcgttaggtccccatccccatgtgagggtgacaaccatgccttgtagccatgcccacaaaacgttgtggcatggcgccccctttcctaccaaactctttccttgccattttgcaaaccccacatggctcactttgtctcctacaccttgtggattctcttctctaatggactcaaatcattggaccccaaagccaagaaaaaagctctttgttttggcctccaaacacacacacatggatcaatttggctgcaaatgagatgcatatgttcgtcagagactatgattaaagaactatgagcatgctaaggagaggaagcaagaaatagtcagaggtgatcagggtttgcatttcctttttgaaaataaacacgcttctcaccatttactgaaaaccgataaaaactagcaaaaaccaacaacttttggtaatgccatacgaaaaccagctaagattggtttccacaaaccatccattagcggtttcacgaaaaccgatctgttttatgaatcttggaggtgatactaggtcttagattagtggtagcagttgggagttggaaggtagagaggacccggccatggcaatctactggggtagaaaagattctgaattttggaaggagagaacaactgaacaagcaaaagaggatgaatgacaggtactgagtactagtatgatttggagatgtgctactcaattcttgcaatgacgctaaaccttttaaatattcctccgctacatcagtctcatgagttgcatgtgcaaactactgttagtaacaatatcaatgatgtcttatgaatgtgctgtgattgcactgtccatgaaagttaagcactctgaactctgaaggctttttgctgtgagctcttcaccggttgtgaatgatgtgtgcacaaaccataaatcagaaatcaactagagtagtaacatccagtaatatgtttattttttttcttcagaaacttcttaatcggggatatgagcctgacaggttacaaagatgtcaggtacttgaacagaaaacaaaggctgctaattaacttattttttgctgcttcagtccaagcagagctccttcaaaagaggcaattgatccttcagcctgaatctacctctacttgatctagctactactactttgcttttcacaagtagaaagcaaggcagcttctgcaccacatggcattcctgataaaatcagggatgctaacacaagaaaaggtggcatctttatcgtctaatcagaataattacgtacttgaaaatgttcctccattgtactaccatgcaatgcaaaattgcaaagaagaaaaaaaatgctttggcctgtcacgtgaggaggaattgcccacgaatcaaagctttttcatgcaccatggttctcacttttcgcaaagaagaaagttgcaaggtgtgatgccttgtttacgtaatctttaaagggaggcgtgtctcctgaacgggctcccgttcttcttcagatcagaatatataccagatcgagctatttctctgagatgctctgagaaaggttcaggtttgtgcatgaaccagagcaaaggaagccaaaaacaagatgcaagagagtaataaaaaagaagaggacatcttgggcctgcaaatggaggtgatcactggacctaaccagttgacaagaggccctaaatgaattagttattgcaggccgagtgtcacactgtcactgatggatcagatcattgactagtttcacacaattgacatctaagcacaaaagaaagaggcaaggaaatgagagcagaagaaaaaaaatgtttagaaaaatatcaaatagggatggctgcggtggcttaaccttcatggattcttgtcaggcctactctagttcaaccaaatgaactaaaattcatactgccttttacattggttagttcaaatatgagctaaccatcagaaatttcagaacagagagagtacttcgtagccagtgttgtgtatttatactttatttggttaaaaaccagagtggctcaacaggtagagtccatccctgtagcaacccctctacagaaacagaaagagtataaccaacaattctaagagtgccagcatcagagtacatctgaaagctctgaacagctaggcccttgcaacggcctgattcctgctcctgacgctaccatcatcaaaatccaaagcagcaatgcaacggcatgaagctccatataaagtgacgagagaaccattgcaattttgcaaaggggccatgctcttgatgagtatccgtagattcttgttgacagaataaagaggcaaatcctacaacagataggcccctgaacagaaaagaaagtgaaggggccaatagcttctatacaggttccatggggggcaataatggcaggtcactttgtccttcaccaaccatcagtccatcatcagtgacctaacagagaagacctcggcccaccatcatttaaagataaagggatattcagagactagaatgttaaacacaaacttttacagttttactacactggtaattgcttactggggcctactgaaggacaaccaaagactgatacaacagcagcagcaaagaagcatggagattataagcgtgagggctgtaaacatgagtgtttggcattgattcagattttattggtatgggcaaacctctgaatttgatcaatgacaaactaaatagcacatctgagatgtatatcaatataagatacactattatgatgatgaatagatacactacatatatcaatataagatacaacaacagcagaaacgattactgtgtaatgttcctttactttcttcagaacctcgtagttaatgtcagctttgttgtcagcgtcatcgccctttaagaagcgcgagacccaccggaccgctgctctgggatgccgggaaagnnnnnnnnnnnnnnnnnnnnnnnnnnnnnnnnnnnnnnnnnnnnnnnnnnnnnnnnnnnnnnnnn

SEQ ID NO: 57834 - DNA, 2606 bp, Oryza sativa
ccatttttgtaatcaacataaacaatgccaaacctcttggtgtatcccatagcccactcgaagttgtccaggaacgaccatgcgaagtacccacgaacatcagcaccatccctgcatcatacagttagttgcattagttgatttttagcagaaaacacttagacgcgtggtaaacagcaagcaaaatcaactaacttgattgcttgtgcaactgacgcgaggtatcctttgaagtaaccaaccctcgtcgtatcattcaagacttggtcaagcgttgccgattgatcatcttcctcatccatgcctacatgagagaaactatggtaaaggaagcaaatatcaaatgtgacaacaatttgaagtgtgctcgcaaaaacctttatcatcaggtacagtactagcgtaacaaacatcataccgggacatttcacatacaggattgacaaatttaattcactccagatttccaataatgttttacttttactactttgcatattctgaccgctccagaaattaaaacaaggaatggccaaagactgtatcaagaaatttgcttccagaccatatttatagggttctccagctttggtttttcatgtctcatgtgctatctctataatctatatagacctagtaatgcatcagttgtgagctgtagctctcattcctgaagtgaagagtgaaataatgtaaaccctcagaatgtaaatcggttcactgctcaatagtcacaggcaaacatacaagttaattatgtagaacaaaggggcataaagatatatatgttagaaaattctatgttgcatcacattcattttaggaggtatggaaaccttaccattctcagttacatatatcacaggatttccatatctctttgctgcataattaagtaatttccggaggccccaaggaactatgaaaagccactcagatgcggcctgcaaaaatgttgacatgatatgttaggacataatccacagaatttacacgagagagagagagagagagagagagatcagttctgaccctttcaccaattttttcaccagtgttccatttttctgcaaaaagtaaacaaatgttacaaatagtttgatcataaggttttgcaaaaatggaagatatcatttcattttgaataacataaaggagatcgcagtaacacaagccaaactgcaataatgctagtattgccacacggaccaacaaatttgcagtgttttactccaagaaaacagtctggaaaaatgaaacagaggagttatgtggatttcaagttcgttagtaaagcgcttggcaatggagatggagttaacagaaaggttactacacaggtacaaactgacaaactgttcttttaactaggcaatggtcgctcttgcacataaatttaaagtttgactcttgctaatgaagcctcttacatctattataagcggttcaacagttttcaatgcctatgcattatattcttttgtttgaagtataattgttgtttgaggtcttatgctgcaacaattgtgtaagagaaagattctgctgtagctgaagaattgtacctattctctccacttgttgtactcggtaaaaataaatatcttctggatcctgatgatgagcaatgaatcttgaagtataatgatttattccaacaaagtcaattttgttcctgataaattctttatctttctccgagaaggttggaagatcatcgcccagtcgctgacgcatactttctgggtaatcaccgaaatatattgggtccaggtacctttaaggaaaagtagcacctatgtaagactatgacacgcaatatcctaagcctccctgagccaaaagatgtgggagcattgtaccatgaaaaaaaaacatgttacaatttctctcggtgtatacacaaagcatttatgccttgtgggagaaaattcagcattttccccatgtttcaggaaaaaaaaaagatgcaggacaatactgtgcaaagcataacattataccatgaaaaaacattttttgccttgaagaaaaaaatggtagaagctttcccttgtttcagaaacaatattgcagcataacactgtgccaaaggtagctaatgtgggaaactgtgacgcaagtaatatgagcagaaattataccatcctagctgaaagtcaagccttcgttctgcagcaacctgatcttctgttttctctgaaaatggctctgcccattcacaatcgacaaccaagcctacttcaccaccttgcacagcctatttttgtataatgtaaaactgtcaggaaaataaaatgttcttcaactacaaggaactgatggaataatgatcagggtgcccaaattttctgctaccatatctaccaatggaaacacgtatcatcagcaccaatgtcctgacataggattaatagaacacaaccaatgtcctgatatattagtatatcactgagacagaccttaaatttcctttgtaaacatcaacagcagcagcatgagccaagatttggtagtgggcggccacgtagcatctagcagtttccccttcacatcctccaggtgcaaaatgtccaattccgtaaccattaactgcagtttgaaga

SEQ ID NO: 57835 - DNA, 16440 bp, Oryza sativa
tactccctgggatattttgacagtaagaaactcacataaaccaaatcaagtttgcaagcactttaaactaaatcactcatcttaataataatatcccttataaattggttatatggctgtttaaatgactttttaaatcatagtgcaaagtaaagatgtcgtagtgtcttacacgatcttatcagaaagccaaccacccacagtctgctgaagattatgtggaagatcccaatgatacagagttgcgtatggctcaatacctacagccagacatgtcattggttaataactagaaacattgcaaccttgtaaggtattaagtaaagcatatgccacctttctcaatcatgaaatttataaggtcattataaaaggcaactccttgctcattgacatttttccccaggccatctgcaggcatgataaaattagtctcaatcatagaaagatgatctgaagcattactgatgaaaaaaaggatgtcatatatatctggaaatgcatggcatgtgcaatttttgtatgtgaagctctcatgtgattagctcaacataccaggaaatatgcgtggccaagatatagaaaatctataagcacggaaacccaaactggccatgagttcaatgtcttcctgaaaaaactcatcacagacaagaagttactgctctatgaaaaaaatgcattgtacagaaatatgaaagtggtctatgaggaaaaggactaatgtttgtttagaacaagtttcagggattgtttgcaataaaattaaaatgaagccagtgttgtttcccttttttccttgaaaagaaagacaaggaaggcaattgctaccttgtatcgatggtaatgatcaactgcaacttctccactgctcccatctaagatacgttctgaaaagcacaagcatttgaacattacctaattaaattgataggcgccaaaaacatagaacccaggtaaacaaacctttgttttctgtgaaaacatcccatatgttatctcctttgcctccctcccgtctcgccccttcaatctatacagtaaaagattcatatatacatgatttccattttgggagagaaaggaagtagcacggctgttcttcttccttctatgaaatgaaacaacagcaaaacaaacttctttattccctgcacaaacttctttactcaatgttcctctcttctctttagtgaagagaaagtaaaatacaattaggccttatttgtttaatccacacctattgtggtgtggaattattcctcctcaatcccctccaatcactctctcttgaggattaaccaatcaaggccttattgggttaaaattctctcttgccatagcctgtattttccattttcaactaaaggttgcacaccaattttagtttgtctgttaaccttttttttcccccatatatcttcctcatccaaccatcgactcataaaaaaatttccacaaaagtggcacctggggccgattgagtatatgcacaaaaagtaaggcacatcatgaacattaaatctctcatacaggagttctacacgcagaatgccaattcaagctgtccgtgtgatcacaattcacagtaaaaccaatccacagctaagtctaagctgatcagcaagttgaaaccgaaagggtacaacacccacagtgatggcgccaccagaaccgagagctacactcacccaaaatcccaaataaagttctaactccatcccttcccaccggggtacagtacactactactagtagtagctagtctagtacagtcaccacgggcagcaagcagatgcgatgcgatgcgacgcgacgcgggcggcgagtacctggtaagcggaggtggcgacgccgaagacgaagccgtcggggaagtcgccgcgggtcacctccgcgtcgcgccccgtgctccccattccccccggcggcggcggcgaggaggaggcgatctccgcagcgtgcgcgacgcgtggctcggcaggtgagtcgcgcgcctcgcgtggtttctgcctgcgacgaggcgtgaagaagacttgtgcaaataaataggaggagagcccacgtgagcggccacgggggtgggtggcacggggacgaggcggtgggacccaccgcgcaggctctgtcgacccgggaggtggccccacatgtcatactgatagaggcaggagatccggatctcgtttgcgcccccacgactctatgcccccccctccccttctgtcctttttgtcgtgcttagaggttagtaactgtagttcttgctaattactctatcgaagtctttaaaattttttggccggtctttgactaatggcttgtttatggcatgggtttatatatttcaaaattcataattatatcgagactgtttcataaggggacaggatcgtgccatttgtttgaggtcaaacagcccaatgtgcaaacacgccgttagaaatacagcatcagcagcagctttgcatcattccatacagtgacagatcatgtggccaagcttaacaagacgggaagttaaatcgaacgaaaatttgcgtcacaatttagagcaacttgttcgaaaaacaaacagcaacgagagcactacttcgaatagaaaataggcactattaccagccaacttgttcttgccatgcccatgaacaaaatgtgagaggatgccggcagagattccactacagaaactcagcgcacattcagctcatctccagtggaggaacaaagcaaaccatgtaatattgtcactgcaataatacttttgctctgtgtccaatggcacgcaaaaaaaggatgcagtttgcaactttgcatcagaccaaaatagtttcatgaactcaggatctgattccgacaatcaccatggacggtcactgattgcttcattagtactacctccgtcccaaaatatagctatatctagcacagtactttgtcccaaaatgaagctatttttctaactaccttctcctctcaaccattcacaaccattctttttcacatactttctcttttcaaccaatcacacaccttcttcaatcattctcacctactttcttaatacccgtgccaaccttaaaaatgcttgcattttgggacggaggaagtatatagtaactccattttggctttacctaatgaaagaagaccttgatcatggccaatcaatgcatgattccttcttgtctgcatagcaattgaatacattatcaaatcaaaaaagaatatatttgtgtggttgtgcagctcgtgatagcttccacccaacagcccgctcacagataaccaatcggtacacataacagcaacagctagacacagctcctgacgaagtaagaaaaccgtcgatgtcttttcagagggtgccgacaaaggcttgaaagtaggagactagacaaaactctaaaatgacatgatgcaattctttctaccaaattcaattacgacaagctgtttccaatttctcacagctgatcacccaacagatactgatacattgaaatgaataacagtctgttgtaatagatgcaagggattaaaccaaaaaagtttacaattatcttactacattatggtaattctgttaagtcagttgtcactttgtcaatagtaacaggtgatccaataaaaaagttccaagtagagtttgcctatttaaggtgggagtacgaacaaaggattttcctggcacgactttctctagactctactacactactctaaatataaatgtctgtaatgctaggcaacttggtagtctgctcttttttgttttggaaatcaagtcagaaaaaaaaatcaaagcagcacaacatatgatgtgtacagttgctccaatactattgagctaccagtcaccataagacagtgatacaacaacaactaagaggctattaatactaactgaatgcaagacagcaattcatcatgcaagagaactgggacgaggctattacaacgaccaggtccaaccgaccaaatacaatgaaactatattatctgaatggtggtgcactcatataggaactaaactacatttatcaaataaaagttatctacttgcacaccaaattattcatgcatgtcctagtaccaggtcaatgaaaaatatcttccctaaatcagattccgatgcttgaataaatatacaatcacagttcactgacattttggtattttttacatcataactgtctacatgttctttgatataaggttctagaggtacctgctgcaacattgacatttttgttctgatctgtagctctgtactctctccttgcaaggcatgagatcatatggaaaataaaatatggaattctctcagttctaaagaagtaggaattctagaccaaaattaaatctcttcctgtcagtctagcacttacaatataattgcaagattattgtagcatctaacaacaaacagacacaagtacaaaagctgatgtttctcacaagctcaccagagaagcagagagcaaaagaaagcactgccccaaaattgattggcagctgtgtcactgcaagcgtaccaaaaagaaactatgcttcttggctggcttttgacagctcatccatttccaattccttgactgctgctataaggcttcgagtagtgcctttaaggcataatccaccatcctccatttccttcaggagattctcagcagttctccagtccaaagccttgagacaaagtgactggataagtttgttgtactcatccatatttggctccatcccatcttccttcatctcctttaggcactccaaggccttctcaaactcctccatcttgcagtaaccacgaataagtgtgtgatatgtaaccctgcttagtcttggatgaatcctcttagcatcacgaagtagtgcatgggcttcatccatcatgcctcctttggcgtagccactcatgatcacactgtatgtataaatgtcggggcagatcccttggttctccatcactctcatcaaaccctttgcatcctccatttctccatttttagacaatgccgtgatgacaaagttaaacactgcgctaccaggagctgggcctagatttaccatcctcatcagcactttctttgcatcttccacgttgtttgtattacacaaaccatgtataaccgcagcataggactggccagcatccttaagagattccccctggtactcttccagcagctcaagagctgtattaatggtctcgtcattcctcgccaaagcgctaacaaggaaagttaaggccgaggtcggagcctgcaccttcttttcctttgcagttatgtatactgaatgtgcctccttcaccttcttcttcttgcaaaagaacatcacaatgtcaccgaccttctcgccatcggggaagcagccagagctaatcatcccatcgcaaactctccatgcagcatcaaccatggacttcctcccagctgcttgaatcgccagataatagctgtcgccatccggagcgcatcctaactcactgaacatgtcaaacgcctccaatgcagcctttgacttctcgagcttccagaacatcgcaagcagtttattcagcacctgtgtattcactgatccaggcacagctcccatttccttaaccaaatcccagagcaaatatacatccatcttgtcgatctcatcggaatcagcgatcttgtcgacgactatctcaagattggcgaggctcttggccgcggggttgttcttcccggcagatttgaacaggcggagcagctttttaccggagcagctctcggcggcggacacgagaatggcggcgaggagtggctcgttgaagtccacgaccatgtcggcgagggcggaggggatctgatcctcgggggtggactccacgacggcgccgacgcgcgcggccagcacctcgtcgaccacagcatcggcggggtcgggggaggcgtcggcggcgaagacgtcgtcggcgtccccggcgtcctcctcccagagcgaggccaggttgtcctccccggcttcggtgggatcagaggcgaggccatcctccccggcatcggtgggatcagaggacgcggaagcagcgccgccgccggcatccgggaggggctccggggaggaggagaggaagcgggagagggggcggggaggcggtggcgctcgggttaaggctcgaagtggagatggcggcggcgggagaggcctgtggatggaggagcggaggaggaggagagcacgagctcccgaacgccgccacatctcctcctcgtcggcggcggcggcggcggcggcgtggtagctgtaatgtgtggaggcggaggagtcactggtcgagtcgaggtgggaggcggaaggtttctttcttgctttctagggtttaaggccttgatggcgcactggactgggcctgattatttttgggccaatatgaaacttttctctttttcccctaaactaaattgccagttattttcaacacatttatgaatttagatccacgattgcgttgataacatctagataaatcatctttttcccattttagatgaaatataaatttttaaatcattataattcaacatacaaacttcaaatctattatgaatctaagaaccgaaagacgggaactgtgccaaacaaggcctataagcctcatttccaagaatcatcgccttcactttcgagataagtttgaatccaaatcttcgatggaattatcagcatttccatggaacatattatgatggactcttatactgaccaacaacagaggaaatcaaagcagatgaggattttattccaagcgacaccaggttttagttacatactgtaagacacaaaatagacattcagattgagctgctcatttccaggttgtatgattctactgtctattgaatccaacaggctacatgtcaaagaaataaaagatacatggatccttcaaaaaaaagcaacaggtagatttgcaatgtaggagtagtagcaatctccacccacacaacacacatctgaatgtgcatctatgcagtgatctcggatttggcattcttaacattttcttcatctttggttgatgccgctgctgctctgtcctgctctttcttctgcgcccttatcagtacacgtcttgcccggggacgcatctcacgcacttggcgtggtggcatcacaaaaggttcaagagggcgatcatggaatggatgctcatttccagaaaatatcctcagtttgcgatccctgtcctgtgatcagaacagtgcatgcttaataagcaacaacagcattatatgaagctttagcaatttgaagacgagaattgaaggaaaatatagatgttttaccacacaccagagaggaaaagacttgatttctcggacagaatagagttaaatcacataacaaagaaacaccatgaaagatcagtatacaactatcatgtggaacatgaaccaagaaggtatgattggatttacggtatgttgaagttgaacttgctattcaatacagttctcttgaaaatccccaccccatagaagaattgtaagataaagttcagcaaggctaagagaccgaaactataggcttattatggtaggttgaagctcaaaaatcttatcttattaatgtaattccaaactaagagaccgaaactataggctagatgtagaacaggattcatattggatagctatctagatgtttcaattatagactccattccttttcaaggggaaacaaatgtatacagcttccttcgctcagtgcaatataaacacagatatgctgcttgctgcaataatgaaataatcaaaaaaacttgatttttcaccattcaatcagcatgtcactgcagattctgtatccctacaatttttgggggtattatgaggaatcattggcaggatgaatacactaccagaatcacaatacgtagcataggcaactcacaatatatatctactgctgtataattgtattcgatcatcaatatgccatctagatccatcagcacaccactgtttattcaaactctagagtttcacaactcatgaagctagtccacatcaaggactgatgtgaatctctctatactgaacctaactggcctaactggctctaccgtgaatggatgtactacacgtttgcaaaaagccaacagctcgtcccttgcccgtggtatcccagctgctacaaacgacctcctgcaggccacgctacaaacgaccacatgcaggttatgctatctctaggatcagactcacatttcatcagtatcaaagcctaaaggcaagataaacacgcatgtcgctctggtatctgacggtttcaaccagctgcagtatgcacattctcaatcagcagacaaccaaatagaccccatctcggcgatcacccactctgactgcggctacaccaacactggtacaccacctgtgaacgaaagctcatgcccacgaggagaacctgatgggcgacggctccagccgaaacccaaaacaccacacatccctccactccacctggtgctttgcagagagcacacgcgcacaagctcctattccacggggcaccgcgcccgcgccgccgccatgggtggatccaggttacattaggtctcagcgccagccgaaatatgcgaggggaggacagcgcggctcgctctacggagacctcgatgccatctaccggagaggaggtaactgaccttgaggttgtcggtgaaggccggcagcgccacaaccatgttgatctcccgcggtggacttgtggccggagacgagaggggaagaggcggcaacggcgggggaaaggagaagacgatggagtcgtgggagcgactcttttgtctccttagtgcttagtgggccccacaggcccacctcattatatgggctcaatttgggcccaagtttggccttcttcagattgggctcctttcgtttccaacgagtttgagcctttttttttttacctccctttcttcttcttttttctttttctgaacgcgcacaatccttgcgcatcgatatattagaagggaaaaatatattttacaactaatacctgttagtcatcagggtaacaggaaataggtggaacactgaaagacaatcgggcgcctgtaaacaaggaaaaggagaaagagcttgtagatttgcatacattctttcaaaatttgcataaatttcacttgcattttaacaaattcaagtttatcctcccaaataaacaaaaaaaaatcttttaaatcctcccttgccgctcacatcggcaaagcaatagtagcttgcagatgattttctgcaccctccatggaagcaaacgaagcccagaaatgacatggcaagcagctttcacgtagctttgtgctaagtgcaaacttcaccaccaaaccaagccatctgcaactctgcagcaaggccgccaagatagatcatcgacgttaaccccgatgcgatgtttaagctaataatccaagtcaaaatcataccttgccatgctctccaagctactccaattttctgcgattgatgcggtaatggacagtacaactaccagtacaagatccgggtgacaagccaagaaaacgcggccgcgcgggaggaggaggatggaggagaagaggcagcggctggtgatctctctctcggcgctctgcctcgccgtcgccgtgatgtccggcgcgctgctgccgccgcgggcgtcggcggcgggaggggtcgggaggaagcggcggtgggccgggttcgactactacgtgctggcgctgcagtggccgggcaccgtctgccgccagaccagccattgctgcagctccaatggctgctgccggtgaccccccatccctccctttcttggctagtttcgccattgtcagcttggattgatttgctcacctggtgcttctcccccttttccgtctctgcagctcacatccgctcaaattcttcacgatccgtaagtgtgtatgagttcttgcggatcagaagctaaatttataatcgattgtatcaattcgtgaattcatattcttaaattgttggaatagatgggctgtggccgcagtacagctatgggggatggccatcctgctgcaggccaaccacattcgacggcaacaaggtggctgccaaccacccatcttatcttcagaatgggatattgggatgtggtcgttttcccccccaatttgatgaagaactgctagcttcttgctgtaagattggcatgtcaatgtgggtgtgtatttatctggttttaccttgtgacagatctcgaggttgaagacgatactcgaggagtactggccgtccttgtactgcggctctttctcaacctgctttggtgggaaaaggccattttgggtgcatgaggtagacattggtatctaaatgagatatgtgatttgatgaggagaaattactgacatcttacccttttttcctcttgactcttgttcatgtgctgatgctttactcgacattcgtcagtggggtatgtgatttctgaacttgttgttctgctccttaatgttgtcaaaattgttattcctagataagataagtactacaaaattccttttgtttaaaatatcatgttgccaatgcttgagaaaagaatctttatagtttcttacaccatgaataattcctgtcctcgaatcactgaagacagactgactgcattccatgagtttttttgaacatgacaaatttagttagttcctcgtatgtattaaaaagggactgctttatgtcttttttacgtataatttatctggtcacaaacagacagttcagaagctgcatgaaaaggtttgacctctaattggcaggagcatcccaacctaaactttcctaagcgtgccagatgatgcggctccatttttattgtatctaatactccacatttttgggcagaaactcatggaacatgtggttaccctgaaatacaggatgaatacgactacttctctacagcactgtacctttacagcaaatataatgtgacggttagtggatagtatttggtttcatgatatgaattcgtgaaactataaataatcacctcccatcttaattcaatatcccgcgtcaaaaaagaatcttaattcaatattatatacatatgcgcaaggtatttgaggttgtaacatttcctcagcacattgatatagttctcactctggtcttgcagaaagctctgaagaaagcacatatttatcctagaggaggcaggaaatacttagttggtcatatcgtctctgctattgaattttcctttggggcaatgccatctattgtgtgtaaaaacggctcagttcaagaactgaggctctgcttccacaaggattatcaggtaattttgatgtatttgtgagtgaagcacattattatgtcatcatgtccttacatattcagatttgattaaatcggtcaaagtaggaatttctcctgttatagtgatattagaagggcagggcctaatttttaatcgagtcacagtaggccctagattatgcaataacaaaacatacatattttttcaaaacggctaaacatagagtgttgagatagacaactggaatggatatcccaggctcccagctctcaagtgtccttgaaattattatttttactatgtggctttcgtgataaacatttatcgtcaagtgcagattcttctgagcatttctcaaattcataattgaactaaatagcgtatttttgcagcctcgcgattgcttagttgagggtgagaactctgttagaagaaaccattgccctcgatacgtcactttaccatcatataaaccacacggtgagttatctgtttgtgccaattatcagtcactgaaatgaacagacagtacatgcaatagaaactatgttttctgaacttctgaaatagtactaggttttctgaaatagtactaattgaacaatatagttcatttaatcatcttcttcttgaatttatgtggctttaccttctcttgttttaaagataggttttctgaaataattctctcagttttgacacttattatctggagaaatgcatgccttgtgctaatagaacaatagtataattgtttcagtcatcttctgcaattcatgtgactttaccttctcaatgaaaacataccttgttcatcccatgtgttttccctttttctgacactccggttgcacttgcagcatttggcaattctacagaaggaatcagtaaccaagtcaacgttgagcaccaatcatatcagtagatctcacatctcactgtgagtattctacaatataaacacggctctgatgactcaggaatgagatgtacagcaagaaacccactaggcacacatacagtaacgtctgcatctgtaattctataatgcaattcaattgattataaagcaactgaaaatcccatgctgagttatgcagaacttttactgcatctcagtttctgtaaatctgtaattctgaattgtctgcaaatttgcagcatcccgtcatttccaaattcaagcgcgccgttaacaattgccaatctcatgtttttgtgtcaaaaccattgtgctagatttcataatttgtcagcagctataatattttcgctgaatatcacatcacagcgtttatgttctcagcgaatatttcgctgaagtctgggagcttcgtgctctctgttccgttcactttacgcatctcaacctatcgctgtacaagcgcctgctttctgattgaccttggattatttgcgttctaagatttgtttgatcagatgctgattaatgtcaccttttggccttaatcatataaggaatattccaaagttaccaaatccacatgccatggcatcccgggccaaaatggtaatcagcctccggttgcttcaccttgcagggctctttatcttaaccaatctggaaaaaaattcacatgaattctgagaaaaaatgtgtagaaaacaactcgaatacttcaaagcgaataacaatccatttgaagcccactactttgaaagtttgaaatggatgaattttgcggaaaaatatctctcgataaaaatgctaaccaccaaatcacttgtaactaactgaaaacagaaatggtgcagtaatttctgatttggcggcgggagggccccacctgtcagtgagacgaccatcgcggtaaccgcatccaaataaatccacgtggccgccacgccgagcgaattgaccgtacaaccaagccgcagagaagaggaaggcggaatcagtcgagggcgaggcggcggcggcggcggcgatggcgacggcgaggaaggcgccgcgcatggtggcgatctgggcggtggtggtggtggtggtcgccgccgatctgttcggagcggcggtcgcgcggtcggcgtcggcgcgtcacgcggtggggaagaagcagcgggagttcgactacttcgcgctggcgctgcagtggcctggcaccatctgcgcctcaacccgccactgctgcgccatcaacggatgctgccggtagagcctcctcctcctcctccccgtctcctcccaccgccgccgccgcacgcgcgcgctcgtcggccggttttggtggtcgttacgattttcgcgcgcgcgccgcgaccttcggagattttttttcccctgatgcggttgcttttgcagctcggagccgctccagacgttcacgatccgtaagtgcgccgcgcggctgctcgatcgatcggtttaatcccaccctcgcgttcgatttggatgccgtttgctgctcgagcgaatcaatttctgattgatcgatgtgtgtgcgtgtgtattttgcgtactggatgaacagatgggctgtggccggactacgacgacgggacctggccggcgtgctgccgccacaccagcttcgacatggacaaggtacttggctgcagagctcctcctctttgtagctcgaatgctcgatgcttacacggttaattgaaagagtgacaatgacaaggtggttgtgctttggtgctaaccttatcgatgcatggattcgtcattcgatttttgtggtgtagatattgcccctgaagccgacgcttgagaagtactggccgtccctctactgctcatcctcttccacttgcttcagtggcaaggggcccttctgggctcatgaggtatataaaagtttcagaagtcaagaactaatggattggattatacaagtatacctcttttggatttgcaactgaccttttgtgctgttttcctgtctgtttgtcatatggtattcgatcattcgcggcatatctttagtggggtaatgttcttcaaatcattccaccttatgttatgagctttcttattgtttaactttctaacaggaagttattgattccacttgaaatatcacgtagttatatttactaggcactgatttgtcattactcaactcagctttctttttttctcagagaaacatggaacatgctcatccccggtagttaaggatgaattagagtatttcaccactgctcttgacctctacttcaaatacaacgtcacggtaagcatttgggcttgggcttactagttgtaggcttgtagcatcgagttgatttactttccagacaaaagtcactgtgtcacaaattacagcaacagtagccttttgtccaaataggtcagggtgttataaggacaaggcccaagttgagccacatgccatggcacaaaatcttgtcctttttcctctgattaaatcgcaccgcattgcaggaaatgttggcaagtggtggtatccatgtttcaaatggtaaacaatatgcgctaactgatgtcattgatgccatcaaatgtgcttttggggcctcaccgcaaattgtttgcaagaagggctcagttgaagaactgaggttatgctttgacaaagatttgaaggttagctctcctttttgttcttcgaacaacttcctacagtttgtatcatgaaaattatgctgcttttagaatgaacgaccaacagcatgcacattttgaaattatgttcctacaggcctgcagtttcatttgctaaaactcaagcatttaccaacctcaaacatgctacatctttctatatgtatgcctaatagtgaaaacaaaaaacttgatcactgttgaaacaccactaaactgtacggaattcaaggtgattatatgcatcatatagtgttttctgcttgtgtttcttcatgcccctattaaggaatgttttatctgttgtgttgaaatttctaaacatgtgctgcataaattttgactggtgagtatttttcccaaactagctacccatgtgaatattttccccaaaagttgggaatgtgcgcagtcctgcacgtgttatttggcaatgtctcacatggtcacatgttgcatatgctgtacaataaaatactataatctttctttttcaaagaaaacctgtacaatattgctaaactcggtggtatatttccagccccttgattgccttactactactgctaccaatgaaaacgtatcgaagaagaagtattgccctcgatacatcaccctgccaacatatgaccccataggtaagttcagttgctggaatgtaaatcattgttccaactcttgatgcgcatgctaatcctattgtctgattcgtctgaacatgattgcagtacatgctaattctactcgggagatcataacagtcgaaagtgaggtctatggatatctttacacatcctaagatacgattaccgcgagcaagaattacatggccatgatgaagccggtagttcagggctcttagctgcttaagacatactggggccggcattgaggttcaaggaaatgtatatctagataactcgattattacatttgtaagcacggcacgccagaacaacggagaatgtgattgtgtctgaaaaatcaattgctttatgtactatgcaaggttggaaaatagttcgtccatgtatatagtcattggtcagggtcatctgcgactgcaatctgctgaattataatggacagtggcaatcggtctgaacttttctggctacgaatatctatcatgtatgtgcccagagtacgtgttgacatggagcaagtcatcacgtgaattttgagtacaattcgttaagatcgtgcgagacattttcgagtgaagaactttattgtgttgtcatcgtcagttatacatgttccctttgtacaggtgaaaatgcacacttttgcacaccggcaattgcagcaaatacaaaccaacaactgtagaacagtactccctccctccgtttcgaaatgtttgacgccgttgactttttagcacatgtttgaccgttcgtcttattcaaaaaatttaagttaattattaaatttctttttccctatcaattctgattgcattgttaaatatattttcatgtaggcatataattttacacatttcacaaaagttt

SEQ ID NO: 57836 - DNA, 4689 bp, Oryza sativa
  unsure (1)..(4689): unsure at all n locations
nnnnnnnnnnnnnnnnnnnnnnnnnnnnnnnnnnnnnnnnnnnnnnnnnnnnnnnnnnnnnnnnnctgacaaaagaacctcaagccaacagcatgggaacaccatttccttgcactgtgaattcagcttgatcaacttccccaaagctctcaagaaattaagaagcctttgttcatctaaatgaataagaagatgttgagaaagagaagaaaactgctcgtccatcaaaaattcatcaactaactgccatgcatctctggaattctcctcatacatcaagtaaacgaattgatctacaaaatattctgtgtcaatttgcagtatttcaccgtctttgacggaatcagcaagctcttcagaagaccagaagtctgggacatactccaggaaattttccacagtccgcagaacatcgagatcacgaaaataatggggcttagtagcaacaacagcaggagactgcccatgcttgcctttccactcaagctcttcccaacaaatatcacgattcacaaatgcaaattgagaaagtgccctagcacccttcttatgtgtcaattcaccagtaaccgcaaagtgaccaaaccactgcattatctgctttggattccctgtagaacataataaatggaatgtcactatgtcagaaagaatagatgctcatgctcctgccagtatcaaaccagtctttctgggttgcaacagagacacagaaaactcaatatgctttgtatatttgattcagggcttactacagctgcacagcacaaaaagttacatggatgtttagcatgttttcagtacacaaaggcactcaccctacaatctctctgacaaattacactaaataagatcatacaatcatatatgcaagtatgcgagagccaactcatgtcagtcagtccaagttgagacctagatcacagccaaaaaatggttctatacctaaaacacaaatagaaaaaggcaggaacaaagcatgatgttactgtagtggaaacaccatttcatcttcttctagtgtatggcacatttgtattaatctaagaatgtgttaaactacttgcatgagtgagggactgaggggcgggccactagttactacccattatgtgaagaagtaattcaaactgagtgtacgcaattatgcataattccatatcttgtattgccaacaagccaaacaggcttaatatttttatgcaactgtaatagaggaacaaatgtcatatttctaggtaaatccctaaacagatatatctcaactagagtatgttctggatactgaacagtgagtcgcagcaagaaaaaggaatataaaacagatatatgtgagcagcagtagaaaaattcagagcatcgagttcttagtgtaattccttaccttggaagaagtcctctagcatctggcatttctttgctataatagaacctgcttttttgggctttttgtcaaaaatcatccgcagcaagcgggcagcgacatcccgtttggaatttttcatccccaagagattgagaaacaggtcccgctggccatatgggtcgagcaaatgaatggatgagaccgtactgcagagccacatccgagcctcatacccacctccagactttataaccgacctgattataggctccaccttgccaagaagagatcgccttgcttttacagcatctgtatcaacactaccaccatctgtggtcccttgaaaaaagagttgaaccatcttccaagagagattttctacctcctgaaattgaaagttgcaaattgcaataacaatgtttcacattctccagtcctcattgaagtaacgcatataggtaacactaaaaccttagattgccaagtaaaattcaacatggatttaacttagccgagatttgatcccaacacctatttatctgttgaaacgtcataggtaattttaatcggaaaccctaaactgaaatgcaaaatttaaaagttcctggctaggaaatagaaaccgaagcacaacaggtaccaactgagacctctacggcagcggggcaggttagcgtctctcacgattcacgaacacctccaggccgaccaagtcatggaggaggaggcgaggcggagatgggaggcgaggcggaagagcagcaaagaggaagggggcgacaaggaaaggccccctgcccgaggacggcgggaggatgtggcgtgaggaggaaggcggcggcggtggcggcggcggatcgagcaggcgaggagaggaaagcctcacaactcccccgagcaccacgatctctctccagctccaagaggactccgtgattgcgaccaaattctcgaccaatttgatgaacagattaggagcgcgacgcttaccagctgggcgcggcgggggttcccagttcccactagggcacgacgaggaagagaggcggtagtatgctcgttgcggtgagcggcggcggcggcggcggcggcggagcaccgagcagcgcggcgcggaggatcggaaagaatgaggcggtgacggtgaaattggagaaatttgccacccaattcacatactttttttttctcgattcatactatcattagtaaatttcagaaaactaaatgttttatgttttatggttgaagttacagaaaaacacacatattttaacacttactccctccgtcccataatataagggattttaagttttttgcttgcaacgtttgaccactcgtcttattcataaaattttgaaattattatttattttatttgtgacttactttattatctacagtactttgagcacaacttttcgttttttatatttgtaaaaaaaattgaataagacgagtggttaaacgtggcaaacaaaaacttaaaatctcttatattgtatgacggagggaatagtaattaagtacatatatttttttggtagttttttttttcacaaaaccacaatatcaatgaatggattcacctgtgagatgacgtggttattttacctaggatgaggacgtggcatcctattaatttcatgagatggctggtaataggatgcatgtcattgtcctatgtggaacaaccaagtcgacgtggcatcctattaatttcatgagatggctggtaataggatgcatgtcattgtcctatgtggaacaaccaagtcatctcacgggtgaatctatttattgatagtgtggttttgtgaaactacactaccaaaatatatgtacttaaatgccaaatgtcaaagcgtgtgtagttttctgcaacttggaccataaaacatgtagttttgtgaaatttactctacagtcatactccctccataaaaaaaccaaactagtactgaacgtgacatattatagtacaataaatctagatatacctatgtctagatttgtagtactaggatatgtcacatccagtattaggttggttttttatacgacggagggagtacgtcttttgaaatgggaaaatctaaggcctttctggttttctggttttagtgttaacgagagactgtataggtaccttaacaatatagtaccagtccatcaagcaactagaaaatatattcctatctgtttcaaataaaaatttatccttaaactactcattcgatacacgatccgattacatggttgtgttcagaattaaatctttataacaagctcacacatgattatgttttgatgaaaaaatacaaattacttttataatattctaaattacttttagatttcactaaattacttcttagacatataaaggtaaatttaataaatcctaaaagtagaagtaacttaaaaaaagaaagttactttgtcacgacattaaaattagatccgttatggaggtaaaaatatgagtatatccagaaaattaatttaatcagtacaaattatgcaattcactaaaaatgataataaaataacaactcacaacattatgattatatgaggtaatttaatcaaatcggaaagtaatttatatatatgataaaagtaacttacatatataataaaagtaatttacaacatagacatttctttcatcaaaacatagtaatgtaaaatcctgttgtaaagatttaattgcaatgaacacaatggtataattggattatatatcgggtataagtaatttaaaataaaaaactgtaaaaagaaaaaaagatatgtataatttggtatactagtaggcaaccagctctaagatgaatctctggtcaagacaatataacttgcggtttcaacgtagtcatgtccttttaaaatatatcaccaaaactatgaattgtttgattccatatcaccattactctccttgtctgtttctctatatatcgccactactgtcaccattcccccgcatgtcagctacacacaaaataataaaaattggtgtggcccatgtggccccacaagcgaggatgaaatgtatgtcccatggttttaattattttttcgggatccaattgccacgtaagcgccacgtcaatatcatgtgagacgaagacttagccaaaggagtcacgtcagttaaaaccgagcacaatactaccgagggaacttgtttgcacggtattgtaagatgggaaatacgctatacctggtttttgcattcaagcatgaatttcagattcagcgacaaattaagagatnnnnnnnnnnnnnnnnnnnnnnnnnnnnnnnnnnnnnnn

SEQ ID NO: 57837 - DNA, 7640 bp, Oryza sativa
  unsure (1)..(7640): unsure at all n locations
cccccccccccacacacacccccttccaccgccgccaccgccgccgaatctagggttcatcggggattcgggatcgatggagaagtacgagaagctggagaaggtgggggaagggacgtacgggaaggtgtacaaggcgcaggacagggcgacggggcagctggtggcgctgaagaagacgaggctggagatggacgaggaggggatcccgcccaccgcgctgcgcgagatctccatcctcaggctgctctcccagtcgctctacgtcgtccgcctcctctccgtcgagcaggccaccaagaacggcaagcccgtcctctacctcgtcttcgagttcctcgacaccgacctcaagaagttcgtcgacgcctaccgcaagggccccaaccctcgccccctccccaccaacgtcatcaaggtacacctcttgcctgattatcccgtgtcttctccgcttctgggttggttgcctaggtgaaaatcggttgcagcaaccatgttagtgaaaatgaatgaaacactagatgtatgagttttcaaatgacattattgatttttcagtttttttttcactattcagaggcaaatactgggccatggaagtgtggatcaaattaaatacgaaatggaaaaaaaaattaacaatccttatagttcctatgtctctctttttttatatatataatctctgattgttggaggtttttcctttgattattgtgagaccttttacaaacaaagatagatgatgcacgaccgactaatcggttagtggtttcatattctgtcaagttgcacattgctctaattgcatagaattcacaattgttgcacgttaattatgcatacaacaacagtgatccaagttagttctctacaaattttatatggcaatgaaaagaaatgacttcttttttttttcaattccctgcagagcttcttgtatcagttatgcaaaggagtcgcacattgccatggccatggtgtccttcaccggttggactctgttctctccctgtgatttatgttgctgggcttatcagccccatacagcattgcagttgttgataacatggtttatacttattcctgctcaattttgtagtgatttaaagccacaaaacctgttggtcgacaaggaaaaggggatattgaaaattgctgatcttgggctaggtagggcgttcactgttcctatgaaaagctacacacatgaggtaatgtttacacatctcatctgggctaatttctgaacatgctctagcaatttccttatatgtctgttttgtgttgcagattgtgactctttggtacagagctcctgaagttttgcttggatcaacacattactcaaccggtgttgacatttggtccgttggttgcatcttcggtatgctccttttgatctttgttacggctttgtgggggcacttcattcttatatttgaaaaaccaaaagcacaacctggatacaacttttaaacaaacgcactagcagattcatggtcacctgtttatatcaacctttaaacaaaggagaggtagatgtgcaccagcagttctaaagtttttcgtgtatgtgttatcaaggattctttagttttgaatgtgtgtgtatatttgagctccaatttttcatcgctgtcatgatctttgaatttctggctgactaagcagcatatatcatacttttgcttcaagtttttcccttgctttcagtacaaaaaacatactgcctcctcattttgattctcgtactgttctatacagctgaaatggtcagaagacaagctctttttccaggtgactctgagttgcaacagttgcttcacattttcaggtctttcttccttctgcctttcatgattagcaagaagtgcagttatcataatatgagttacattgcttatctgctaagacaatggtttaataatttgataatcggtagttattgctgtagatgatgattttttttcataaatccatgtttgacatagtctgaacatatagctgtgtgatgaaaaattgccatgctagaatttcataaactactttctgtatagtgtgtgatagtttgcctcagcctgtataccttatggtaatttattcagggagtattatgcattaagccattgactaaaaccgacttcttaataggttgttgggaactcctactgaggagcagtggcctggagtaactgatttgagggactggcatgagtttccacagtggaagccacagattttagaacgtcaagtcccatcattggagcctgaaggagttgaccttttatcggtaagaaaactgatctatactggttttccattttgtcactattcgaaattatttaggctgtaagataatttgaagttctccctaatttaatagcttcaaaggaatcttttatgtatgattttggttggttttaaattgtgcccaacttctcttgatttgctaaattgtgttcaatttttcaacaagatgtgaggtgataatattgtgaataatttcttgcagaaaatgctccagtataacccagcaaatcggatctcagcaaaggctgctatggaacacccctacttcgacagcctcgacaagtcccagttctagtttgtaccatgtgattgacgaagtccatgttctgttgtgtcatttgattataaacgtgttgctgttagcagcaaggaaattcgttttgcctacttagcaccctactttgtgatccaacaaggaaatccgtttgccatctaggcaacttgaatacagtttgaatgtaaaatgggtttgtttctatgctgtatggcatatgtattatggacaagaaggttgcaatatatttgcctgtttctttgacgaagtattgccaagcattagtttccacctttacacttgcaatgattttattagtcgttgtttagtagattatcaaattcattcatgtgctctgaggggcgatttgcttatatgttaaaaatcttttttgtgctctaaaaagatgaagccatggtccaatatttgtcaccgtaattagctgggatgctgaaaatgatgaagatgattgattaagtttgaaactcatgaaaataaagattaagttggtgcacataaagcgagaaaactattagtacatgattaattaagttttaattattataaacttaacaaattggtatatttgatattttaaagcaactttcatatagaaattttttcacaaaacgcaccgtttagtagtttgaagagcgtgcttatggaaatcgaggtaaaatcttaatcttgagaaaaaaaacatcaattgactttcaattcaactttagtgagatcaagcatatactattagtttacgttttttgagcgtgtactacttttccgttccaaaatatagatattttttaggttaacacggttattaagaaattagtatgtgataattattaaagaaaatgtgtgattaattgaaaagagaacgtatgtgaaagagaatagatgtgattagttgagaggaagacgtaggaaaaaaaattgcttcattttaagacaagacactgtattataaataaattttttttggataaactattgtgctagaaataataccgaggtaataggaaactcatttgcgagtgagtatgacattatgtgtcatgcacacaggtcgtccactcgtccaacttggtcaaggaaaatcaaatccttcgtcaggactcaggacccacctgtcagtgacggcgcgcgcccgcgagtcacggcgtcggtccgccacttctcgcgtgtgtgccggggcccgactataaagtggccccgtggtcccagtcgacttggagtcgaagccttctcagaatcacatccagaacattctagatccttccagaagcacgcgagagaggggaggagagagagagcagtgggggagaagagaaccatggagagcgcggggagcgggtccggccacgcggcgacgccggtgaggtacgtcgccctcccgccaccgcggggcgtccgcgacggcggcggctggaacgtcctcgtgccggagtccatggcctccgagtggacggtggcgcacgtccgcggggtggttcgggtggcgtcgagaggcggcggcgccccggaggtttccgtcgacatggccgcgctgcaggccgcgctgaacggccgccgccgcggcgacgacgaccccgacctccatctccgcccggagcggggcgggggccgggacgcgctgacgccggtgaggtacgtggccctcctgctaccacgaggcgtccgtgacggcggctggaacatcctcgtgccggaggccatggcctccgagtggacggtggtgcacgtccccgcggcagctggcgtggttcgggtggcgtcgagaggtggcggcgcaccggaggtgtccgttaacatggccgcgctgcaggccgcgctgaacggtccccgccgcggcgatgaccccgaccacctccatctccgctcgggccacagcggtgtgggaggaggtgttgcggagcggggcggcggtggcggcgccggcgggccgtgctacgtccctgtggtgttcgtcctcaacaccagcaaggaggccgagaaaaaggaggtaaagtattctctctgccctttccgtgccatttgcttcacgaaacatggagcggatgccgcagcagcagcgccgcggcgaatttgcggcggtggtaccgtggtagcggtagaactccatagggttgtcgccttgtcggatactcggatctcgcttgctggggaagggcaatgctccaggcgagcagcggcccaaagtttggtttgccaaaattatcgatgccgtgatgggatgagttgttgattgttgtcagttctagtggtgtgctagtttttccgatgatgtgtcgctgtcgctgtagtatttcgtcgccgcatggatcgttccatgtacatgtgtggattcattgttttacttcaccttacttgatataaaatagtagagaaatgcacatagttatttttagtcaattatttttgttgacgtacaggttgattcagctgaaggttattgaaaaataatgttctgattgcttagtaattgaacttgcgtgtcactactcaccagtatccacatatcgttaaattcattttacctaatgcaaaattttgtggagaacacctcagtatattatacttcagttagctttatcactgtgaatctgtgtgagggttcctaatgctttgtgtatgcgtgtggtactggtagactggtagtacctgaagctgttggattggacgtggacatgttataaaagtaactgtgctaagctggtgcttatgcagtttcaataaatttggactaggacattgatgtgcgtatctatgcattgttcacctaaagaaatgaacatatataagttacctattattattgattccgttattgcctacgtatgttattgtttgttttgtctaagtacactggataataaaacttcacataagcatgctaattatgtatgttattgtttatataacttgtacgttttgtgggcactgaaggtagagtctcaactgtgattctaaagaaacaatggatggctaattattagtttgttttactcaagtaaataggtgagcttaattagatatcgttgttgtgtgattagcaactttgattctttgaacgactgtgcatgctatctttgcttggtgacacgcagatgcaactgtggatagatcgagtagttggaacacagacatgcatctgtaatcagttaactcttcatcctttaacctctaacttctgaagttgtcttctgccctctagctgtgttcatgtttgcgttacagtaataaaatggtgaactgacagtgatcacaacagctattctgttcagccgttttgtttactgagtgttgaagtgtagtctgatgtacactatggcattcattggatgtctctttttttagtacttttgaaaactatgccacaagcccacaactaaatacttccttttgtttctgtgctttcaaccagcaccaagcacgcatgatcagtctgctcatgttgtcaacctttgctgtctacctcctctacgctatgcagcacatctccaaggatacgttcctcacagtggaattgcttcagtttgtgggccacattgttatgtgggctgtggtgagttattgtctcacttctaatcattgacccttaatttttgtcattgtactatcctactaagttgcaccaacaattcacaacaggcctcaagagttgctcgaagcacaaacagaagtgagcctcgtcttgtgccaaggtaactcaatcacatcatcttatattcttatgggtatttcaatttgttgctgctccgtgctcctccaagtagctctatttagccccttgacgctatattcttacccagcctggcattacagttctagtcaaaatgtgttctttctgaactgtgtaatatatccgtccttatgtctggtcacttactcactcactcacttgatgttgtatcttccaggtcttttattactgtgaccaagaagaacgcgtgagagagacaatcagtgtgctctctagtctctaccccttcgtcagatgttcaagatgttgggagtttttgctacctcgaggcgatactgtcctctgatgtcgcttctattcgttggtttctacttagtagttagattggcaatggaagttgttctgctctcttacccatatctgtgaattgtggatgtcttaccgctgcatatgtagcaatacggcagaaatgatcacgagtttgcgacagtttgcttcacatttgcatgagtatattagaggattagtactttcaaggtgttgccggtagtgttggcgttctcatgaactcatgcttggatctacatgaaattttgatatgcctgcattgttcctaaactgattcctgcaagccgctgctcccataaggccgtaactcgcttctagttgcaatacccgcatatattttagattatatattatcttagtttgcatgtttatgtattaacccattaactttgactaaaatctgcgtctgaaatgttgctgcgaaatggctgtcgtttaaattagtccatgaagagctaccaccaagtgagattctctcgctttggcttacttagtaaaccaatttgagatagatttggagcatccgaggcagtaatatgtgaaatttgagatagatttggaggcggtgtgcattgttagctattacaaaccagttgtaaagactcttaaaactggagcatctaagacaggagtgtgtgaaaaaaaaattgattgaagagtttttctcatgctggactgtaaagactcttaaaactggaaaatctgagacaggaatgtgagattaaaaaaatttgattgaagagtttttctcacgctggacggtcaacaaaaatgtgtgaatacttttgattgaatagttttgactcatgctggacgatgaacattagttaattaagagttgttggttcgtatactgccaaaatctcttcatatagaactatatgtcaaaatctatcaaaacaagcatctatatgcttcgcaatatcatcaacataatggatgagcaagcaagcannnnnnnnnnnnnnnnnnnnnnnnnnnnnnnnnnnnnnnnnnnnn

SEQ ID NO: 57838 - DNA, 1026 bp, Oryza sativa
  unsure (1)..(1026): unsure at all n locations
attcctgcaagccgctgctcccataaggccgtaactcgcttctagttgcaatacccgcatatattttagattatatattatcttagtttgcatgtttatgtattaacccattaactttgactaaaatctgcgtctgaaatgttgctgcgaaatggctgtcgtttaaattagtccatgaagagctaccaccaagtgagattctctcgctttggcttacttagtaaaccaatttgagatagatttggagcatccgaggcagtaatatgtgaaatttgagatagatttggaggcggtgtgcattgttagctattacaaaccagttgtaaagactcttaaaactggagcatctaagacaggagtgtgtgaaaaaaaaattgattgaagagtttttctcatgctggactgtaaagactcttaaaactggaaaatctgagacaggaatgtgagattaaaaaaatttgattgaagagtttttctcacgctggacggtcaacaaaaatgtgtgaatacttttgattgaatagttttgactcatgctggacgatgaacattagttaattaagagttgttggttcgtatactgccaaaatctcttcatatagaactatatgtcaaaatctatcaaaacaagcatctatatgcttcgcaatatcatcaacataatggatgagcaagcaagcaatcaatctcaaaccaaatgaatgcctcaacaagcgatcaaacctcatctagtgtgtaaagcgcccaagggaactccagtttaggacaatgcaggcaagaagacctgaagattgactgcccgttgctaaaaaggaaaaagtaacataaaacactgacaagtgaagagccaggcagaacacattttgatcaatatccaaacggcagcttctcacataaataagataaccgatagctccaggttgagaaccaaaaaccgaaagaaataggttctttgagcggagttnnnnnnnnnnnnnnnnnnnnnnnnnnnnnnnnnnnnnnnnnnnnnnnnnnnnnnnnnnnnnn

SEQ ID NO: 57839 - DNA, 1612 bp, Oryza sativa
  unsure (1)..(1612): unsure at all n locations
nnnnnnnnnnnnnnnnnnnnnnnnnnnnnnnnnnnnnnnnnnnnnnnnnnnnnnnnnnnnnntaacttataaaactggtgtgaggtccaagatagtacccagttttagctgatgcaacgagtgagccacatttgtcatcggccaactcttgttcttccccccccccactcactctcttccctctcttccacatctctcatactctcacctagcctcgagcgacggcgagaagggtggataccgacttggagagggccaaccaacaaggtggactaacgggtgagcaacgagtagcaaggagagggacgaccgccgacttagagtggggcagtgggtgcggcaaactagaaggacaatggtcttcaaactagaagggcagggagcagcattcttcttcctctcttccctatcttccccatctatcaccaggcctccgagcggcggggataagggcaatcgctgacaagccacttgttttgtatggcgcggcaaaaggcaccactaatggatagcgtcgcataggggggggggttggggacaaccccgcgccggggcagcttcaagttggtcatcggcggctatcgtgctcgcaatgcagcccaccctgatcgcctccacctcgtgaccatggcctcctgagtcccgaggacacgctcgtcatcgtctagcacactgcatacctccactagtagtcaacgtgctcctgccagctcatcctcctcgacatcatagaatttcagccccccgaggtgggccgcctccttggaaaccttccacggtcaagctcctgcgctcatgttgaccaccagtgtctccctgtcgctcgccgccccccctcctggcttgaagaggattggggaagagaggggagagtagggagagagaagaaacaagagtgggttgttgacatgtgagacccactcgccacgtgagttaagattgggcactatattaccctaggacctcaggtacacctattttgcaagtttagagacacgctatatgtatctagtatcacggtgtagtgatgtaattcaaacttgacgtatggagatctaaactgaacttattccctcgtagaatgtagaattggatgggctaatgactttggcagtcaaaaactcgttgaattgatcacctaccgtgcatttgcatttggtttaagggatgggatggttggcttggatcgagtatatttcttagcgtgtctggtttaaattgttaaatacacagttttgccataaataaattgctaaatatattatagnnnnnnnnnnnnnnnnnnnnnnnnnnnnnnnnnnnnnnnnnnnnnnnnnnnnnnnnnnnnnngaagtggtgtttttagttgcggacgtgtgagtaaacttccttgggagaggaacaacaactcaaaatggttgctagtttcgctaagggaaaaatttcatcaatagtctgataacaaatttagcgacctatctatagtttcgcaacagtttggtttaaaacaaaatctacttaaaaaaaactcaaatagcacaatgtttgccccctaggattcagaaaccagcacctctagcccagtggatggatgatggactgggagcagcagcagcaacaaccacccaagagc

SEQ ID NO: 57840 - DNA, 1091 bp, Oryza sativa
  unsure (1)..(1091): unsure at all n locations
nnnnnnnnnnnnnnnnnnnnnnnnnnnnnnnnnnnnnnnnnnnnnnnnnnnnnnnnnnnnnnnncgcagagtcaccatggaagtactcggtgatctccttcacaagtgatagcgcaacgctctcctgagcctgaaccctgatgatgtcgtcatcagccctcttcaagaacttctgcattgaatcatggaacctccatgcatcttccctggacttgacttcttcattcaaccgcaacacctcagtgatcttctctattcctccagcaagtttcgagacatagctgcttagcacgtcggagtccatggcagctgccttcttgacattgctgagctcgtttccgaggccagccactacctggaggccaagctttttgcactcgagctcgtcccgtaaagggtttgcctgagttcgtggagttgattggttgctagcagagaggtgggagccctccgttcggataatctcctgcacgacaaaatgcaaaagtgtagtcttgccatcagtgcctttgacatcaaccaatttgagtagagtatcaagcttgaacgcgtgtgcatccccgcgatttgttccaacattcatcctgttcccagtcttcaggacagcttcaagtagcttcagaaacagcctgctgtttctaagctcgtcacaagcagtctgttaaaaaaagtttcatgtacttagttataggttagatgtcaatataagtataagtatgaaaggccacttggaaacgatgattctcacatgtagggtctcaaagtacttggcatgggttgtttcctttatctgttagtgagcgatgtataaccaatggtagtctgtgctatagcatatgggattatgtagagcagccataagaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57841 - DNA, 762 bp, Oryza sativa
caagcttttgcaatttgacaaaagcaacagacctgcatattatgggacttggaggaagaaaaggttagtatttaatttgaataccatgttcttaatactttccaacctcctgttttgaatgccatgtttcttaatgctttccattctgtaatcctttccagtgctgttgttggcccaagatgtccacttaagatggatcctgatcttgactatgaggttgatagtgatgatgaatgggaagaggtaattggtgattttgctcctttattctctttctttctggcaagaggtactcatgttgtttggcgcacaggaggatcctggtgagagcctttccgactgcgagaaggacaatgatgaagttatggaggaggattccaagatcacagatgaagagagcgaagatagcttttttgtccccgatggttacctctcggataatgaggcaagtcattaataagtgaattctttaccagtttacgatataaatagaacttttaagtttgtctttttgtgtaaatgtacatctctaagatgcttccatttagttactgtaactaacaatccgttctgttgtgagagtggtgtgctatttgtttctctgtacctgctgaaaggatgatagaaatgatacttgtgcatacttaaatcttcgttgaatttataagaaaataaaattgtggaacaagacaaatccttgtatgaatatgtatgctgatatgagctacgtcttctactttttccgtatatgaatatgtatga

SEQ ID NO: 57842 - DNA, 2405 bp, Oryza sativa
  unsure (1)..(2405): unsure at all n locations
nnnnnnnnnnnnnnnnnnnnnnnnnnnnnnnnnnnnnnnnnnnnnnnnnnnnnnnnnnnnnncggataatgaggcatggcattgataagtgaatggtttaccagtttacgatataaatagaacttttaagtttgtctttttgtgtaaatgtgcagtctctaagatgcttccatttagttactgtaactaacaatccgttctgttgtgagagtggtgtgctattggtgtctctgtacctgctgaaaggatgatagaaatgatacttgtgcatacttaaatcttcgttgaatttataagaaaataaaattgtggaacaagacaaatccttgtatgaatatgtatgctgatatgagctacgtcttctactttttccgtatatgaatatgtatgagttctaggttgtgatacactttcagttctgttctacatacatgcgagatcaatagttgtttcattgactaaggccctatttggaaaggatgggataaaatcctaaggactaggttcaaatcaattcaacatttggagttcctttattgcaggggattcagattgaaagcctcttggacgacaaggatgaagccagtagctcaccaccagaccagtgtgcagaagtagaggaatttagggctctactacgccagcaaaaagtactaaacactttgactgagcaggctctccgcaagagccaacctctagtgatatcaaacttaactcatgaaaaagctgaattattgactgccggagacctcaagggaacttctaagattgagcagctctgcctacaagttctttcaatgcgcatctgtcctggaggtgctactattgatttaccggttattgatagttcatctgcaaatgctgaggagaccaatcagttgaatgtgaagagtagtcctgctgctgcttcagctataccagatacagacctggcagaaattgtaagtaatcacttagtattcaatggtaatgtgttgattggatatgccattttcttatacatattgttcaattccaatgcaggttaaggtgataggatcatgccgtgatggtatcaataagctggttgagtcactgcatcagaaattcccgaatgtgtcaaagtcacaactgaaaaataaagtgagggagatttctgaatttgttgataatcgttggcaggtaagatactttcacattcaagaacgccataccaacaatgtttgcttttgtgctagtgttatttacagcagcgcattatgagagatgaaatatacttggaatgctctattaagttattttttcttatctctgcaggtcaagaaagaggttcttagcaagctaggcttaagttcatctcctggtactgtacctcatattcatttgtcagtaggaatcttgcccccattgtcatcttctgaaacccttctaacaataagtcttgtttttttcagcgagttccaaaaagcccaagagcatagcgacatacttctccaagcggtgtctacctccggaggaggccatcctggcttcacctgagctgcgcctgaagtcgaaaaccactcaaaacgtcaatggtgacactgatattcctcgaatcaatctgctcccctcgtcccagtaggatcctggaagcatcttcagtacacccagattagcagatacctgagcaacaatggtctgcagcagcaaggttactgcattgcaactccattttgcaacatttccctgacgaaagagctagaaatgtgttctataacttgtgatggatgctctttttgttgcgttcgccctctgccgtttgacatgtatttatctggcagtgatggtgattaaatgtctgtcaaactactgaatcatctgggttttttttgttactacaacttacaaatggattccaagcaagaatgtgaatggttgaggagcagcagcatagcatcatagcaaacgctttaaagcaatatatatttgctttgcatcttagtacaaaagaattcgagtacacatgaaaatatcactagtacaaaagaatcatgagagtaattctactaataatctaaacaacacacgaagaatggactcttcggtcgcaccaatggcggagtggagtggaggaggtgatgagggcttcagagtttcagacatggtaggaggcggcggcccagttcttgttgtcgtagtcgccggcgccgtcgtcgtcgtcgaggcggaaggagaaggcgagggcgagcgcggcccactcgaggacaaagatggcggtgccgaggccgccgaccatcttgaggatgacggcggcgtcgtcttcgcggacgtaggactggagctcggcgaggaagtcggaggtgcgggtgaaggcgagcagcgcgacggcgccctggaagatggcggtgagggccgcgcccgcggtgtgggcgttgtgccactgc

SEQ ID NO: 57843 - DNA, 8841 bp, Oryza sativa
  unsure (1)..(8841): unsure at all n locations
ctctttctttctttcattcttttttttttttgcagcactgtatttctgtatgtgtcctgaattcctgatgcaaatgtattaggcatactctccggcctcaattctcccaacgtcaagtatttgtcatcacagttcatttgatgttgatgttttagctatcccagcgccaaaaatttttcactcgagggagtaatttagttcattgattaataaatttcaagtaaattttacaaaactatataattaaaaatgggtatcataaatcaacaaatttagcgtgaaatttatcacaaagctataaatttaaaacatcatatcacaactacatatttaataataaagttgtcaaacaactgcagattttagagtctatatccatagcactattgagattatcaaagttatagttttgtgataaaaccaatgttaaatctatatgtttctattatgattccttaaatatatagttttgtgataaattttcttatatacactttcttaaatctgtagtttcttaattctgtaaattgtgatagattgttcaaagggactatctaaaattctggcgacagattttttagaaaaaaactttcaaatgtaattacagtgtaagttatatgtaattacagcgtaatttctatgtaattacagtttaagtaatgtgtaatttttgttttaattcaagtttggataactgctcacttggttgagtcgtgatgcgtgcgaccagttggtcctaggatcgaatccccgttcttgcagttttctgtgttttttatctctggcagaccagaaatcgaaagatatccatagaaaaaggttgttcaaatatctatagatttgtaaaatttaatctacgatggtaaaaaatgcttctgatgtggagcttgtcagaacaacgctatggatcaatctacagactacagtacagtactgtctggaccatgggccccacggatcaactccacatagaagtgaaacaacattaacatcatcttgtgctaacatgtgttcattattgttgaacgctgcttataaaaatttacagtgccggttcatcaccacggctgctcacagtagctcagatcaatcaactacatgagaaaacatcaaatttttccacagaatttactgggcgtgtagctactggctaacgactttcactcagctgcacagattgggatcacattggccactgaaacctgaaactctcacgcttcagagaccaaactgtctgcctcggcgtcagacggctgcgactcgtgcttcgcggcggcctggagaacccggtcttggaccgccgtcgtggagggggaagtcgccaagccaatcttgcttggctccagcttcttggccgcccacgagaacgcctccgcgcctactcttaacggggaaagcagcagtctaggcaatcacaaggagaggagtaaggggaacttgtaaatttgcaatggttttttttttttgtcatgtgttggaaaaatggcaggtttcgagcacctgagctgtaaatttgtactacagaaaagaagcacaccacgagaacggatgatactaggatgacttactttagatcttgctccagatcctctgaaccctcgtacgtagagaatcgcagatagatagtctacaagagtagaagaatgtcatgtaaactgtgttgtttccgcttgccatgatatttggatcggagtgagtagtaatataaaaggcacaaagctgtattgctttactttccaggcaattgaacagaagaatatatgatatgtaccgacagtttgaaaatggaaaatacttaccagaccaaggcttagaacacctatgtattgcagagtcgtttcccattctgcagttgtttatcaatatcaattaatcgcatattcaaaatgaatacaagtttgaaacggttgaattatagctgcttttcctaactaggttataaaagttcaatagcacatacccatgatgggcatccagtcaaaaagatcaattatgcacatttaggtaaaatgacaaataaaaacaatcatgactcctagtaatccagtaagcttcccagggtatgaattattcaaaatggtgtttaaagcgacctgcaaacactccactaagaaatgccttctcaaattccctaaaatatcatacttgtgaatgcagcatcgctttctgttgataaactgacactgagattaaaaatttactattttcaacagcgttctgttgctgtttttctgtaacttgtactcttccaaatcttaatgaaattactcggcctccttcggccagcccgcccaaaaaaaagagagagattaaaaacctgtcctctttttgcataactgtgaatcctatagaccattaggagctccaaagagcaggacaaaataaaaaagagagagaatatgaaagagcccttatctctgacaagagaacatactgttctgaaaatcatatgacttgcaatatatttaatgtatagcaaagcaatgcaataaccacacttaatgctttcctacccctcttacctagcaaagcgtacgctgctgctgagaggccctgcacaaaagaaccaaatttagaaaggaagaaatattgcacgtaaggcttcaaatgcacaaagggagaaatgtcgtgattcagtacaacttttaaaagaaccattcttaaaaaaatataatggaaccaataatcaaagagaaacaggacagtgtgccgactgccaacagaggcaaaagaaagtaaaaggagaccaattgatgtttatgtaccaggagagatccaaggacaagtgttggagtgggctttatgtcttcaaggatttcctctgcgtcctgcatacattcaaaacaatattgtgagttttcgacgttaatagtacatagtgataacaaaaagtgctacctctacgtagtattcaacgctgatacatacaaatttttggaaaggaacaaagaaaaattgtgaccaaaaccttatacgcttcttttcattcaaacatgaggtttttgtctgaatttttacctcatttattactgttaatgcggtctcaggtttcaattctttcactcgaaggttctttgcccaagattggaaaccacctttaacaaggtaaggtcgctgccatcaaaacagtcaaatttaggcaggactcggatcagtgaaaatgaaatatttttgggagaaactgcattggaacttacctgcacaccaagcttcttcagtaacctagcaatggcctttgatcggctcccattagcatccataattataacctttgaatcaccctataaaagaagattgaaaacatacttcacttattttgaagaaatcttagactgaagatatcaaatccaagttcaggcaaacatcatactttgaccaacttcaagttgcggatgataactgcgagcaacgcatcatcaacatctcttccacttttaagtagcctctttactgaacctttaatctaaagaaaaatatgtgaacttaatatcagtaagcaaaatcagttttgtactctcacccgtttgaaattgaaatggctgactgctgctagagttgcataagtttacttctcagttttctttttctagaatgaaaacaactcctaacattattccaacaaaaagaactcattgcatacacttcaatcctcacggatatacataaaaaattggaactgagttcaggttaagtagacatataaactgtccagcaatcaatggctggtagcacttcagatctccaagttcaaacaaagacacacctcaggtgaagcagcagttgcatatttagatctagctgcacggcgtagatccggaattccatctttcactctcaagtcctacaaaaaggattccatgataagctgttacagttgcttttgaaatactaatgatgaatcaaacacttgaagttcaggtacatctgcatgtaagcttatattctcatgctctagaggaaacgcatcaaagagttgtagtgctacagtactaaaaatgtttgtactgaatggcttggcaggaacaaactgttctacattggcaaaggcatgtaggtggctaacaaacaatattatcttttctacggtttgcagaatatatcatggaccggatataaaagatgaaaacggacatcaaagaaagaataggccagtgagatttacaatctcttgcctcagaccgaacatcaataagtacggctttgtcatcatttctcaacagctctagtgtggattcgggtgacaagtctccggaatagccaccgtatgcgaagagccagtaagttaacctgcaacatagcagggattaagaagaagatttggtatgaacatgtcagctataaatggcaaagagaaaatctcatttacccgattgtggttgaacctccaagcagaactgccaattgaacaataggatcacttgggtccaaaccaacattcttttcaataccttcgacgactacatatacctgaatcatagcaggcaacaacagattgagcaatttcagtaaaatgctaactggcataccaagaacaagagctgaattcttgccactgatttacctgttgaagggcacctccaatcggtttcagaactagactagctttctcctcggaggagttcagcaaatctttcacattcggtggcaacgacgacttggttgatccatagtaatatccaatggatgttgctgcgctgcccagtgaatcctcggcagcaacaatagccttcctaaggacatcgacggcgacggtgccagctccggccaccttgtcctgcaacgcgccggaggcgtccgtcaccccaccggcggcctgcttcttggtggcgtccaccgacgccgtgaggccaccaaccgcgccgtcgacggacttcctccaggcgctgagcgactggtacgccgacagccgcagcttgtcgtacccctcggtgagcgcgtcctccgcctggaagatcttcttcccgagggagtcgatgagcctcgcgaaggcggcctcggcgtcggacgcgtcggccgggaacgtggtgggcaccggcgcgtcaagcagggcgcgctccgcggcgtcggtgacggccgcgtcggccgtggtggcggcgaggtcggagacggccgtcagcgtcgccggctcgaccccgccgcagcagagcgcgtcacctgctgcggtggcgtcggcgctgggcacctccgcggcggcgaggccccgcacgatgtcgtcgggtgacgcggagtagggggagaggatggatgagtccgcgagcagcgggcggtcgggcaccggccgcgccacgagcggatcggcgtaggacctgagcgcgctcacctccaccaccctccctcgtagcgccggcgcgccgacgacatgggccaccgacgacgtcacctgccaaagccaaccaaacagaagcattagcgactaccagaacgacaacggcggcggcggcggaggcggcgcgcggtggtggtttgttccgtaccgggcagagcggggagcaggtgggcgcggcggagcagacggggagcagcatggcggcgggcgggcggggtgtcagcggcagcggcagcggcatcagcagctcgctgctgcctgcctgccacccgtttggttggcgcgtgtcgtcgcggcgcggcgcggcgaggcgtggcgtggcgtgttgtgtggaagaggcggtttgttgatccgggacgagtggagacggtgcgacggcggatttggtgatcgcggaggcggggattgcgcggattggtgctcgtggattcttcggtttcttccccgcgcgcgtgggaccccggcgcgtcgcttgccccgcgcggccgcgccacatgttcgacgcctcgttgcccccggtcgttttcaccgctgtttgctttgctagctccttggtcgttgttgctgctgctgctcacagtccatcatccatccactgggctacgagtgctggtttctgaatcctaggggggcaaacattttgctatttgagttttttttaagtagattttgttttaaaccaaactgttgcgaaactatagatacgtcgctaaatttgttatcagactattgatgaaaattttcccttagcgaaactagcaaccattttgagttgttgttcctctcccaaggaagtttactcacacgtccgcaactaaaaacaccacttcnnnnnnnnnnnnnnnnnnnnnnnnnnnnnnnnnnnnnnnnnnnnnnnnnnnnnnnnnnnnnnctataatatatttagcaatttatttatggcaaaactgtgtatttaacaatttaaaccagacacgctaagaaatatactcgatccaagccaaccatcccatcccttaaaccaaatgcaaatgcacggtaggtgatcaattcaacgagtttttgactgccaaagtcattagcccatccaattctacattctacgagggaataagttcagtttagatctccatacgtcaagtttgaattacatcactacaccgtgatactagatacatatagcgtgtctctaaacttgcaaaataggtgtacctgaggtcctagggtaatatagtgcccaatcttaactcacgtggcgagtgggtctcacatgtcaacaacccactcttgtttcttctctctccctcctctcccctctcttccccaatcctcttcaagccaggagggggggcggcgagcgacagggagacactggtggtcaacatgagcgcaggagcttgaccgtggaaggtttccaaggaggcggcccacctcggggggctgaaattctatgatgtcgaggaggatgagctggcaggagcacgttgactactagtggaggtatgcagtgtgctagacgatgacgagcgtgtcctcgggactcaggaggccatggtcacgaggtggaggcgatcagggtgggctgcattgcgagcacgatagccgccgatgaccaacctgaagctgccccggcgcggggttgtccccaacccccccccctatgcgacgctatccattagtggtgccttttgccgcgccatacaaaacaagtggcttgtcagcgattgcccttatccccgccgctcggaggcctggtgatagatggggaagatagggaagagaggaagaagaatgctgctccctgcccttctagtttgaagaccattgtccttctagtttgccgcacccactgccccactctaagtcggcggtcgtccctctccttgctactcgttgctcacccgttagtccaccttgttggttggccctctccaagtcggtatccacccttctcgccgtcgctcgaggctaggtgagagtatgagagatgtggaagagagggaagagagtgagtggggggggggaagaacaagagttggccgatgacaaatgtggctcactcgttgcatcagctaaaactgggtactatcttggacctcacaccagttttataagttaaaagatgagcgttatatttggtattatggtaaaaaaacataattaaaactcggcgtcgaagatacgagagatgtaaagtgaacttattccttctataaaatgaatttcgttcttctctacgccaatcccctgcaggccatccgttcgtagaagatgggactaatgctggcctgcaaatttatttgggctggtaacgaggaaacatttcctttcccagcctcacagactgaggcccatcaagccgcggagagcaacccctcaagacgatctgagccgtccgatccatctcccgcaccgcatccgtccgcccgatgcgctcccgcgactagggtttcttcgagaggaaggataaaagggctcgtgggcagccgccgctataaaccctaaccattccttctcccaccttctcccttctcctcgctcctccccctccgccgccgccgcagcggagcagcaacagcaggcgagcgacatggtaagatcctctgctccatcctctctacctcgttacggcccgtgctcgaatcggtcgctgcgtgctgtgctgtgctgtttcgttctcgattcgccgcgttgcggtttggttcgtgaaggttttatgtggtggtagctccgtgggtgattggtagagcggctgcgaggttttttgcgtttgtggcgatggatatgatgctgggttcttgggatccatttcgatccggtagggatctatggcgtcatatagatttcttgcttaaacgacgatgtgttgtgccatctcggtcggcgtgcttcccatttgatggttgctagcatctcttctctttgcggtaacattctgcagtagttcgtgacatccatattgattgttttgttcagtagatccacttaggtgtattgccacatccctgtagtggaagtatactagatgtcacaaacactatctagttgctacaaccagcacaaatttcacatgcttgtctagttctatcagttatactcctacgcatcagagatttatgtgttttggatattggattttagatggttcagtcgtgtagttgctgcagtacatttgctatcctaactgactgcatgatgataaaactgcagtgttttgatatgcgtttaggaagttctcaaatttaagtctagttcacatgtttgcttgccttcagtttttatgctgttgtattaatgtgataatgtctctccagggagggtttgtcaagacccagaagacccatgcctacttcaagcgattccaagtcaagttcaagagacggaggcgtaagttcaatataatcctttcatgtggctcatgcattctgtgcttgtaatatagctaggttttgatgtacttaatctcatttgttattgtttgcagagggcaagactgactacagggccaggattaggctccccaaccaagataagaa

SEQ ID NO: 57844 - DNA, 860 bp, Oryza sativa
  unsure (1)..(860): unsure at all n locations
taggggggcaaacattttgctatttgagttttttttaagtagattttgttttaaaccaaactgttgcgaaactatagatacgtcgctaaatttgttatcagactattgatgaaaattttcccttagcgaaactagcaaccattttgagttgttgttcctctcccaaggaagtttactcacacgtccgcaactaaaaacaccacttcnnnnnnnnnnnnnnnnnnnnnnnnnnnnnnnnnnnnnnnnnnnnnnnnnnnnnnnnnnnnnnctataatatatttagcaatttatttatggcaaaactgtgtatttaacaatttaaaccagacacgctaagaaatatactcgatccaagccaaccatcccatcccttaaaccaaatgcaaatgcacggtaggtgatcaattcaacgagtttttgactgccaaagtcattagcccatccaattctacattctacgagggaataagttcagtttagatctccatacgtcaagtttgaattacatcactacaccgtgatactagatacatatagcgtgtctctaaacttgcaaaataggtgtacctgaggtcctagggtaatatagtgcccaatcttaactcacgtggcgagtgggtctcacatgtcaacaacccactcttgtttcttctctctccctcctctcccctctcttccccaatcctcttcaagccaggagggggggcggcgagcgacagggagacactggtggtcaacatgagcgcaggagcttgaccgtggaaggtttccaaggaggcggcccacctcggggggctgaaattctatgatgtcgaggaggatgagctggcaggagcacgttgactactagtggaggtatg

SEQ ID NO: 57845 - DNA, 792 bp, Oryza sativa
tcaacttgtacatcaaggaaataccttgagacttagtcggttacgactgtattttatctgtatctgcatattccgttagggatatagattatcttttgtaacacggactctttcccatatataaggggggtccgggtgcctctaggggcatgtgttgattatccccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacagttggcgcgccaggtaggggtccgtcaagcttttcgccgatcagtgcaatgggttctgtctccggcatcgacgacctcgtcttcccacccgggcagacgtttcggttcggcagcctcgacttcgtcaccaacaacttcggcaagatctctctccttgactcggagtcagaccagtcgggagagaaccggatttcagtcccgtttggactcccaaacgcggctgaaagttacttcaagaccgtctcaatcgagttggcttcaaaccactcgggcgggatcgcatcttctccaatgtcaccagatcaagatgatgaggcttacccaccgatcctgatgaagctccccgacgatttggcggccgtctccatcacgacagcgtctccatcccgtaggcctagacggaagtcggcttcaacaccgatttcgcctagcttcagggaagtcggcgttatcctc

SEQ ID NO: 57846 - DNA, 823 bp, Oryza sativa
agtttcgcttgggatgcgttgcgcagaacgaacaaaccatcttctgaaatccaccgagatcaatagacagggtgatgtttatattggtagaaatacaagtaatcataaaagcagtaaatttggatatgccaaatttaacagaggcatcgaacgattgaacatataagaatatcatccaaagatgttcaactgttaccgcaagaacacggcaataaccttctttttagtgttgtgcggaaatatgttgaacggttaattgacaagcaaggattaaccttacttataggcctgttaatttgccattatgaaacgtgataaagacctagtaaaccaaagagaattacccctacattacgaacttacgattggtggcgtgcgtatgactcgaaatggtcgagcagcttttgttggagctctgaaacaaaggcaggacaacttgtggatagtacacgtcaaaattggaagtttggttgaaattgaaattggaatgaattggaagtttggttgaaattgaaattggaatgatgtgatgtaaaagttggaagtttgtatgtgtgtggaaagttttgatatgatggaaaagttgaaagtttgaagaaaaaatttgaaattaaacaagggcctgatgagaggtctgcttagctcatgcctgcgtcagtggaccatccctgacgaccttccaatcttcgccactactcgctgcatggtgcagatcatggtgacaagaaaccagaaacaaaaacggcggtaggaatctgcaagtcttgtgccaatggttcacattatcaatgtacaccgacagcagcgcacacagcctcaagtt

SEQ ID NO: 57847 - DNA, 1047 bp, Oryza sativa
catgggaactcttgaagcagttagggaccagctacatgaggccaaggagctcgccaaaaagacagagaaggaattaagggaccgttttgctcagctccaggattcaaacttcgagctgagtggttcatcaaaaggtaatctctagatctgtcccattaatttacgctgtcgtaactgtatcctcaaccatttggatttcaaacagcgcaagccgccaggatggctcaaatggagaaacaaattgaagccctggaaagagacaaggtagaactggctgcgcaaagggactcggccttgaaggaggttgaaggtactgccagctgacaatctgaacttctctctttttaatgcagtagatttttatcataaatgtgttttgtagaccgcaaaatcaaatctcaagctcaatttgacgtcctagttagtaagatcaagaggcttgaaggagcaagagatgaagtcgctaatgtcgctataccactcgtccaagctatgttcctcaataacagtggtccgagtgtactcgacgcaaccgaaatcttagacaagctgagagttgctccggatgtatatttcaagaatatcaagaaagctggaagtatgggagctagcacggcattggcgatgaccaaatccttgtacccgaggattgaaattgacgccattgatggctttgcagacaggacaagcgtagaggctgctcttgatcttatcagcaatgctcaaaatgcggctgacaagattgcaagtgacgtcgtagatcaattccgcaacaccgatcttcagccgagtagtaataactctgatgatgaaaggactgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaaatcaaacaaggcaatgataaaccaaggaagcaaattgaattgat

SEQ ID NO: 57848 - DNA, 787 bp, Oryza sativa
attagaaataatccacctaaatttaaactctagacttaacacggttgtatttcaatgataagtgacgtattcgtgataactttatcaatattataagatatactagtccaatctttcgaagatgcttgtagagataagatttgcgtgcatacgtttataggagatgcatgtgcatgctgaacgtctttctatatgtaaaaaagatgagattgctaaatgaacgatcaatcagttcatggccgttgattgcagagtggaacaccctctgcatcgatcgatctcgccatctttgtcgtccttgatagaatgacacgataaccagtcgaacgatcgtacgtagcaatcgtaacgaaccaactgcttgacgtttccctgttttgggcctatatatacagaaatatcctcgtcagcctcctgatcgccaaaagaccggccctagctagctcaccggcttttgttggtggcgacggcgtgcctgccggttgaccatcgccggccagcaagccaatccggccgtcggcgtccgacaagtcaatcctacctaaaaatgaaccgatgcgagtaagaacggcccgaccggccgacgtggcacggcaacgacggcgtcacaatccggataagatcagttcccatccacggcgtggttatatgtggtggtcggaacatgaagctagctagttgtaataaaaaaaatttagttagggcagataattaattaagacgctataaaagcgtcattatggccgcattatggattgcaacccaagcaaagtatatacagttaaga

SEQ ID NO: 57849 - DNA, 1932 bp, Oryza sativa
cctctccaaggcgcgcgtcgcgcggggggcgtttgcacgtgaaacgcgagtacgtggaggtggagagagcggaagacgatgggatcgtggatggcgtgcggcgcgcccgggacacgtacgccgcgcgcgcgggggaccagcatatgccggcgtggtactgagtcgagaccgacacgatcacacgagtgtccgccgcatgctcgcagttactagtgccacccaacccaacccaacccaacccactgggtgtacgtcatggcccaggggttggttaggccgtttcctcggcccagcaaatctcattgctcacaattgtgggccgtccacgcatgggagcatatgctaacgggccgacttggtgctaagatttttttttttgagcgattgagcataataaaatttgatgctgtccaattgttgaaggataacagattaaacattgctttacgaatgacatcatatcaaaatttggtagtttcgaaacacttccaaattttaatttgaaggtatccaagtaaatacatccactatatcaaaaatttggcatcaccaaagcttaccaaaatttgataaattggcaacaaagggcatgttcatattgtagctaaaataaacctaaacaagttttgccaatgccaaaattttggtaagatggtaatattgccaaaattttggcagaatttcttatgtattgaccaaatttggcagcagactaaacatagacatattttttggcaactatgctaaaagaatgataggtttgcaatactatttttgaaaactaaaataccacaaagcatatatatttaagctgaatgttccatatatccatggattaagtaatagagtgatcatttttcgctaacacgcaaaatgattgcacatcaatatatcagaagaaaagagttatacttacacaacgcaatcagccagaccgacttatgccaggggaagggagaatagcaaaatataaaactgaagcttaaaaaactactgcggcggctaaacctaaactccaagcagcgggaagggccgagccacgctacactcccaacaaatcccaaaaaacggcaacgccgactaaagaacacatatagttaatagagttatcataaaactacatgtttaaacgccaatttttaatcacaataatacaatatttgtaactcaacatcacaatagtattagcaatttgacctttaaaattctagttttatgataggtttatcaaaataaataaaatatttatagttttgtagattttactctaagacttttctttttagctgccatctagtaatgctgatgtcattgctaccgtcaagcaatttttttccccgagacatgtcattgattatgtcactgtaatggtcacacattgtagtatactcctatatgctgtactcccatgaaaagtcatgagacggcctgtgattggatctttcattatactttgtcaaataggcgagaggaaattcaatcctttcttcttcggacaatctacattggatatacatgttcatatccgtacattcgaaattcagggccaatttggattgctaccctactaaaatttgcagtagtataccaaacacctctattaaaactctacctatgccataaatttggattggcctataaactagtatcatatgggcaaattttggcttcaatccaaataaacattttcaactctaccctaccaatattttggtagtaccaaaacttgcccaagatttggtactaccaaaattttggtagggcatcaatccaaacatgccctcattttgtactttgcatctagatgtctcatctcaggagtagaagattccaagtttcacagataagaatgtcgttgtgaaccgctgcagcatccatgactatactgtatatgcaataactgtgtcacaataatttgatagtaatctgtat

SEQ ID NO: 57850 - DNA, 944 bp, Oryza sativa
atttaccataacgaaaacaggcatataacataccgaggaaatgactatggtaaaaacaagttatcccaagttaacccagacagcttttgtagcctaaaaaagcttacaaaaacagcataacacctttctgtcgggcaccttttaatttgcattgtaataattccaaagaattatatgaccgcgtaaaaaggattttatcagcattgggcaacactattgtgcgcataaattgccaaagcaaaaaatgcctaagtccctaaagagcacaatgggccacgctgttaaaagtactgggctgaggtactgttcaggcctaaacccattcgtacctccgatacccttaacaagaaatcccgagatccaagcgacacttcatcttccccgccggaactctcgccattttccccactccctgctacagtacagagctgcgccggcaaactacggttcaccattccactcgaatccaccttcgaaaagttcatcaaaatccttcccgtgatccaccgcctcaatccttcacctctccctagccatccctcgaatcagatcagcgcattcgaaaaaaaaatcaatggcggaagagaaagaaagctttgaatgccaatgggcgccatccgacgtgacggaggagaacctgaaggagatggtggcgcacggcgttctccctgccaagaaatcatcgggtggcggccagcgtgcggtgaggcttttccgacccccgatacacacgagactgtggtcttctcccatttcttctatggcggattcgctcttccgacctcaaaatttttccgcgggatattaagcttctatggaatcagcttgcatcacctaaacccaaattccatagttcacatcgacaatttcatccatgtttgtgaagccttcttgggaattaagccccacttcgctctgtttcgccgaatcttctttctcaagcc

SEQ ID NO: 57851 - DNA, 869 bp, Oryza sativa
cgcctccgcaggtacgtatctgaaatcttcaacccatgaccaaaacataatcttgtcttcatgttgagttaactaaccgcggaggcatctcactcaggaatatgtattgatgaagtctgaccccccaatcactcagcgccggtctcctcgccagcacaccgttcagggaggtggagggccgacaatcagatcagatccgcaacctcaaacctccaatccgactgggcagacaggttctcgcaagagaaagctggtgcttaatgacgacgaaggcgacgacggcaacaaatctggggacaaaggctcgcccaataaactcccaaagcataccactcccaggaaaaaactggctagtcgtccaaggccaaagatcagaacatcttccaggtataaaactctcggtaccatttcacttcgacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataaggccaatccgagtgaccagcctccgactgaaaaccagtcggcagcaactgaaactacaacaacccaagagcccccgactggaaaccagtcggatgtaggtccagatcaagaaactcccgaagttgaagcgcagacgacaacttctcaaggaccagaggctggtaacgactcgttgattgggtctccagataaagaacaaggatcaccccacggtcagctaggaacatcctcaagtaactcatcttctcaagtgatgccgatttcaataacttcag

SEQ ID NO: 57852 - DNA, 731 bp, Oryza sativa
cattgatctatgactcaattcaacacgagttacacacaccagccaggtaattaaatacccacaccatgagtcatggacgactaatataaagttattattttctccctttgaaaaaatgcgagactaatgacagcgtcctcaatacatatcgaccatgggatgaagtagaacggaaatgacaaggcaatttcgtgggcccaccaccaggcagatggatcgaaagctgacgtgaacacggcccatatgtcaagctaaaaaattactcgcaaaacggaggtctcctttcaccaatcgggcccgaccacgagacccgtacccctccggcgatcatacggtcgagggaggaagctccctccgacgtgtcaacatatgggccgtccgtttgctggccgcgggcttcttcgtgtgggcacactaggttcctccttttctttttcttcgtctctgccaacgacagatcatcgcctgccatgaccaaaatcaaatcacatgtgcttttggtgatcacacgattcacgacgacggtgaattggtgattagcactaatgtttagggagacttatccaaaacgaatcacgttggtatgggtctaatcatggtctgcaaaccccttcttgcatggatgggattcagtaatcatggtctaaaggttactgattagcatctctctcgaaagacatgagtactcgatttaaaactttttaaagcaccgtgtgcgaagtacggcatga

SEQ ID NO: 57853 - DNA, 1095 bp, Oryza sativa
tgctacaccgtttattaaaaataattgtctccctcccttcccatacgcatgcacgccagcgacgactaccgaacgggagaggtggtggcagaggcggagagggtggagcgggagggtgtggtggctgattgtcaaccaccatggcgttgcagacacgctcgttaccttcgtcgacatcaaacgcccatgtcgcacactctgctgcggtgttctcgctgtctcatactgcgtcggcaccgccatgctgttggcgttttcccttgatgactacctgactgatgcctgcatggagacggtctacactccatcctgcaccttggtgtgctgctcgggagctattgtttgtacacaccttcgggcgccgacctttccctttgcttcttccccgtgacggttggttggtctgcaatggcgttgtcgtagcgattcttggacggccacaatagccacgtcctacttgcagtagctcaccatcgacgacacgtgggctcgtatcctgaggcgatgtcgctgctcggatttgacatcgtggagaaaggggaggacgactgcagtggccgctctacctgctcaccatgtgctgcttatgtgtcaaggtgtgggctggagcggaccgtgctcgcggctgtgcaaatccggcagctcagcgaaggatccatgctgcggcggagaaggaagagaccgggagattggccgctgctcctttcccgtgggccaccgcacgtcgctcctcttccacaggtcaccgtgcgccgctacctcttctcccgtcggccgcctgcgtgacgcgccctgtcccctcgccgatgaagagccggaggaaatggaggtagagaggggagatgtggaggaagtgggactcactaactattttttaaccttattagtatttgcctgacatgtgggtccagatattttgttttattttttaaattgttaaattttacttcatgtgccacgtaaatgcaatgtcagatgaagaccgagtcaaattagccatgtagataccacgtcagctgaaaccgcccttcaagccgtcttaagacttgttagagcaggtacaatagatgcttcaagccggtgatagctgtccac

SEQ ID NO: 57854 - DNA, 2244 bp, Oryza sativa
catgaatgcaagatgagctaatattgtcgggttaaatatatttgggccttttctagaaaaagaaaaggtatatgtggacctcaacgcgcaggcacattgaatagtgggccaaagataattggaccgaaaggcccatgggcttcccttaggcaaaaggtaattggagctgacgattgccttgattgtcctttagccatatttatgtggttttacttttatataagttaaccacctccaaaaaattttctagatagaaaacatcaattttaaccgtcaacagatatctacatcacaagtatcacaaaatactattacatcataggggtagaatgtacgtgtgtgtttacatagataagtgtgtggatgttatgagcgtatgagtttctacgtgtttcttaaaaaaaaaagatgaacaaaaaagcttgcatcatgggtgcatgttggtgagccaacagccaagtagcacaactgcaaaagattccccttttagatggacaaatgacaaacatcaacaggttgaatgaagttcagcggatatgatttcattttcgtctcaaccttcaaccaaagttatattgttcatacatccatgagccgtctgttgcagcgccgaaaaggcataaaaatctgatcataatatcgctgaaatgaaagaaaatgactccagtggtcaatctccacacaaccatcgccaaatatggtatgttccttgaagaaaacaaatactatgcatgtttaagcacgttaagaaagtcatctatgtaaggtaatgtatatattatactcctatataatttgactgtgcatgaatgaacagccgtcgccgattttcctcgccggaaacgaaccaaaactggagcagaagcccacagaatgtcactcaaaactgcccagaatacaggagatgaagtcaccaaaagcaggttttatcatagtctcatctgatgagactgacataactgcgtaaacaaaacgctgatcgaattagtcaaacaaacaaaatcagtgctttaccagtgtagtgtcaattctaaaactgcaaagtcaaaacctttcaattatatttcgaccagagaaaggaggacacatgaagctgcaagtgagatcgatgcaattttttttgaaaaaaatctcaagattgacttaagaagatggccatctcaagattgggctaaaataacatatagcccaattcggtcgtctgcattataggagtattatctgtgccaatgtcaatgcacctcttgtcaaaaacactaattttcttatcccaaaaagattgtcaaaagcattacgtatacatggagtgataatgacaccatggtaataaactagtttacttgtggagtgttgatttgcatgtatactatatactccctccatctcaaaatgtttgacgccgttgacttttttaaaaaatatttgatcgtttgtcttatttagaaaatttaagtaattattaattcttttcctatcatttgatttattgttaaatatacttatatatataatacatatagttttacatatttcataaaagtttttaataaaacgaatggtcaaacatattttaaatagtcaacgccgttaaacatttagagaaagagggagtaatataattgcacacaagagagatactcttgcatgcatgcgtacaaggagatcaggagatcccattggaagatcgatactcctcgttatttctaatttgactggttccaatgcatcatcatcgattcatcgatccaatattgtggcgtcatttagctagcaaggggatcgatgtatttaattagtagtcaatgagcaagatataattagtactctactattattttgtctcctaaactttggggttaagtgcattttgcatctttgaactcttcaacgatatattccaggaagatttttcttataaaatatgctttgtttataagcaaatcgatcatcagcatattcgagtcgctagaagctagcatttgcagaattgcaggactgcatatatttacactgctgccccgtatgtttctgcaggataaaggtcattttggtcttccaaactattttgccagagcacttaacccctgaacatttttccagtttatttaatttacacctcgaattattgaaaacggttcaccttactttataatgctatttcttttttttttctctctgtataagtcaccatttgcacaatattttgttaggactgatagagacgcattttaacttacctttaaa

SEQ ID NO: 57855 - DNA, 1201 bp, Oryza sativa
ccacgggagtaaaatgtacttttttttattattagtttgtgtaaacaactaaacacgattaagcttctctactactccctctatactcataaaggaagtcgtttaggacaatgtttaagtcaaatcttgggaatataaatcattaataattctcaagttgttgagtttgaaaatgtaaaaattatatgaatagatttgtcttgaaaaatactttcataaaagtatacatatatcatttttcaataaatatttttatagaaaaaagaagtcaaagttatgttttggagaccgtgtcgctgtccaaaacgatttccattacgagtacggagggagtacctcttaattagaaaaatacactacctccaactttccaagtctctgaaagtgtgcaagtaatgtgcatagactcttgcctgtagaaagaaaaaatgcctagtggcagctggtgttgaactgttgcaattaattgccacaatggatggaccttatgctgttgcgaagagtcctcgtcaaccagattaccagcgctttgcacaatcatggtcagcactagccaagttgctgttgttttgatcattcttgttaagatagccaaacattttttctagtggcaagttgccctttcagatatgttgtctgttgttcgcacacggcgacctcgcattccttcccaatctcttgcagaagaacacattaaactagtaaccaacttgtaattgcactgcagatccaatgcatgcagaatgaaaaaacaatgcacaactgtacaccctatgcagctagctgtgcattctcaagatatatcatgtatatgtatatatatagcagatataaatctgtaagcttcagccaagcatggaattatggagtagtactgtaagaaaatgacttagtgatgagtccattatttcagtaatttaagtattggttcttatccattatctaaaaaaaaagtattggttcttatgccatacacttatactacagagaagaaaaatcttctcactttgaaatacagctcagcgtgcaccatgacttatattgaatacagatatgttcattaagctccctccatctcaatttctcattgttttagcatttaaattttttatcaaaatacttgccattatcacatttaaaagcatttttagaaatgtctgtcccatcctacccttcattatctatgcagtcatacgtacgt

SEQ ID NO: 57856 - DNA, 811 bp, Oryza sativa
catgcatgccataacaacagtgatgaaaaagaatcaggtctctcctcgaattgaggagagtggaagagattgttctagcctctgtacacgccggagggatcagcgttttgaactatccaagggtgctcgaggagcttgtggaggggcagacgatgcgccgaattcttcacgagcatctgcagatcaaaatgctttcttgaggttcacactctggtggatgttctacttgtgtccaagtgacgatttacttgtcacagttttacagttatgtaaatcatcaggacaggagcatgcttcttacctgtgaaattaggtctttcgcagccggggacacgaatggtttcagtgggaacttcaagtcaactttcacaatcctgcatgtccacaagacatttcagagaacagtgcttgcaagaagtttcatggaacttattggtaattacaggtgagaacaaatggaattaattgtactctgtcgagcatggaggatagattgaacataatcacgagtgtttattaaagtagcagaaaaagataaacaattagcagagtatagctcagatatcagaaacgatagtgcagaatacaacctctaatgggcaagagacaatgagattcacaagggcatttgagatatgtctcaggctagttagtaaaaagtcactgcattctcactctgaaactcatcattacctgcgatatgtttcggagtgttcttttgcttcgaaaggtgggactccataaaggaactcatagcacaggatccccaagctccaaatgtcaacatggtagtcatgttcagtcttctcca

SEQ ID NO: 57857 - DNA, 815 bp, Oryza sativa
caaagtcttcacaaaagtctttaaacaactccgccagtgaattgtctgccattatcagtgatgatccgattgggcactccaaatctatgcacaatgttgatgaagaagtctcgagcgttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggccaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaaaggcttttcttgtacagctcagcttcatgcataatataaagtttgcttcgtcttgaaatccgctcggcttcatctttgtcttgggggagttcttgagaagtcaagaatcgtatgaggggctctcgccagtcgacttcaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgag

SEQ ID NO: 57858 - DNA, 9824 bp, Oryza sativa
attttgaagagaaaaaccaaggagatgctctcagagtgcgtggaacaggtattgattgcttaatagttaccctggtgtacatattttctgctaccacatgtatgatctgcaaccagaagtaacataactataaaaatctgcttggacactgcctcctaaaatcttaatacaaagatatgcatcgctcttacgtattcctgaaaaaaatctgcttggacaggcagtcttctgcaattaaaacgtttgccatagaatcccttttgctttgtctcatgttaaccttgttttgattttgtctcctttcctcaccttctatgcagatggagtttaatgcgaaattttatcatgaacaaattgaaagacttcgcaaggacaccgaggagaaagagaatgagtttgagaggttgctgcaggaggagctagcaagagctatagagtgtgatgttgactctgaaactacagaaaattgcaagctaaggtgtgaccaatacgtggttgggacttgggagcagttgaaaatttgatagtacttctgattattcttctattgatcaaatatagatatggtgtctctgtgaatggaaatgctccactccgatatatcactaatccaaaaatattttgtgcagggaggaacagatacaaagaatcatagattgccaggtgaaggatgcggaggagtttgatgctgaacaagatgaattgatcaaaacacacgaagagaagaaggcgaacgtcaagatggagtatatggcaaaggatgttgagctcgaggaggagctttatgccgctctcacaagtctgatggagaaacacaagccggacatcttccaaccgtccagcccttgaagagctgcaggcttgcagctcaccatatatatgccctgctcacaataatctcaagaggtccctctcccaaatgaacttcaatttacatgccgataaattgcttgaaatgctcagaaactctcccgagtggcgtctctgggcaattgtgttgcacccccaatttggtgttttgatctgcaatttttatgcatctgcaaaggtcaatttgattgagttgacaagaatacctgttgctcaactcaaagatgatgtgctattcttgtcaaacatataactctacacggttttgatttcacttgcaagtttgtgaaaataaaagtaaaacagatggttttactttgcaagtaaaagaatttcggaactgccaagtccgtccctaatatttctagagattcagaaacatcacatgtttttgggttactgcaagcatggtttgaagtttggacttcattttggaatgaaaaatctgttcgattgtcatgtatggaagcacatgctaccgtgtcatgatcagatgaaataggatgtcgtatgccgtatgtgtatggtgcagcagtgaattgtccatctcaactctttcgaacttgtaaaatcacatctgttgaaagaatttaaaacgcacaaattaatcgatcaattcgacgacatctacaattctgcacacctaaagatgacttaacatgcatgtgaattgtttgaacttcgaatttcgggcaagaatttggggtatcacaattcacaacatgtcgctatgcaatacccaaatcttgaacattacactactagaatatataatattaacaaggactaaataacgaggacaataaattcctagtcgttaatcatattttggagcagtttcggtagaaaattgggacgtgatgtgtaaccgacgaccacagcttacctcccgtcgttagttttcgttctttgtcatcgttaatagcagttttgatttgcctatcaccgttttatagtaagttgaataaaattttattcgtgtactcccgatccgataatctcgccccccatcttcttgtattcccctcgctcctgctgccgctcacctcggccgccggcgtgatgctactggcgcaaccatcggatccctgcgcacgagctccggcctgtcgctcccaccacccgtgacctccattgctgccaacgttggccgtgcgctctcaccaccaccatctccagatccttgccgaagtgctcccgccaccacaaccccaacggcggtggttcttccccaagttctcaccgggcacacgagggaggaaggaggcttgatttggtgcccccacccccctttggtagaatctccttctcttggcacaagaagtttctatcagttatatgtcctccccttctgcgctaatccaaactgagatcgttccctgctggtttctcctccaaatcagcaaaaatcaggaggttgagagctgattagtgattgctcgctggaggtgctgcctgggggctacatcgagcaaaagggtcacaacaggaaggtaatactatcaaatttgccaggtagttcatacgtgctgattattattaaggtttatttgcatgtctagttgtctactgtgctgcttctccctatcacacaatgtttgatatggtacgttccaccaaattcttgtgcttgtgatagctctgccactttcatgagtaattgaggattacaagcaattaattctattttgtaggtaagcatacttcagttgctagctttaatcaaggaagaaattcataactgtgtatcagtgtgcatgactacaggtaaccgggtaactgggaatgaattgatgccatcagttaagcaggctcaatgtttgatgtgaaattcagggacagcttcactcttcgtggtcctataatctttatcaggattggaattttggaacttaactataggattaatcattgtgttggtaaatgtgtcgccgtgtattaaatttctctttcagtttttagatcaagaattcgctctttgatcaactgttactgaattataatacaattgggcatatgtgtaggaactttgcaacgtttatgtgttgataattatgctgcccccattcatgacctcatccctagtcccccatgaagactctaccaggtgctttcttaactaaataatgtaacatgattaagagttctcctcaactgactgcctggcatgattttatcagaaactaatggatttttgttataagctattgcactgtttatcttctgcaggaacaaaattcaggatgatgcctcctggtccgaacagtttagggaaaactcaatagagccagaggatctacacaagccttctattcattgttttaaattgccatcagtttcatcaaacataattctatctaatttgtgctctgtattgcttgagttaattaatgaattatcatccaaagcataacttgtagtgaacttatttgctacaaagtgttatattgttccatttagctattgaagttaaattgttcttatttatatattgcagtcgaatattgtttaagaaataaatactaagtttgcaaaacttatcaattgataattctagactgtaactgtactaaagtattttgcttctcagtatccttctttttatatttaggtaactgaactaacatatattaggttatcagaacaacatcactggaggtaaattttgctctcaaataagttatatattacatgccaaatataatgtatattaactagtataatccttgccagtggtaggatttatgatgaaatggatgaggaaggtgcagtcgaagacatattgaagggttgtttctctatataatgattagcggttctatccataagacctccagatcgaagaatatttttttgtcatatgtaacattgaagctcgggtgtcccagttagattaggtatcacaatgtatccctgaatattttattacaatcgattcaagaatgatatcattattcttgtactgattgttttgaaatattgctatgttgtgcaataatatatgagattgttaactccaaaatgtgcacttgcaattatttccaagggagtaatggatcttattgtgaattaataatggtgttaatgatgtatcctgaaatttcctaatattagtaaatatgaacttagatgtggtcgtcaatatattaagaaccataaccagtcccagtcattaatacatttacaagcacaaaatgttacggtcgttaatgtattaacaaccgcacataaccatggtcgttaatgtattaacaattgcacataaccatggtcgttaataaagtaacgatgacatattgttcctgtcgttaatgaaataacgatgggaaaaattacgtggtcgttaatactattaacgatggagccttcaatgactagaactttgtagtcgttaatgaccacatttggacctttaacgaccacatttcccatcgctaataatcgtttctctagtagtgttaatcgccattgatgcatgggtaattgccctaccaatctcgcattcatgattttcacatgtctcaaacgtgaagagaacctatcatgcataaactcttactgtcactacataaatatcaaatcagggtgtgtttagttcctgaaaaaagttggaagtttgaagaaagttgagagtttggaaaaaaagttagaagtttggctgtatttagatccaaagtttggatctaaacttcagtctttttccatcatatcaacctgtcatacacacacaacttttcagtcacatcatcaccaatttcaactaaaatccaaactttgcgctgaactaaatacaacctttatgtgtgtgggaaagtttttgatgtgatatgatgtgatggaaagttaggaatagggggaaaactaaacacggcttcagtgccctcacatttcatgtgaatggatcaaagagggtactagcgaagtactataataaaatactacctccgtcccattttaagtgcggccatggtttttcgcgccgaactttggccatccgtcttatttgaaaagtttttgaaaaaatttaaaaacttgagccacaagtaaagtactattcatgttttattatctcgtaataacaaaaatactaattataaaattttttcaaacagttaaaatgaaacacagggagtagatcgataaaatcaaatcacttgcttagtcatgacaaattgattgctcacgattcagcttctttcataaataatgaaacctttgtacttcggcaacttttaaagattcttcataaaacagcagcaacacgaaccagacttctcatgtcttcattcaattcaacaccaacaactagacaaagcttaaaggtcccctgacaaagtgccaactctaagagtccccatccatcactcacagtgacatgtgggcccagctcctcacgttgaccgcagttgactcgttgacagcctcccgggccccaccagacagcgcgaggtgcgcctcctctttaaagccttcgtaaacgaggaaggcgaaaagcggggggggggggggggggggggccaacgcattgccccagggggaccaaacttactttaactgaaacatggggcccaccagtggggaccccactcgtaagctacccggggtaagcgggggggatcgggtgaggaccaaacgagcattccgggcggccacccacccggggcggttaccggcgcccccccctccataaaaaaccaaccaaggccacaggcgcgggtccgcttcggcttctctctctctctctctctctctcctcgaaaaccccaacacacacaacgcgaaccccactccgcgatggcgtccgccggcgatcgccgcggcggcggggggcctcccggctccggcgacgactccggtgaggccccgctcccgtccctctcccttgtcccggtggtcggatggccgatccccgcaatgtcggcggcggatgctgctcgttcgcgcgtagggtttatgggggtggttgggttgggttgggtttccccggggatcggtgcgtggttggcgtgcggggtttttgttttcgtgggggtttcgagatgatgtgtgttgcgggggggtggccgcagcgatgcggggggatttgggtgcgctgcgcgggtggattgttcgaggtgattggttctttcattttttttttgggtcgattggggtgtgtactgtgtagggggtttagtgccgtggtgctttgtgtggttgcggattcggtggtctcgtccatgtggttggttcatctgaaggcgatgggttttggtttgatttggttagtttgatccttctgtctttttagagcttcagagtttggtgttgttgggtatttttgggttcctttcggtgaggatttgtgttcactttctatttgaaaaaaagagagagatatatacgtattcaccttatggagcattcagttgtaataggtgggtttttatttgattttgcggctggttcattgtgctaaatttgtgttgttgaaataggatgccgtatgtgattattgtaagatcattgattattgaaataggatgtatgtgattattgtatgttttgaatgttcgcctagcttgctagatcgataattatgcccacatgcttattgtaagtttgtagctatgttaattttgcttccctgcgctcttaggtttatggtgtgacctccttaatttgtgattgatctatgcatgtgtgtgtttaggtctttactactgataaaattcaaaactcttagaactttgcaaatactacttcatgctgaatgattgctctactcagtctggtcagaattaatttacattttgtatagaactgttgatatttatctctatgaatattttgattggacataacattacgaaatatataatgcaatcctaaggtagtgtttacaattgcatttggagaccttttgatatctagtacatatttgtgactggagagagtgttcagtgttctgtattggaaccttttattgctttcatcatacataagagcatttcataattattaatcactggccttcatcagttttggtgtgtgtcaaggagctgcactcgtgaatctgtgcgtgcatgtgcatctgccttataatcacgtgaaaataacatgttatactaatttatgtaaatgccttgtatccagggggtggttgggagactgttgagaagagggtaaagaaaccagcgcaacaagttgggaaggggcaatggggacaatggaattctccaaatgctgcacctgcacctactgcaccacggagtggctctggagcttttcatcattctggaaacactttggttcgacattctgatcgtaggccagcaagaggcactcctaggccaccaccacaaaacaggtctatagaggcagaactgcaagcaccgcacggagttgtgactgcacctctggcaaatggttggcagtggggagccaggtcttgcccacctggtactgaaagcaaggagggtggtcttcctttgtctggttgtgatcctgaaacagacaatgctgaaggttatgacacatcggacgatgataatgatgatgatatgagtgacgatttgagtgatgactatgattctgatgcaagtgagaaaagttttgagactcggaaaaatcacaagttgttcaaaggtttcttcgaagtcctggaggcgttaagtgtagaacagttaaatgaaccaactaggcaatggcattgcccagcatgcaaaaatggacctggtgcaattgactggtacaaagggctacaacctttgatgactcatgccaaaacaaagggttctataaaggtcaagcgtcacagagaattggctagtttattggaagaagagctatctcgcaggggaacttcagtggtaccatctggcgaacaatttaggaaatggaaaggattgcgggaaagcactgatcgtgagattgtttggccaccaatggtggttgttatgaacactgtattggaacaagatgaggatgataaggtaacattttcatttgattgctgttgagtttcagtatagatctgaccagtttttctgcctgacttatatctttatgagcataacttttactcttatcttctattcatcattctgcaattacaggtcttgtctgccacattaaatttgtagtaaatatacatatttttggctattttcttgcttatttttttgtatctcgtaagaacattgagttgattctactgatttgtttacctattagtatcaaaagcaatgcacattcctcaggagcagttactatatgttgacttttgttactcaaatattatatattttttcttatgcactttgatataaattgattagcaagatttatcctcttcatcacacattttggttgaatttattatgttttgttccagcagatatttgttttctcaagtgttaaaacttaaaaaaaaaagacttcaaaattcactctctgttgtgattttcttgcatttatacttcattgtgaaagaataaaaatatgctgagcagtcagggttatctaggcgttgttcattaaaatgtatttcttattttctttattattgtgaaagaatatctgcttgatctattaaatgtgtctgcttttatgtttttattgcattctaatatctcctctttgtctcaatctagtggaaaggtatggggaaccaagagctaattgattatttcagtgaatatgctgcaagcaaagcacgccatgcctatggtccaaatgggcaccgtggcatgagtgtgctaatctttgacagctcggctgtgggctatatggaagcagaacgtttgcatgatcactttgttcgtcaaagaacagacaggaatacatggaacagtgctcacaaggttacattcttacctggtgggaaaaggcagctgtatggtttcttagctacaaaagatgacatggagacattcaatagacattgccacggtaagccatttaactatggtccaatacctgtacattaaattaattaacgctgtgtttttggtgcaattgtcattcatctgataaataactggctttcattacttttatctcctgaattctttctgacgccgattattattggtcacctctatgaagtgctcatgccaaatactagcttgcatttttatgatatgctgcatattcctgttcttcatcttcattggaatgtgatcacaattgatattatttaccgcaatatgtttctactaatgcttcacaacaattcataccttcatttcatttttattacgtagcatgttattatagtgtactcaatgctcatcagctgggtagctttctggtagtttatctctactacttgaaagcatgaatgtctaatctcattccattcaaaatgatatttcccttctgattgtaagaagaaaaattctatactcaaggacaatatgcaagggtaacttacctcttcggggacagcaaaggattagatctgtgcttctatattaataaaccttcagttatctattttctcctagaacatggaatcctatgatttatgctaggtatagattcatcatcattgggttcagcaagagtaatgtagcccattaataaaaaagaactgttaatgcaaaaatttaaatgatgctgatggaccctaatattttattacctttgtgcaatacggataggaggcatgtgcttgtcttttgtcttgtatcctttacctagtttcgttttgttgtttttttctaaataaaatacaccatttttaaagtaagaaagatactctagtttgcagatttctttcttttataagaacaattaattcctgagcattgcatttgggttacattcaaccctctacacttcgatagttttatttcttcatacgcattacaacctgtcaatctgtcattcatcatagcctctctgcatgtcagtttgacttcatatttgctatcctgttgatagtaaaatagaaggggaagtggtgcctg

SEQ ID NO: 57859 - DNA, 7055 bp, Oryza sativa
atctcagagtcatcatcgtcatcatccgacccatacacataaggacacacatgattaaccttcttagagttcttcctagcttccgcaaatctctgttcatgcaattttaccttatgtataagatgtgacaaactatcaaagtcttcagatgagaatttctccttaatcggaccaatcatgtcctgaaaggctaaatcggctaattgagaatcagtcaaacttaagctgaagcacttattcctcatttccctgaatctctgaatatactcatgcacgggctcgttatgcctctgcttaatcgcggtcaagtcggataatttcatctcatgaactccgctatagaaatagctgtgaaattgtttctccaagtcgacccagctgtttattgacccatatggcaaggaagaaaaccaagtaaaagccgatccaggcaaggacaaccggaatagcctaactctcagagcgtctacagccgatgcctcaccacactgagctaaaaatcggctaatgtgttcataagttgacacaccatcttgtcccgaaaacttggagaaatcgggaactttaaatcggttaggaagaggaactcttttaaaccactcagggtaaggttgccgatacaagtttccagtgtcctttggtttaagcccaaactgttccctcatcacgtcagcaatcacatcggcccatggtcgttgctgagctgctccttgcgattgttgctgcgtcggctcgaactgattatactgaggagcgaactgaggttgagctagccctccttgctaatactggacttgtggggaagaaggtcgatactgataactcaaattgcccccttggtaattctggtaattcggctgaatattttgcaccaaatgctcgggcacaatctgaggcatcaccgtaccatctggctgcacatggtgagccaaatgctctggaacaatttgattcagggcgtgtccagccgattgattcatcaagccttgctgtggaatcggctggatagtttgctgtcctgatggtgtctgttgagtcggttgtgcgacctagcgtcttggcggcgtttgataaatcggctgttgttggactggatcaacaataggttgagggggtaaaaacatagcagcaacctggtcttgtgtcagccgatttgtcgcctacccactatgctgtggctgcttcctcatcaacaaccgaggattaatcagctgtcctggtgccgatgctgttggagcaggtaaaggagtcaatggcagtactgtcggctgagctaatggtgcaatgggaggaactgcttgagcagatggctgagtgccggtaatcaaaggccgataatttggaaagacgtctccctgcaaataaattgggcctgcagcctgatgctcggctattgatccgtcggctattgatttcatcaggtttgacaaagtgttaactaacaccccagactgattgatcaaagcgttgtgcacggcataatccactcgatcttgaaagttgttgaagaaatcctgtgctgtctcgccatcttgattaagatttcctccttgcagcccatgaacaccatcacattgaactccacgtaccccttgagagttgtcaccctgagtcttgtaagccgagtcatcggtagtacctttttgtcgcctggttgagccgattctgaggctttcttcccttctccttccttagaagtactagtctcaggctcatcaggaactatctttaccttgtatttctgaacaaatgttcccttgcgagtctgcatgaatgaatttaagaattgatcccgcgcttgttgcatcattgcttcaaaatccttcttatgatcaggtgtgaacttttctggatcaacagccactacatttccttcattgatttcccccaagcctagcctctggattttttccttaacagcccctgggctagccgaggatggtgaaggtggcagcttctcagccataagggaaattgtcttccgacttctaatcggtcccactgggcgtgccaagagcgtgttgacagaaaacacgaggcctgggagatctgcttaactacagtgcaggtccaaaactcgccttcgggtgtgtaagcgtaccagttgatttgatcctgtaatcaacaagaaatagagacaaagaaaccataattaatcctataaacgatagccgatcggctaggtgccgatgacatttcatttatttctgagccgatgtcatatatgtatcgatcggcattcatgaacaaataagaaggaactaaatctactcgatcggctgtagatattaatgatacatacttcctatatcgatatatacttaaatcaagtgattgggatagatcggacgccatgccgagacagtataaatcattagatcgaaatatatattaataatggaactatatacattcatagcatagccgatcagatagatctagcatgtatcggctaatactccgatactactctatattaagatattaaagcaagtagaatatatcaaacaaaagcctaatatacttaactgcaacaagatcttaatgtaaagggcggatttaacatgtcaatcatgcatatagaataaaagtagttaaatcaggtaagatcggctgaaaccctgatactactctaatcggcaaccagaaggcaggctagaggttgatattctaagcacgacttaatagatcaaactcaactgatgcagcattaagtataaaaagaagaacaatatctagacaatcaagccgctaaaagtttcatagagtggtggatattttatataatcaaaatcaacgtcacaatctaacctaatcggctgtactctaccgacagatgctagccgattgtaagttagataacgatattgctagagattatataagatatatgataactcgacggattacataaacaagattagtgtatcataatgatggaagcactaatcccgataacgcaaaccgccataacaagttttacctcttgttgaagatcgaaaccgatgtagctacacccgaaagcaagaactcgtcaaaataaaactaaagcaaaagggtggcgatgcgccgaaattgtattgaacgtgtgttgttgattacatgaggctcagggtctatttatacccgagaattacaagatatgtgtccataccggacatgactattatctctaacaaactctaagataccataagtctttacagcagacttttgcccaaacatatctctaaggaaataacatagaatatcctaattaatagatacaattgccttctcaggaatctatccttgcatggcaattaccatgaagcacattaacttaactcgatgatgtacgccgagtcgtattgttggaatcggttgtatcggctaaccccgtccgactcaaactctgccgatcttatcatagccgatttggatggcagccgattcttgctctgttttcacaacagtctccgtcttggattcctcttcgatctgatcttcatccccgatactgaggttaccaaatttggtcgttaacaccgccgccgccaccgccctcccctctcctcgtaggggccggatctgggaagtgaggggaggggagctgtgtccgccccaccgttgccccgtccgtgccgccgtcgtcgtccgtgctgccgtcgcctcgtccacgccgaagccgtcgctccccctcctgcagccagatctaggagcggggaggaagagagggggagccgccgccgccaccgtcgtcggcccgtccttgccgatgtcgccatccatgccgccgccgcgtccgccacgtttgtaccgctgccgtcgctgtcgctcctcctcctccgccggggagggagagagggggagccgccgtgccgctgtcgtcccctcctctggtcggattgggagggagagagggagggagggaggggaggggaggaggtgagccggtggggggtggagaggagaagagaactgttgagggggagagagagagagatagaaaaatgagtggcatggccggtggggaggacaagataaggatgacttaaagacttttttggggaggtacgatttttgcaggtggaccacataaggttccgcctgtaaaaatcatatttttccaggcggagcacttaagaggtccgcctggtattttcgcaggcggacctcttaagtggtccgcctggaaaaattgattttcacaggcggatgacgaaaatgcacctcggtttacatttttgtaggaggatatttggcttcgagggtcatacccgtctgcgaaaaaaatgacccaacatcggtaaaaatgccttttctagtagtgatgagaaactttttagggtacatgtatcctaggtatatacactggtggagaaaccatctttggtcggtcggccaaattccataatagtctggttctaataaaaaccgggactaaaaagcatctttagtcctagtttaaaggttgaggagtactttttgatctttagtcccggttgatagatcatttttagtcctggttcaaaaagttgtagggttcaagacagaccccaattatatttactcccggttagtataaacaaccgggattaaacagtaccccgaaccgcgcgccaccaactcagatattatccgcgcgcactcctctcgatctcctcccctctcatttctctttctctatcccttcctctcccccttcatccccttcctctcccctttcccctcccgttcctccccttcccctctctgagcggcggccgggcgagcggtagcgacagctgggcgggagcaacggcgcccggcgggagcggcggcggccggccgtctaggtgcggcaggcgggcgggcgggccgccaccgcgcgggctggcgtggcggccgaccaggcgggcgggcgcagcagccggccggccgagatggcacgaaggccgcgaggatggtggccgggaggccggcggcgccttactctctgctgccgatttttttttttgaatttgtgattcattggatttgatctgtgatgtatgtgatattggatctgatctgggagttgtgatgtatttcttttaggaattgtgatgtatttttttgtttgagattttgtgatgtgatgtattgtgatatgtgatgcatttctttccaatatgtgatgtatttctttccagatctgtgatgctatttgatttggggatgatttgggagtatgatcggggatatttagggagcagatcgatttgagaaaaaaaaaatcaaccgggactgctcccactatttttagtcccggttattttatccgggactaaagatacccatctttagtcccggattcgtagtcccggttatacaaccgggactatagggggtttcctatcaggagtaaagcccttttctccactagtgatatatgtttgatttcaagataaagtgggatataatgagatggtatcatcttgtctttgatcggaaggttgggataaaccttatttgaggacagaaaaggatggatgggacaataattgatgggattttcggataagagaaaagtcgtacacatgtacgtcatgcgtttcttcagcacatgacaagcaccccatccatcatcacgattgggctcaggggagtacgtacactaggagatgggtgtacagttgtaccctattttttttttcaaacaaatgtgatttaatatatttggtatatgtgtacccaaccggttaggcatcaaaacaatcatttgtaagtacaaaattatccttttcaaacaatattactacatccatcttaaaataagtgtaaacatgggtatccgtatccaacatttgaccgtccgtctaatttaaaaaattataaaaaaataaaaaaaattagtcacgcataaaatactattcatattttatcatctaataacaataaaagtactaatcatattttttttaaataagacgaacggtgaaacgttagacatgaacagtgcaaaactgcacttattttgggatggatcggagggagtatcattttcccttagctattttatagtttttctataataaagattcctatttatgctaataacacatattagcacttcaatacttttctcattggataacgacgcttgcttgagtaactgcacctctcgcgctactgaatccgagccaagcctgtacggcccagctcgtcgtcacgcttgaagacgatgaacctcgtacgtgacgaggataaggctgctggaggcgtacgttgaggtgtcaagatcggaggcagcagcgatcgatgtcgaggtccaggaaattgatagatggaggtgaagtagggtcctccttatatgcgagtgatcgcgggacggacgcatgcgcgatcagaaacggcaaaacagaaaaagccccatacacgtgatcgagaccttgtgacccacattcacgtccataccacttcacacgcgtttatatatatatatatatatatatatatatatatatatatatatatatatatatatatatatatatatgtgttgcaacaggtgaataaattctaatgataatatacgtttcttatacataattatgtcaataataatgtttgtattttaatgagccgtttgttttttcataaacggcgtatttctttctaacagtttcttcttagcatactttttttgatttttttttctgaagacgaaaaccatatttttctccctttttctttttcttttctcacgcgttttttgctttttttaatgttctttttttgcttttttttcaatacatgagaatatatgacgaaataaaagccgtgtaatagatggcaaaaaatcgatagatcctatccgacttaaacgtccatcaatttagcgtttttttttctgacagttttttcagaacgatttattttttaatagacggtgtttttttcttgcgtggttttttcaaatatttttttagaaatggcgtatttttttcgttacatttttttccttgcatgtttttttaaaaaatttaccgacgatggaaataatatttctcgcacgttttttatggaaggtggaaaacctttttagcattttt

SEQ ID NO: 57860 - DNA, 5315 bp, Oryza sativa
ctgcagcccatatcactgtatagattgaaaccgagaggagtgtgcatgggatctcggactcaaaccgagaccgagaagaggggtgtgttttattttcctttttaggggggaatcggatctagagtaagacttttttttatttttttcgctatttatattgttttgacgggagtcggacctgagagggagtcggactttttttttatttttttcgctatttattttgttttgacgggagtcgaacttatttatttatttttttcactatttttttgacggacgaaggaaacctctcttattttttaagtagtagagatagagatatatagaaatactatatataaaaaatttaaattcaaattcaaattgaatcgggtatgtaaacttttgacttataaactttggatatataaactttaggtgtataaactttggatgtatggaaatactatatatagaaaatatttaaattcaaattcaaatttgaatcagatataattcaaattcaaatttgaaacggggtatataaactttaagtctataaactttagatgtatagaaatactatatataaaaaatatttgaatttaaattcaaatttgaatcgtatatataaacttttggtctctaaactttagatgtgtaaacttgaggtgtataaactttaggtacataaatttactaaaatagaaaattgatacggtaccaaaaaaagaaaatcaggtggagggagatcgctacccaatcgccctggcaatcgctcgcccattagagcttccgccttcctgcacactctcgcaggctcgcagctccggcgtgttcatgtcgtgtggctgactgcgtcatgctgacatgtaccatcgttgacatgtatcgtgctgatgtgtgcacaattattgacttgtggcagccgcgagatgtttggcgaggtgaagactagggtgtggtgggaggagatgttaggctgcagctgcacgcttgcaccaactatactctttctgaagccttaatttttaaggcaatttttgaccaatttttgacgaattacattagctgctgctagtcaccattacaagtgaaatgactcctccctccagccaaatttacccagttttgtacttttgtgccagcctgccatgtggtacatgctgattatgatctcttccttaacatttttatctggagaattaatgctaattaatgattggtcgtgtacgtgtcctcctgcatgattaattcgatttctttgtttggcacgtgtttatatacctaaagtttttatacaatgcacctaaaaaaatacaatgtacctaaagcatctataccagaaatttatgtttgatttggatttggattcaaatattttatacaggatgttgttatataaaagtttatgtctatgtaaattttgtgtgtataaagtgacatgtatagagtgaaaaaaattatacgtgaatattttatagtacaatggattttttatttagttaccatttttttatttttttaaaaattcatttgaatggatacgtgaaccagtagtaagggaggcgcggatgtaggggtgaaaacggagcagatattattcgatccgatccgcttcgaatccgtctgatgtgaggatatagtaaggatttttagatatccggccggatgcagatgcggattcggattttgtcatgcggatgcggatatggtatcaacgatatccgacggatgcggattatccgatattttaatcggattatccgatgtactgtttggcggataatccgcaactttcaggccacacaacaactctatttagcccattttacatcgggcggcccatctagcccatctagtgtaacctaatccaatcctcccctaaatctctctctgtgtgactcttctctcggtcccttctcttgctcccacacgcgctgccgcatggcaccattaccataggtgcgccgcgccacctttgcagcctgttggcgccaccgccgccgctcctccttctagtccaccgacagtgtgttgtgtgctatatggaactagtgtgttgtgtgctgtatgcagtgtgctactgtgttgtgtggctgtgtgttgtatgcctagatagctgtatgcctcattgcctcatgcgtgtcgtactgatgagtgaactactgaactgaacactatatttttaaattttaagcaacacagtgaactgctgaactgaacacttatattatatttttgattgatgtgttatattaagcaaaattatattattgatgtgttttggttggatttctctagagagctgaaatcatgttcatatgttgttttgccatcgtattgcggctaattgtattgccgccctcttgttttacggattgaatacaaacttaacatccgacaactttttgtccgtttccgaaccgagtccgcaccgacttcgcaccgaatccgacgtccaaaataatccgctctgcatccgcatccgcacgtcatccgcacccgctccgcattcgcttaaaaaaaatagtttaggatatgatatagctattatccgtccgaatccgctccgttttcacccctacgcggttgcgcgcgtgcattagccacatcctctttatcccaaactctcgtatgttatgcacgtccatgttaatcacccaaatgattaacatttgacactatggctatttatccaatccatgcgaccgtgagcaagtcgtcggaacagcgggaaccagagcactccaggtctccagccgtctctgtgagcaggtcccttgcctcgtggagatggaggaattacacgagaggcagcagcaacagctcgtctgatcctcctggctccttcgataccatgaacttgtattctggatttccagtacccaaaattctttcatcaatattgcatcatggctaatccaaaaatccctaaatttggccatttctaacccatgcttgtatattgtccattttatctcccaaaatcagcaatgcacagttttgcaagtcacacataagaaccaaatttaccaaagtgaaccaaaacatgcatgataggagagcctgctacagtaatacacctacccataaccttggtcttctaagcttgccgtctccctcctcgagcaatggccgccaccaccgtcatcgttgagcccgtagtccacagaagcgtcatcccattctggtggcgtcgtcgtccttatcgggcgagcaagaaggaactcggactcttaaagttggcacccctgcatcctgcgagttctggttaagttgtgatccaaattcatttacatataataaaggccagcttttgccggagcaaagcggaggcccgtttgaagctagaggcatgggccggagcgaagcggatcgttatccttttagggtttcaccttcatatatactccctccgtactcataaaggaagtaattttggacagcgacacggtctccaaaacataaccttaacttctcgtttctatagaaatatttattgaaaagtgatatatgtatactttttatgaaagtatttttcaagaaaaatctattcatataatttttatatttccaaactcaacaacttaggagttatttatgatttatattcctaaggtttgacttaaatattgtcctaaacgatttcctttacgagtacggagggagaacttcttataagccgccgtttggcgttgtaatctcaccaccgatatggtgaagatattttgctggttggcgcccgtggttttttctctcctacttcgaaaggattttccactttaaatctcatgtcttctgtgattgatctattgttctttattgtttatttgcctatcgttttctaacagctctcagctagtggcatcctcttaggctgattggaggtctgaggaggaagaagattccttgagaccctgacatgtgggccactagtctaaattgcacattggtacgcaacaatagctggtctaaagtgaaaagttgttaatacctagtctaatctgcatatcaggtaagtaaacctagaccaaaatgcaattcaagagggtgcatgggtgggaggtgtggttggtcgaagcctcggaggcacgcgaccaggttggtagcgtgcaacgcacatagtactagttctagcaattttatacaattatacccactttcataatcatcaattttacgaactgatcaacgtacatatttaacctatttgtgctatttatttgtcattccttagttagaaaactatttatatgctcaaaatattaaaacacatcctttattgccatccatttattattccagaataggatgattagatacatctagaaccacaaccgcaactcgaaattcgccgaattatgcaatggtttggtggttgcgtctgattacatgttgactcgtagcagcatgacgatgcaaagcagttgcttcccttgcagcaagtgcatggatcacactctcttgtaacggataaaggaaaatagccggcttcactcgtcgtgttcatggactgcattggaacaatattccgagtgctcttctcttccattgatcctgttcatctattcatatcacatacttgtgtttatttatttgtatgtgtaacaacacaacaattgtgtacaaatgattttctcacagcttagcatgaaaagtagaattactacgaattcttattaaagattaatatttaaaagaacaataaaatattaattcattttgccaagaacatattctgcaaacaaacaccacatgacataaagtaaaagagagcttttttaaaaaaaaaattggagcgcattcttgtaatgcataaataaataattcagaccaataaaatgtgcatataaacctttggcctgaaggccagtccagagaaggggcaggaaaacaacggtgagcgacatttgaaacagctttgccattgatggtccttaaatgttaaattgaccgccaattcctgcataaaatcaattgaaatgaaaccattttcacaagtattcataaatatttgtatgtgggcaattatgaataaaatagacccctcatacgacgaaatataccaccagccaaccaaacacaattacgcggattgaagcgcccaagaaaaagagcaaaaccgatattatggagatccaatccactatgcgcaatcatgagggcccacttatcagcctcactcagaaggttggtggccagaggcggtttcatttggcagactagaggaaaaccaatatccgaagcaagtgatagaattcacgcttaacttaatttaagaatcttatttaagtatcttaatctacatcctaagcctttattttagttct

SEQ ID NO: 57861 - DNA, 974 bp, Oryza sativa
  unsure (1)..(974): unsure at all n locations
tattgacctttgcaacggaggttaggtataataacgaacgaattgatgatcaacaaatgtagtcaagtttatcaatctggagacggattgattcataataacaacacacgtggaagaaataagaaattctgtagtagttgtattctaaactaaacttattcctttcgacgccttgccaggcccaactcggtgagaggcccatcagtctagctgatcctggccacctctaactaggccgggcctagcaatctgggccgggcaagcatagctggcccagccagccgaccagctcagcaaccgggcaagccgctgcaactctccttgctgtcctcgttgcagtgttacaattattgtagcaatagatcgtacagccgccggtgccgccaaaattggcatgccgcctccgccgctgacctgctatgccgggctcacacgcgatcgccggcgtcgatcgactaccgcttctcgatctcaacccgaccatcccaaagttagccacacgcggttgtgcctttccccgaccgatttagaccgggaatcccgctggatcgatggcgccgcccacactccgccaaccttgggagctcatcatgtcgccgtcgctccgccatacacagccgcggctctaaacttgggttgaaacttgaaacccccaacccttttttcttttttttttgagaaaaaccaaactgattcggatcgaggctctcgaattaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57862 - DNA, 1009 bp, Oryza sativa
tgatcaaaaggtgatgcctgagggagttaatactactgcaattgttctaatggctaagaagaaggagtcaaaagagctaaaagatttcagaccaatcagtttgtgcaatgtgatatacaaggtggtagctaaatgcctggttaatcatctccgaccaatcctagagagtattatttcccaggagcaaagtgctttcattccgggacgcatgattacagataatgcgttaatcgcttttgagtgtttccacaatattgcccagagcaaaagggagtctcaagagttctgtgcctacaagttggacttggccaaggcttatgacagagttgattggcagtacttggaaggggtattggataggatgggtttcagtaacacatggattcaatggatgatggcctgcgtcacttcagttcgctatgctgttaggtttaatggatccatgctgaaatccttccaaccatccagagggctgagacaaggtgacccgctctccccataccttttcctgttcgttgctgatgggctatccaccattcttagttcggctgtaagaactggggatttagttccgctgaaagtgtgccgacaggctcctggaatttctcacttattgttcgcagatgatagtctcctctttttcaaagcaaacgtggaacaagcgacggttgtaaaagaggctcttaacctgtatgagcggtgtactagtcagttgttgagcccggcaaagtgctcaatgcttttcggcaaacactgttcagaccagactcagccgggcataaagtcactacttgatgtccagcaaaactcgtttgaagacaagtacctggggttgccgacgccagaagggagaatgaaagcagacagattccaatcaataaaggaaaggttcttcaaacggttaattgattgggcagagaagcatctgccaatggggggcaaagaagtgctgattaaatcagttatccaggcgctgcccacgtatatgatgagtgttttcaagctgccg

SEQ ID NO: 57863 - DNA, 779 bp, Oryza sativa
attcctgcagccctgtttttggagatatatgtaatgtgttatgtcatttcctgttaaaacattcatatggtgggatgagcctgtatatgcatgtattgtactatttgaggcattttaataaagtgcctaaaaagaaaagtaaaggcattgtcaaaaatgccttgaaaataaattaggggcatatgttaaaatacctcggaagaaattattggcacaagtccaaatgcctcaaatgtgcctcaaatgtgtttaaatgcaatctaaaaagtgccttcatctatacttatgaaggcattttgaaaaagtgccttaaaatccctttccctacaatagtatatccaacacttttttaagtgccttctttaaggattggaggtatttttttaagtagttgaggcattcttaaatgcctccgaatccttgcgattcggaggcgccggcgtcttccattactggtgcctccggtatggctgtccccaggtgattggctgggcgaagcgctggtaaccaaacaaaggcgccgttattcttggggcattggcaagcttgtgtggccgtgcggcgacggcatcgatccaggcccgtgcaacgatcaagatgacgatgagcgccgtacgtccagaactgcaacatcgacgatgctggcaagttcttctttcttccgattttcttaatttgctttttcttgcagatcgataatgcatgcatgtatactctttccttttcctaatagatctatctctgttaatagcagaagaggatgcagacacgtatatata

SEQ ID NO: 57864 - DNA, 2261 bp, Oryza sativa
acaaaacacatttattagtaataatagttttttcgaggtttattgatttatcttatttagaccgtatttcttgaaaaaaaaactatgctttcattttagatgatgaagtggattgtcgataattgctcacagagatgaattaaatattatataagatgatgttgataaatagcttggaaataatatttgagagatgtccattaacaaaattttagaaaaaactatatttttgaagattgacacaaataatccaaatgatatctagcccttaataagtttaccaatcataggttaagacaaatgcccgagcattcaagtgggctacttttctagttgataaaataggagcgtaacagcacctgtaaaacagatgtgttgtatatatgtgcaaattgatgggagatggagcacactacaccacagcaccaaataggaggcgttgtcatgcgcatgggttccatgcctttgaaacataccttcatggtatatcatataggaaactattctaatccctcgaggggatgtttcctcgtttgtttaaaaaccatttaaacggttatgaaaaattatggaaaaatttgacaatatttatacaacacatatatacaactccacaaaatcttaagtccaaactcaactcacacgtcgagatataaaaaagataaattcagcgtatgaatagtagagtactgtttatatctaaatttgttttttttttctcgatgtgtagatcgaatttgaacatgaattttagtggattagtaggtatcattatgctctacaatgtcaattttttttcagattttttcataactatttgcatcgaatttggaagaaaaaggtagacgagaggatatcccctcgagggattagaatctactcccatatcatatatatacttatcaacttatggatggaagggatccttcggaacctcgtctattctatccaagataacacagctgtggcagataaattctactgttttgcagcgccatatttacacaccatcatcatcttgttgctgccatcagccatcatatatttcacaagatacagtagggtggcaccatcaaacaaaggagcagtgcaataaagttttgctagagagctacttatcattatcactattacaggatagattttcctagacgccaccctattttgtttacatgcggtccataaatagaactgcatgaaaaaatagggaaccagcaccgagctgtttttcacacgggaaaacgcattatcccgtgcgggtggcttaactcacctgcacgcgatagctcatccggcctctccctctcaaaatttcaaaaaaaattcatcctctcaactctctctctctccttccccaccacttcatccttatcctcttctcactgcctcatccttatcctctcaactctctctctctcccctctcctctcctctcatgcgcgggccagcaggcgcacgggtgcggctcgacggccggcgcgcgggcggcgtcggggaagcttccggcggcagcggctccgtgccgagcgcgctggcggcggtggaggcgctgtcggcgttgggggccgggagagggacgcggtggaggcgggtgcagggagtcgcgagcggcacggagcgaggcggccggcgcccggatccaccctccgccgcccagatccggcggcggcgtccctctcccacccttccccacacgagggcgacaacgacgacgacgacgaggcgggagcagcggcggctctcctctccctactttcgtggggcggcagcgaccgtgcgaggcggcggagagtgggcgtggcggtgaccggtcgaggcggcgacctggcgggcgcggcgaggcgactaccgggcgggcacggcgaggcggcagcggcgagcggactcggcggcgagtgggcggccgacgcgactgtggccgcggcggccgtcccccgcggcggtgaggggcgccggcgggtgtgctcaacggcgacgcgatcgggtggccgtggctggtcacgacggctaccgaggggccgtggctggtaaaggaggcgaccggggcggcctggctggtcgtggcggcgcgacgatgtcgacgatgagttgcggcggccggttcgcttgtgggccggcgggcgggcggcaatttttttaaatttttggttttttcgattccgtgcgggtggtataatatgattattccgtgtggtcctcctgcccacacgtgaaaatactaattttcgcagacaacggtgtgcaggtgggccaaatgaccg

SEQ ID NO: 57865 - DNA, 9595 bp, Oryza sativa
tgagttacttattagtgtatattaaggagaagaaaggagtggataagaacccttacaacaaacacaatagaccttacacgagacaaaaaaaaaaaaactgcctcagcctattacaaaatcggacaaaattggacattcttcacccccaactatgaataccggatgaattacccccctcgaccaaatccacggtggttttggtctacgtggtgtacacgtggcagtccagtcagcattctatttataaaaaaaattgtgggacccacctgtcatacactactctctctcactctctcacttctctctcttcctctctctctcgcagccccatctcacgggtcggcggtggtgggggacacgagtggcggcagcggcgcgtgaagtggaggcggcggtggcgggggatggagagtggcggtggtggcggcggcggcgcgtgatgcggaggcagcggcggcgggagatggggagctcggcgcggcttcccccctccctctcggtggcgtgcgggtgggcggacggagctcggcgcggcttccctcctccctctcggacggagctcggagcaggatgtgatccgatcgcctcgccatcgtcgccttctccggcgcgccgtgcggagtagcagctggcacgagcggtgccggccctccacggcgggagctcgtcgcggcggctgcacaacctgttcgtggcgacaggagcggtggccgagtcgcggcggctagcggagctcaacaactacgcgacggcgcgggcgcacggagctacgcgactaccgacgacgacgcacccgagccggtcaaccccgccgcccgcagcctcgcctcctactcgggccacgccatcgctgccaagaggtcccgccgtatcgtcggctgcgatggcgagtaccaccgccggcacccggtccgtggcatctcaaccccgccgcccgcgcgccgtcgccatctcccctcgagccctgcccgtgtcacgcgccgtcgtccgtcgcgccccgccaaccgcctcgccgccgctgccacctcgactcctccgccgcaccccgccgctgccgcctcacctcctccgccgcaccccgccgccccatcccccgctcgccgcctcctctgctgccgtgcgcgtgtgagacaaagagtgaaagaagagagagaggaagagtgagagagagaagagagaggaaaagtggaatatgagtgatgacatgtgggccctatattttttaataaataaaatgttgactggaccgccacgcgtacgccacgtagaccaaaaccactgcggattaggtcgaggggggtaatttgtccggtttacatagttgggggtgaagaatgcccgtttttatgatttagaggggtaattcggacaactgcgatagttcaggggggtaattcgtactttttcctttctattaatgaaaatgaaggtttgccctttgctaaaaaaaagttcccaacattcataaatctccaagcaattaaacaaataagttttttttaaggcacaggccgcttccaaaacttcttgcaaattaaagtggaaaaaaccatatgcagaagaaccagtactatctggagcaaaagtcctagagctaagtaatgagaacaatccattattcatttctcgtaataccaagtaacagtatgtcacatgaattcttctgtttagcacaaactgtacaaaattaactaaatgatgaacagtcctagctaacaggtaatcacgtgcattatcagttcatcacagaaaccgagaggccaagacggtttgctactcatggatgtagaaggaattaaaccaaactctggtgtatatacatgaggaagtttctcttttttaatactccctccgtttctaaatatttgtcgccgttaacttttttaaacatgtttgaccattcgtcttattaaaaaaataagtaattattaattcttttcttattattttattattttattcattgttaaatatactttcatgtatacatatagttttacatatttcacaaaattgaataagataaacggtcaaatatgtgctaaaaagttaacggtgtcaaacatttagaaatggagggggtatatcgttcctcttcgtctgttccaaatgaactctatagattcttctgctatttgtttctcctcctatctccaaatctaatttgaaattgctacatcaaccaattatggcgttgtcttggtatcagaagtgtaactcatggcttttgaatatagctagaaatgaaaacacattatacaaaatcagcagaggaaaagaaggtatatgaaaaaagaaaaaggctgcctactctacatttaatagaaaattccctctaaaatttagggaatattacgccattaattggattgttttgattcgttcaaacacccaaacccttaacctcagtatcctcttcttcttccctacaccgtcgccgtcagccgttggacatctagatcatcatcagagcgggaggtaaggtgttgagacatgaatcttagaatagatcggagagtccaaaatctgcaagacagtgagggggtaaggagggatttttttttttgttgaatgaaggttattatcaactagcagctggaaaagaaatccatgtattaccatacaaggacataatgtaaagcaatggatgaaccaatgcttaggatatttcttgaatggctgctagagtatctccttcatcaaaactggccaatgaaagcctagtacgactcaagcggaagtgttcagttatgtaattattgtacctttgaaactgctagccaagtgtaaacgcacacccttcaacagggaatgctttatatttgtacttttggtcctgttaatttctgtcacggtgtcacctcacatcaaatcagaaaacgcacacccttcaagagggaatgctttatatttccatatagagatcggcagtgttccaaaagtccagtgttccaaaatcaatggccatcttcatcggatgcatctgttcacttgcactcttgctgctctgctcccatgtattccagcttctctcagacgctcgccgccctctcccaccgggcccgaggccgcttccggtcatcggcaacctcctcgacgtcgccggtgagctcccgcaccgctcgttgtcgcgcgtcgcacagcggtacggcccgctggtgacgctccgcctgggcaccacgctcgccgtcgtggcctcctcgccggccacggcgcgcgaggtcctgcacaggcacggcgccagcatcaccgaccgcggcacgccggacgcgtggcgcaccgacgggcacgagaccaactccatcttcgcgttaccgacgcgccaccaccggtggcgcgcgctgcgccggctcggcgccgagcagctgttctcgccgcggcgggtcgagaagcagcgcccgctgcgccgggacgccgtgcgcggcctcctccgccacgtgtcggagctggctgcggcgtccggcggaggcacaggcacggcggtggtcgacgtcgggagggcggcgttcgcggccatggcgaacctgctgttcgggtcgctgttctcggtgggcatcgacgccgcgacgtcgtgccggttccgcgacgcggcgcgggagttcgcgctgctgacgctgacgcccaacgtgtcggagttcttcccggtggtggccatggccgatctgcagggccttcggcgaaggacggcgaggcacatcacgtggatgtaccagctgatcgacggccatgtcgaacggcggatgcgtggccgggaaacagccggtgcgctcggggagaaggagaaggacctgcttgatgtgatgctggacatatcggagaaacaggagcagagtgacgacagcctcaccatcaaccggggtgtgataagagcatttttggccgtaagtatatatatggagtatgggcctatttagttcacgaaaagaaaatttttgtgtcacatcagatgtttaatcggatgtcggaagggtttttcggatacgaatgaaaaaaataatttcataactcgcctggaaaccttgagacgaatcttttgagcctaattaatccgtcattagcacatgtgggttactattgtagcatttatggctaatcatggactaattaggctcaaaagattcatctcgcgatttccctcttaactatgcaattagttttttcatttatctatatttaatgcttcatgcatgtgtctaaagatttgatgtgatgttttttggaaaaaaaatttagggaactaaacggggcctatatcctctctctctctctctctatatatatatatatatgtacgtttttattagattatacagtttacttgtaattatcttttgactgtatgtcatattttaaaattttagtacaaatatgccaaagtataaatcatatataaatttcttttaatatataacaaaacatgcatgttagaataaaataaataatatttatttagcttttaataaaacgaatggttaaacgtcgtataaaagggtaacggcgtcatctattttaaaacgggagtacatgtttttagtgatgtttttccaatgactttacacctttataatagttaatcctttcttaacatattataaaaggttggataattcatcaccctttgatcagaacagaaaaaccacgcacaaaagtaacttttctcactgcacatatgttctagaaagaggcaaaaattgctactgagctataaacaacgtgatgttagaagacatcaatattaattaatcatggctcttctacatgacagtttgtcgcttcgtagtcactaaaacataatgtgtggacggaagcctgtgaccccggctcactagagtacgttatctctaacaaagctattttctaatttttttataactatttaggtcatgaaaaaaaagattggaagagcgaaaacactttaaaacaaactatatttcatgcgcaaggtgatttctataatcgtctgcctaggtttttgtcaagctttaaatattttctctgggttggtctattgcacgtggatgtgttttcaatactcctacaagtttgttggggatatatatttacatatttatttaaaggcaaattttatgggagggcatcacggctgctaagcagtttttgcttctacatacggtaagagctgatctttgggaacgtacttttaaagtatgcatggttatttactactggacatcgtgttgattaaaatatttatttttatttaataaaaaagagataaatagtgtgaaaggacaaatatactagctaaatgaccaaggccagtggcatatttgccttttgcaccgtttttctcttctattcaatcgaaaatgaatattttgatcaatgtggtattcagtagcaaataaccatactttgaaagtgtattctctaaagattgacttttgttgtgttcaggagctaaaactacgaaatcatgatgccttttagcaaaatttgcattatttataatatctgctaatctctttagatatttgttagtaggcacacgatgatatattaattcttatgatagaagtatacatgtaacaatactagtttttcttcagttgtaatggaaaaaaagtgagaacgccatgggtgacatctatctcgaagtaattgtgcacaatatgttaagatattcggtttatgatcaaaattacttacattgcttaaccaatttcaggatttactaacggcgggcagtgaaacaagctcagctgtaatagagtgggcaatggccgagctacagcagaatcctcaaactatgagaaaattgcaagaagagctcaaaaaggtcataggctcaaaaacttatatagatgaagaagacatcaaccaacttccctatcttcaagcagtcatcaaggaaacacataggctacatccagccataccactgctaatgtacaaagcagccgtcccagttgaaatacaagggtataaaatccccaaagaaaccactgtggtagtaaatacatgggcaattcatcagaattcagaggtttggattgaaccagacaagttcataccagagagattcctacaaaaggagatcagtttgtcatcaggtagtaccaacatggagcttgttccattcagtgccggacgacgtttctgcctcggatatccggtagcaaatagaatgctgcatcttatgcttggctcgctagttcatcagtttcagtggacactgcctgaagtagtgaagaagaacggtggcgtagacatggcagaaaagtttggactaacactgtctatggcgacccccctacatgctatagcaaagaatattgtgtagtgtgtaatttgtgtaatgtattgccgaataaaatatgtcatttgtgctgaaatataacatggatttataaatttttatacgatgattacaaattgaagtatctgaaattaaatagggaatgattgtgattgattaaaatgaaaaaatgtaagttgagaaattaaataatatatgattgggattacttaagatgagaaaataggtggagaagttattatattttaaaactaataatagataatattattacttttacggctactgttaccacaactcactactagaaaaacgatttttaccgatgttggccttttatttttccatgtggacaaaaaaaaaacctctcttataatcgtttgcgaaaatagctaaagagtctctagatttaaccccacctacaaaaatttgtatgcggacctcttaaggggtccgcctagaaaattttgattttcacaggcggaactttatgtggtccgcctgtaaaaatcatgctcgtaataaaaatatctatgtcacatccttatcttctcctccaccatccttatcctctccactactcatttccctccccccccctctctctctctctcacccctagccgatgcgcatcggcggttctgaggaggtcaaacgacgactgccacgacgacaacggcgccaacgcctgggtcccgccaccggcagcgatgacgacgacaacgccgccttgatccaccgccagctcgccacgggtgcgcggatccgccacatgccggtctcggggaggggaggggaggcggcggcctggctcctccctctctaggcgatggtgtggatcagcgacgaggaggggaggcgtcggccacgatgaggaggtgatgaggcgatggctcggctcctccttctcccggcctgacgacggcagagacgaggggggccagtattaggttggcaaaaaggagggaggtggcagcggtgctccaatcctccctcccttcctcccggatccgtcatctggcggtgtaggtgaggcggaggagaagccgatggcgacggccactgcagactgggctggcccctcccctcccagatttggagggaagagaagagccagcaggaggcggcactccccttggtcagcgctggcaaacggaggagaaaagccgttggttggagggggaggcccgcggtagtgccgacgggtaggggtggtggcggtgtatttgtttttgttcgttgaaattattttcataggcgggtggatctacctcatttgaagatggagatgccacctgcaaaaatgattttcgctggaaaaatcatctatttttacaagcctttgcgtacaggcggtcctttccctcgcctggaaccgcctgggaaaacgattttcctagtggtgactactatgaggacaaacgaatactaccaatgccaccattactacgagaacctaccattacctacaatcaccaccaccaccacatcactactaccacccatcgccaacctggtacagcaatagcgattgccactattacttatgtagatattatagtaacacactgataaccacaaacttaaagtccatccaaataatgcaagtttaatttgcaatctcattccactaggcaacaaaacaatattattagtgtagttctttctaagcatacggacagaacaagagagcaagagccaaagatggattgattgggctttggatgggctaatgatggtgaacactagtgtagacaaggccaataccatggagcgagaactatagtactacaaagtacacaagttacggagcaaactgatagcatgcactactagaaaagacgtttttgcaggtggtcaaaatacatttttgcaggcggataaaccttccacctgcatctaaacgacggtaaaaatcctcaatttttataggcggaccaaagcacaggcagccgttgccatcttctcaggcactgcaggtgctacagtagcccgcttgcgaaaatactcatggcgcccaaaaataattttcccgccagccccaccccctccgtaggtttgaaatcacaaattcttacaaatctcatccaggaaaaaaaatccaatcacaaacatccattcatcaacacaaaacattggattcaaatccacagcaatcaacatgtaaacttagaaaaaaaaacaacatcatcgtcgtcaccggcgaactcctttgcatgcggtggccgccgccgccccctccccccatagaccggatctgtgaaggagggaggtgtccgcctgttgacagaaaacacgaggcctaggagatctgcttaactccagtgcaggtccaaaacttgccttcgggtgtgtaagcgtgccaattgatctgatcctgtaatcaacaagaaatagagacaaagaaaccataattaatcctataaacgatagccgatcggctaggtgccgatgacatatcatttatctctgagccgatgtcatatatgtatcgatcggcattcatgaacaaataagaaggaactaaatctactcgatcggctgtagatattaatgatacatacttcctatatcgatatatacttaaatcaagtgattgggatagatcggacgccatgccgagacagtataaatcattagatcgaaatatatattaataatggaactatatacattcatagcatagccgatcaggtagatctagcatgtatcggctaatactccgatactactctatattaagatattaaagcaagtagaatatatcaaacaaaagcctaatatacttaactgcaacaagatcttaatgtaaagggcggatttaacatgtcaatcatgcatatagaataaaagtagttaaatcaggtaagatcggctgaaaccctgatactactctaatcggcaaccagaaggcaggctagaggttgatattctaagcacgacttaatagatcaaactcaactgatgcagcattaagtatgaaaagaagaacaatatctagacaatcaagccgctggaagtttcatagagtggtggatattttatataatctaaatcaacgtcgagatctaacctaatcggctgtactctaccgacagatgctagccgattgtaagttagataacgatattgctagagattatataagatatttgataactcgacggattacataaacaagattagagtatcataatgatggaagcactaatcccgataacgcaaaccgccataacaagttttacctcttgttgaagatcgaaaccgatgcagctcaaccggaaagcaagaactcgtcgaaataaaactaaagca

SEQ ID NO: 57866 - DNA, 1236 bp, Oryza sativa
aattacatagaatatccgaattagtagatacaattgccttctcaggactctatccttgcatggcaattaccatgaagcacattaactcaacttgatgatgtacaccgagtcgtattgttggaatcggctgtatcggctaaccccgtccgactcaaactctgccgatcttatcgtagccgatttggatggcagccgattcttgctctgttttcgcaacagtctccgtcttggattcctcttcgatctgaccttcatccccgatactgaggttaccaaatttggtcgttaacacatgccccccaagtccggaatattttggtaatgtttcggatttgccatatccatttccgagagaaactcgcacttgccgtcttcccgaccgttatcgctccgctttaaatactaaccgttgcccccgagaatcttcacaccgtgactcccgttttcaccgcttaagcaaattccgtcttctctctctctccggcgatttccctcggccagatctccatccgcggcgatgtcgacctccgccggtccgtctgctgcgccaccaaccaacccatctgctacaccatcagccgagtacgcagaggtctgtatccactggctacatccctttctcttatcggcaaatcgattttctcttgtcttatattgctttcttcttctcggtcgctttggatttgtagcacctctccaatctagtggcggttcccagtttgctgcacgactaacaatatttccttggtccaatcggtaatcttgaccccactgaattcatcatatccgaaaccaatagaacccccttcaggtcgaccaacccaaacatgaatcattggaaaaacacctttaaatcctggccttctcttgagaaaagctagcctgcatggtacaaacggatgtcggctagcaaacaagctcattgggacgagattggaatcagccaagccttagccctcaccatagcaaatttggccaaggacgaacccctgatagctgctgccacctatttctggtccaacacccttaatgcctttctcttcaaccaagggccaatgaccccaactctgctggatatcatcatgctcaccggtttagatgtgacctcgtcggccaaccccatgaacttgaacaccaagagtactttcgagttcaagactaagagcattggaggctggtcaggatacattgcagcatacatgggcaaaggaccagttaccccaagagagcatgtag

SEQ ID NO: 57867 - DNA, 4925 bp, Oryza sativa
ccaattataaaaaagataagtcacgcataaaatattaatcatgatttatcatctaacaacaatgaaaatactaattataaaaaaatttcatataagacggacagtcaaacgttggcacggaaatccagggtttgtctttttttgggacggagggaatagcagcctagtttgcatcaggcataagcccatctttgctagaaaaatgctgcatttatacatcagacatacaataattctgtacaagttggaatcctagattttgaaggacgcccaaactttcaccaagtagcccaaaatcttgatgtcgctgaacatctgcatcatgctatggtttgtgttctttgtcctactcgtttactcatctgagtaagtgtcaaactcaaactgttgctcacctttatcagttgatgctgtccttctcctgagaaagaactggaacagtgtaaccgcagctaccagggctatctcagaatggtctgaagtgctagtcttgacgcagaagcggcctaggttcctgctgtttaggttagcgctgactgagactttcgatccgcggcccattcggaagtctgactgaagattggtgctgattacagtctccttctcgaacgacagagcggtggctgcgactgtgatgctctcttccctcacagggtaatctttccccctgaatgtcatttccaggccacctccatgtgccacttgcccgcagccaaccatcctcccagcattgccgaccaactgaactcgtcgcccgacagtgatggaatcctctaatttggcaccagtaaaatacttgctaccgaatttagtaatggaaatgcctcctccagtagtgttccagggcaaattgtggaacctggcatccccattgacagtacagaccagatccttatttgctgtttgcatattcatgctccctatcaaggagcggccattcttaccgctgtagcttactgaacattctgattggatatacaggtcttctttgtcctttctcatctgccccgcaattgatgcagtggtattcttttctaaatcttgagatacttcaaaattgatcccatcaaatccaatatcatggtcccatccttgtggatctaaaactggtctgaacaccatatcatcagtaataaggtaacggtagcgatggactggataatcagagtcaaaacttgacggaatttcatatctgacatgtgcacaacctctggggacacgctttcttcgtaatcatcaccaacagcatttgatgcatcaacattttgagcttcaacaagcttttgcctcctaattccctccttccactgtttctttaggtacagagtttcacgatagtctagttcatcaagatatgcagatctctgttcttttgacaatttttcatattcagatttcttcagaacacggaatggcggtagctgatcagattcatcctcatcatctgacacttcggtcatgtcaatgccaacatcttctgatcttgatgatggattaggtttaaggagtgatgaaagaagatgaggcagtgaaggcagtctggtatttgcttgtgacagaaggaagctatcttggaacttaagcaaggaatttgcttctgccaacaacttggtcgccccacatagcagtaaaagttctgatacccataccttcccattaggtaaaactctttcacctttggtgttccgtcggcacattggatgattgtcaacaagaactacagggttctccatctgtgtgttagaagcagccacctggatatgacgctgcaccacattcttgcaataacgggcataggagtcatattccagaggataaccatctggtccttcaggaggagatgaagagcagtgagtcatcacaaggacagtgttgaaccacatcgaagaacccaagatatcagttatgagcttcaacagcgggtattcacagtatctactgttaatatggtcgagtcgctcgaagtacaagacgatgtcaggtggtgatcttttaatgaagcgcttgacagcatgtaaaatcttcctgttcttcctctgtctatggtaatgaggcaacaaaccaggtgtgtcgataactgtaactcttattcctttgattgttccatcaatcctccttatcctttcagtagcaggagctaatgcattggtagcaacctttggttcatcaaaaatggagtttatcgtggcactctttcccacaccagtctttccaagtagaagaattcgcaagggcaggtccaaatcaggtccacctggtgcttcttgctctgctgctataactctggctttgttgatagcaaggttggttctcttggaatctgattcgccagctttaatcaagttggcaaggtgcaatctgtacagtacctgtgcgacaacatcagtagtgggaggcactccagttctgtgcacaagccgcaggaacttaatttgaagagcctcaacatgctttagtggatctgactttgtgctatcatgatctggttcataagatggactggatgtgacctctgaatctgatgcgcggatatcattagatggaaatctattggcagacacagtttctacaatctcattttgcatcacgcctgaatcacaagatggaataagggggcattcattatagtattaacatgagcataaatcaataacaaatgtgtcctaaagaccattctattggtaacatgaatgaccaacaagtaacagaatgtcctcccagcaaagcaaatgcatccacaccaatttggcagtaccacagcatataaattttcatcaagagcatctattggtactgggtaaactaatgaatcatgacacaaggccgtgctccaccgacgatggaaaaaagattcaatcctactgaattcgaagacataagatttcctatttcctaatcacaatagggcaacagttcctggtagcacactaatcgaccaccaaacattatacatgcccagaagaactagtattagcgaaaactatcacatatatcatgcaaaggcttgtaatgagcccctgcaccatttagtgaagtccaaaattttatcaatcagatttcagacttcagaggcaatactgtactcgagcaacatcagaaacatccaacaattatcatgcagcggcagactcgaaaacacatggcacagcatgttatccctttcagaacaagaaagaacctaaatagaatctgaaccatggaacctgagctgcaaattctaatcaatcaccataccaaactactactatcactaatcatcatcatcatcatcaagtaagtaagacagagagagtgcctaccatccccatcgcccccgggctgggcggcggcgccgtcgtggtgggcggagagcgagaagggcctcgccgacagcaccgacgagccgagccggtacgagatccagtccctgaagctcatcatcaccaatcaggaatttccacccaccccggctgcataaccagtaccaaaatcctcatcacctcgaaccaacccaaacaaacaaaacagaaaataataattaaaaaaaaccccaatccccccccccccctcctcgaattgaaggattcgatacgggaaccctcacgctacctggcctggtgggaggctcggagcccgcggcggcggcggcggcggcgagggggatgcggatgatggtgtcggagggagttggttggatttgggtggatgagaggagagagtgggtgcgtcggtccaacccagccggaaacggacagggtcgtccgcggcggcgagcgcccggatttgtcacgtctgcgagtgcgaggccgaccgggagatgggggggtcgctgacaggtgggccccagcgatcggtgcgagggtggttattccaggagtgcagctgtgcaggtaatcatagagcaggtccaataagcattttttttgccggtgataatacggccacgttggattctttcatgacctagaacatggaacagagattagaggagagagagtgtgagcccgcgactaattagtcgccggtttcacacgtgctccaaggcgagccaaattgaagtagcgctgctgcttgtcccccacaatactgctggactcataaaaatgaggcagagcgtaggtaaggcaggatgtcgttgaggcttcaagctcgtcggcaagcgactgtggctaggaaggaagcttggcgagcgacacgatgatgactagagtggcaagcttggggacatttcaacgatatgaactgaagcggctggtgagctcagggacattgatcgccccaaacgatgactgaatctggcttggtgtagatggcaagagaacctcgaagaggttgagcagcttgttcttgtgcggagttaagacgaggtcgggaggaggaggattccgggattggggtcgtcagtcgtcaccactccggaagaggaggtagtggccgcaataccagatatcttgacccccctctccaattattaaaaccggtgtaatttaactcccttagtggttttggaggatggttttgctgatgtggcgcctacgtggcggtgttgacctagtcttcgttcgacatggagttgacatgcgcttatttggcgttagaaataaaaacatatgaattggacccatttatcattaacacaaaaacactgtgggacccacatgttatcctctctcctccccttcttcctcctccgtccctccctcttatctctctttctctttctctcctctttctcttccccttcggccggcggcgggtggcgacaactggagcggtggtggtgggctttagtgacgacggcgggcgggagcaatgttggggggctggagcgacgtcggcgagtgggagctgctattgacctcaacgtgttgcttcgtcttggctcgtccgcgtccgttattgcacgaatggacaatagcgccccaagaagctcgtattgcagtgtt

SEQ ID NO: 57868 - DNA, 3776 bp, Oryza sativa
cactgcaacaggagcttcttggggtgctattatccattcctgcaatagcggatgccgacgagctgagacgaagcaacaacacgttaaggtcagcagcatctcccgcccgttgccatctcttccgcccccaactgtcgctcccatccccccccaccgtcgctcccagccaccacggtcgctcccaccccccaccgctgctctagttgtcgccactggcctaaggggaagagaaaggagagagaaagagaaagagagataaggggaagagggagagagagaggaggaagaaggagaggagagatgatgacatgttggacccacatgttagtgggtcccacgatgtttttgtgtgaataataaatgagtcccacacatatttttttaattctaacgtcaaataagcgccacgtcaacgccatatcgacaaagaccatatcaacacctccacgtaggtgccacatcagcaaaaccgtcctccaaaaccgttaagggagtcaaattataccggttctaataattgggggtcgagatatctagtaccgtggttcaaggaaacgaatcatattcgccaaccacttaagggagccaaagtgaacttattcctacaagaaagtaacaaacagcacacatcatagaagctcatggaagatatatgggccacaagcccaaacattctgaaaataggcccaagtacccaacaacagaaacctgaaccagaatttatctttgttttttttccctggacaagtctaccagacagcccaatgttattattcccggttagagttaacatgaggagaaagggtagataaatttacaagagaatccgcgaatttcataggagtataaagcaagatattttcataaattgaaatattatcagtccacagaccagtccacacgagcatgcaatgcaagtaaaataacaaacatgatgttggatatattagtcttctctttcacaatggtggttcttgtataatggttttgaggatccttctttgtgaagcttgaaacaggacttcatcaatttgcatctattcatccttgtgcttctaatcatcttcgtctgatccaggttcttcaaaataatacaaaatatcactacccattttttaatatacggcgcagttaacttttttcctgaaactttgactaacaatgtttattcaattacttagttaagtgaagtgaaacaagtacaactaaatctgccatcaaaatcactttaagcatgtcttgtatgtttgtatatttgcacaaatatttctaaaaaagatgaatagtcagccgaattacaaaagtcaattacattatatatttaaaaaaacagccttcttcggaagcatcagaaagatagcagcatctttattcagttattcttactccaactaatgaatctttgaaattctgacatttaatttgcattatcatagccttcttcggaagcacagaaagatccaacgtcagctttcttggtagtggtagctgaaataaacatcaaactgtgcacctatgacatttatataatgttccaagagcaaaacaaattatagatacgatagatacctctctgatggcatcagtcatgatggttcttccaatacctttaccgtgtgactaccacgtctaagaaaaaccacttaaccagtatacaattcaaaaatcttcaacaaagcatgttagcagaaatagtttcacatggaagcatttagttcccattcttttttctagtcatttagcatttatttcaactcatggtgatgacagaaatagctgcatcacagcacatgtcataatagaaaaaaagggaaaaaaaatgaaaagatatgtttcctcattgttttggtaaacgaattgaaataggtcatcgtaagtgctgaataaccttcaaaaaatactactagtaatcagtaagatgtcacattatcatatttttcaagtgctttttagtgtctttatccctcttcatgccatttgtagttatgattttaattgtaactaacattatgtaaattcttattttagattcatgtggcaaccatagaaatgacaactgcaatctgcattcttagatttctactgttggtacaatttgccactggattatctacagatttatagagtttgaactgtgaaggcaaaaactataaatcaaacaacatatacagagagaacattgactttttattgagaacattacctctgaaagtatcagctagtgatactctgtttgccaaggtcatcaccaactcaactaaagagcaggtgtatacacagtgtcgtggcgacactgatattagtacctgtaagaggtgtatcaccaaggccattaaggacatacaacaagtatattcttcaaagagggatagtatagcattttacaacttttgccacctcggaatttctggaaaagattttaagtttgatattcaacatgacatggaaaatatagctttataggacaaccctggttatatcagtcagggcaggtcgtttagtgagacagtcatgttatttgttgatgatgtggcaagaaagataacagacctatcaaaaagatttgctacaggacgagagaaggtcctagggaatgaatataactacaccatattcggcctcgcacagtgctcacctgagttaaacagtttagagtgcaagatttgtttggagatctagcctctagttcgcattttagtatgtcaacaggtgggacaagagcaacaatatggtgtaacttgcgttatgagggatatcctttcttcacgggccctccaatgttggaccaactcatctatcaagctacagtcaagcctaaaggtatgagatgcaaaatttatttatgtttgaaagtttatttatgcatgatactctattgctatacattgattgaaatatttttagtttacattcgttcaaaaggtactaggggccctacaattttgctttcatttttggtaccgaactcactatgtgttatattagactcattccgtgtttaaaagtatgtttatacatgctgatctattgccatacactgattaaactattgttagtttatattggtttgacactatctactaggggccttggtagtataccaaactcaccgtgctttatatttacattcttgtttgtaaatagatgtgttattttcattcttgctaatgaaattgtaatacccattaaattaacaattgacaatcacatgcaggaacaaatcataagaaccatacaactattctaatagtggctatagtggtgccgagcgttgtggtaatcatagtagtcctagcaccactatttcttttgaggaagaaacatgtactgaagaaacgaacaaagctctcgagtaagcacttctaaaagaatgaccaatgatatgtactatatatacttcaatcccaaatagaacttatgagcattgtttcacatataggtgtagaactatctgggagcaaaaatattgaaggctttgttgattctagaggtgaaaaagatgcagaactaactgagagcaaggaaattgaaggctttggtgattctggagatgaaaatgatgcagaactaactaggagcaaacagattggagactttggtgattctggaggtgaaaaagacgcagatccaactaggagtaaagagagaaggtcctagggagtaaatataactacaccatattcggcctcgcacagttctcgcctgagttaaacagttcagagtgcaagattttctaaggctgatcttgtacccgctcaatgtaactagaggggtgc

SEQ ID NO: 57869 - DNA, 10753 bp, Oryza sativa
tgttattaatgcaaatcctatgataagcctgtacttattcttaggtttatagatgtttctactacaaaaggtattattgttgttaaaactgaactacaagcttgaatggcaaatatatatttaaaatgttagactccttattcatattgtgtgataatgtatatgttaggaggactcaaagccaggacagagccgcagaggctcctgagctcatgatgcttaattttcggacaactaatatctcaaaaaaaaaattcctgtgagaagctgacatctcaattgatgttctttctactgtgaatacaagttaatagtttcatgatttaaaaatgagcatatatatggttgaggaaagaaaaaactaactacatttagcaaggtatgtggttcacactttatagatgaatactttttattgcgtgatgggaaataagtactcatgctttataccttattcagaaccgagagaaatcaagcctgaatgccactgacttggtttgttaccaaatctagaagaacaactttgattaaagaccaggttggcgtaatctcaggtgaactgaccatggagggctgaaagcagtgatcaatagtttaaacacattttctgcaatggtaaagcaaacattaagaggaagaatgctgaaagggaaggaagacagtgataacttgaaaggcactatctccaactggtccagttccttatattaattcatactactccaggttatggactgaatctgaatcttccaaggaaaaatcatcaatggagacatagtattactgcatttcttcttggacttggccaggagcattcttttcagcatgttcttcttggacttggccaggagcattcttttcagcatgttgttcccctaaattctgaagaagtacgttattctcatgctgcatattattcttttcagcatgttgttcccctaaattcaagaagtacattattctcatgctgcatatttggtatctccatatgcaaatcctcaatttgctaccacaaaatgggtaaatcctcatccataggaagaacatcagtgaactcccaattaagcacagaagtgtgcagagtccatgactctccattacctcccatattaacaggattttccataacaattcttctaggcacttcactagggtctgtataaagacattttgccagaactctgccaagaatactatctctttgatgccaatggattaacttcccagaactctgccaagaacactattttgtgatgccaatgtataaacttcccaaaagcgtttacaatcctatgaatgtgagtctcatttatgtaatccgaaggaatccctaaaatcattatccaactctcctgattgaagggacagtttctccgataggctaaattatcaggtcttataaagtgtgcttggaaagcccctttatttagcatcaaatgctggccggctatcaaagtatccctgtgcaattcagaaggaacttagatcagacataaaaagtggaaacctgagggcgcagaggacatgcatgttgaactgattgttgatggcgtgcaccacttgatggatcagttgcaacattttatatatgtaacaagatccacctcaaccgtaattctgaatagacttaatgtttgttatacaatgtataatttccaactaaacaatttaaataccattattgtgagtaactaaacatcaattttacaccaggtgggactagggccccagtcaattttataccgagcgggatagggggtcttagcgcccagttacatcgagcgggtacaagatcatagaatattcaagttgctactgatgtagtctatgtcctattaaagaaagttatactctctaatagaatttttttgtgtatcttaactttggtcttgagagtagtataatatgtcgatagtttacagggataagtaaaaaatatagctgttttctcccacctatcgacccactcaaacttggtatagaggctagatcttgaaaacaaatatgaaaaaaacggttcaacttagatgagcattgggccaaaccataattatagctatattttgttagcttctcttcttgtgtggcaaatcttcaagataactttgttactttctttgacacattagtagcgataagtgtttctttgacacattagtagcgataagtgacataacattcttgtttagtaaccagttataaatgtcataaaactagttcacaagtatagataatatgttcattgcatgtaggatactaaattgaatattttcactaaaaattgcaattctaagactacaaaagttgtaataaaaaaattcaaatacttctcagatgactggaaacaatattagacaataacaatataagactggatacaaatataatataagacatgtttcctcgactggatacactaacaatacacaaatacaaatacaaatacaaatgtaaatagtttttcgtcataaataaaatatttttcaacagacagtgaagtgagggaaataatgtattcatttgttgtttcatagaatgctaatggtaaaggattacaactgaccatgtttatgtagaaaaaatatctcaacactaatatgacttgtttcttgaaattaggtgtgtaagccgtgtaaacagtttatgtgtcatctagacaaatgctttctatagtagctttgcaaatacactactttttagaagtacaataataaattttgtctagcaaacatgttccagtatagtctctaaacatatcaagtgaatcaggacattcgtaaaaaataatgtgatatttgttactgcggcatgacaaccatgagggccacgacatggtaacgcgatgcacctacagatgaatgtgctgcaatcctgtggctgtgacaacagctgcatgcagtaatcaagattatgtttttgtatcgtgaatagagatggcaacggtgaattcaccgtcgggggtcatgcccgcgtccccgccaccgcggtgaaaatatttcaccgtccccgtccccgtcaaccacgacggggctataatttctccagccccgatcaccacgcggtgaatttttccccgtggtgaacccgtccccggttaaacaatatattcacagtcacagattgtagtatactcaccttgcatcgtcgctattgtagctttaggggggaggtggctgaaggccgaagccatggtcggcagatggcggcggcgacggcagttcccattggcgcggcgacggcgactcccggcggcacggcgacgacggctcccattgaagatggctgcaggctggcggcgcatcgacggagcctgccggccgctcctggtgaagatggcttcaggcgtcgcgcggcccggcggcgcgtcgacgaaggcggccggcgacggcagcttcagtctcccggcgagaaggcagcgagtggcggtgcgcgtggtggctggcgaacggcgccggaggtggctggcgaacggcggcgcgcgcggctcccggcggactggcgaccggcgacgcacgtgactcggtcgggtggctggtgtggatctggatctggatgggtggaaaatttggagtttgacctgttgacttagggttagattatatatgtgtctgttaaatgggcttcaatattatgggccaatacatctaaaaagtctataattcctcccttgtacagtacagtcgggtcaccgtccccgcccccgtcatcccgatggtgagaggtttttaaccattttattccccatggtgagtagatattaaccatccccgtcacgtaataggtgaattcactgcggggaaacggtgaacgggccccattttcatctctaatcgtgaatggactaacaccaccatcatgtgcatgatttcctctgcaacaagccccagttttgccgtcactttccatcacgacgtgttgttttcaaccattagatagcttaattaagctctaattaacaatccactagtagtttcatattaaaaaaaaaacaatctatataagtcctccctccgtcctaaaaagactcaattcctggggtttttatgtctaacgtttgaccgtccgtcttatatgaaatttttttatgattaatattttcatattgttagatgataaaacatgaataatacttatgcatgatttatctttttatttttgtcataactttttcaaataaaacgaacggttaaacattagacacggaagcctaaaaattgatttttttttttacggagagagttgcacctttttcgtgagtccaatgaaccgtcagcatgcagagatccgtatccaaacgacccctagctactcaatttttaattatttcgagaattctgcccatggtttgctggcaaatcaaatcgcctcgaaagaaaaaaaaagtcatgctgaaaggatcataaggattagaaaaattaccatggaaaaccgagagtacatgtacatacagacggccccggtaaagaaagcggcggatgagtcgaccgacgacgccaggcggaaaaccagcggatcgtctgctgtttgtttctcgtcaaaccagcggcaacgtcccacaacatctgcgcgcgtggaacctggttctgctggcccttttgcaccatgcgccttcgcctttctgtatatcgcgtggtcccgtttctcgtggtctttcttctctatttttttcttaactccactacacttagtactaacagaacagagagtagtatatattcagtccttttcacttagggcttatttagggagcttaaaattctgagaaacatttgttgagaagctagctgatgagaatttagagaagctgggagcttattttccagattctataactacagattctcaaaatctgggtaaaaagctagattgtttggaaagcttctggcaactgaagattttagaagaagctgcagctgctataagctcccccaaacagactcttaataagttgtattacctcctcttcttttatattattcattttataaatcattttattctttaagtcaaaatttttactaaatttatataaaaaatataacaatatttttaacatcagaaaaaaatatcataactacatttttcttttctaaataaaaattttagtaaatttataaaaaatataacaatatttttaacaccagacaaaaaaactatcaaaacatgtttaatgttagaagtaataaaactaatttagtgatataagtattgctatttgtttataaacttgataaaactttaaaaaagtttgaaaaaaagatttgtagtatgaaatggaggaagtatatggtacattggatatgtgtatgacgtcgatattacggataattgttgtacgattgtgtgaataccttaatctgaccaaaatttgttctgagctcatattctcagcgcatcctatttatacttgtatactcccattccggtatatgagattctactaaaatttagtccctttggttccatatacttgtcattggttacttttgtttttttaactttgacaactcgtttttttctgacaaaatgagaaaaacatattgtaccacacaaacaaaagaaatataactttcactaatcatacattaatcgtttaaacgctagtactgatcaaagctgaaacagtagtgacaagtaaatgaggatggaagtagcctaaaatcggatcagggatgatcggataccacatttcccacatttcccatatctgaactcatttttattgcggaatcaccaaattaggtcagggcatagatactatcaaaaatggatagaaatataaatattatcggcaacaaacatgaaagtttcatactcaagatagatatggataatatctattacaaatacttaattgggtatcaagtcaaagcaataacattatataccacatttgtaatagccatttatccattccatatatccaaaaatacaaccatattaagatggaagtatagtggcaatggttgttggagggtccgttgcttggcaatggaaatctcgccctcgctgagcccaaatatcgattgacaaagagacaaatcattttataaggacaaagtgcaacattactcgtgttatggtgtacaacctataataacaccttaatcgagggatcgaaacgtaattacgtaaagcaaacccctccgcggcgccgcgcctcgtttgtttatataaacagcagcatattaacctgcgaaaccagtcagccgtctgtctcatcgatcgattgattcctcgtgtctccgtatattcgatcaccgcgattcatccttcttgcaggtaaagattctacgaggttttgacgaagttgattgtttcttttgattctcgcaagaaaagatgcgcccttttttttcccttttcctgttcttttctggccattcctcggtcagtcgttctgtccccgagagctgctttcttgggggcattcagttgttgctggggccgggatgggcgcacggggtgggtgggggcaatggccgtcggcgtgccgagcggaggagcggcgggagcgacgtcggcgtttcgtcgaacacttggcgggcgtccaggactccgggtggcgtatggcctggttggtggtagccagggcccaggggtttaggtcggtttcacagcaaactgcaggttgggttaggatggtgagattttcagaatcttttcgaggagaggagttgacagagtctgaaagttcagaactgaaacctgaagagaaaatcgggtcctgactcctgacaggagtgcaaaatgggcgtgtaggtgcaggctattctatttcttcctgttttgttcttttgctcacttcttcacatcgaggtcgaatcaacaacaattttaagcttttgtttcttttagtttctgacatggtccttgttttctcttcagaagaaagaatcatggcatgtgctgcttcgagtgtaaaaggttctctcaacgttggaggagctaaggcattcagcaataatttgtttcgtgattacttgaaatcttcggtgtcttatcccgtttcagagatttcttctcccatcagagcgcaacatgtagcatatggttcgaatctcattgttaggggttctaagagcagggactttagctcgaagctcgcatcgacaaacggcagctcgaagatttctggtatgatactcctggagaaatttaatttcatattcgtgtatgctatcacttttcaaacacttttcttgcattttaaaatttgctagatatggtttatgaggaaatttcaaatttacctgatgccctgatgcattcagagggttgacaaattacttaagcaaaagttcttttttttttcaaattgtcatttaaattttatatgttcgtttgtcacatttttaaatgctagatatggtttatgaggaaatttcaaattaacctgatgccctgatggctgatgcactctgagggttgacaaattacttgagcaaaagcacttcttttcagacaaattaacaacagaaaagcctgttaattaaattatatatattgctttgttacagaagagagggtaactgtattggtcattggtggaggaggaagggagcatgctctttgttatgccttggagcgctctccatcctgtgatgcagtcttctgtgcccctggtaactctggcattgctcaatctggagatgctacatgtataccggacctggacatatcgaacagcgacgcggtcatctcgttctgtcgcaactggggagtcgggttggttgtagttgggcctgaagcaccccttgttgctggccttgcaaatgagcttgtcaaagctgggatacctacttttggtccttcatcagaggctgcagcgttagaagggtcaaaagacttcatgaagaagttgtgtgataagtaccacattcccaccgcaaaggtactttctctttaattttgtggatttctataacatattttctcacttggatgaacttgtttgagagatgatttattcatttgctttgaaatataacacaagtataatctgaataagaaacacatattcttgtttgtcttggtatatggtttctaatttctattgttattttctaatacttaaactatatttatgttttaattattagattctgagtcccaaatacacatatacttgttacttgttgctattcatatatatacatccttattcctcacttaatgatctctattactgtttgttttcatatcaagttccatgtgcaggattaatgagccattttagctattgtaattgttaagaaattttatcactgtttaactaagtcggttctactgcacagtaccaatctttcacagatccttcagatgctaagaaatatgttgaggagcaaggagcccctattgttgttaaagccgatggattggcagctgggaaaggtgtagttgttgctatgactttggaaaaggcatttgaagcaatagactctatgctggttgaaggttcattcggttctgctgggtcacgggtaatagttgaagaatatttagagggggaggaggtttctttctttgctctagtggatggagaaactgctttgcctcttgaatcagcccaggaccataaaagagttggtgatggcgatgttggtccaaatacaggtggtatgggtgcatactcccctgcaccaatagtgacggaaaaactcaagtgcaaagtgatggagagcatcattgtcccgactgttaaaggtatggcaactgaaggatgcaagttcgtcggtgtgttgtatgctgggatcatgattgagaagaaatcgggactgccaaagcttattgaatacaatgtgcgatttggtgatccagaatgtcaggttggtaatcctttatatatgacgttagcttttgaacataaatcatcctaatttgcagttttgcatgctgcaatttagctttagaaacagatactgtcgttatgatgttattttaacttcttcacaagcagtggcggagctagtaatttaaccttgtggggtcgattaataccagtttatatttaagtggggtcatttttctaagttttctggatttatatataaaaatcaaggtttttaaagggggtttttaaaaacctgtggggtcagacaaccccagaggatatgtatggatctgccactgttcacaagcaacatttgatgaaaggatgctcttttagaggcacaaaaatagccaacatgaagatagcatatttcatatttatatttgaaatttattattacagaacatcacagtccagctcatattgggatgatttctattgcttgtttttctcctctggacaatatctgcagtgcagatgtgcaattacaatagcatatttttcatcctttaatatgtacttcctctgtcccaaaatgaagacatttttgaggttggcacgggtattaagaaagtaggtgagaatgattggaggaagtgtgtgattggttgaaaagagaaagtaggtgaagaagaatggttgtgattggttgagaggaggaggtaggtgaagaaatagcttcattttgggacaagacactgtgctagaaatagctacattttgggacggagggaatattggcatagaaggttgcaatgttgggatttaaagcctaagagtagttcaaacttgtcccataaaaaaagggagggaaatttggacttgcattacaggtgctttaaaagtgagtttaattcaaaggccctcacattttgcattgtcaaaattgagctcccacaaaacaaacataagtcgaggaaatgcttgaaactacagtttgaatatggaactcatatactgtttcatttcactttgtcattaggtactgtgtgcagaacaccagtacttgcatgtgcagattttaagggagctactgattacatctcaaactgaaagacaaaattgcatcctagttaagcagcattgtgcttatagtggaggaatttcaatatttactgtttaattttgtttttgaaataatctagctgtattgttagcctgttcatgtcatcattctaacaatacattttccttttttcccaggttctgatgatgcggttacaatccgacctcgcacaggtcttgcttgctgcatgtaggggagaactggggtcagtctcactaacctggtcgcctgaattggcaactgtggttgtgatggcaagtgaaggttaccctggtgtttacaagaaggggacagtaataaaaaatatcgatgaagctgagcaggtctctcctgcagttaagatctttcatgctggaactgccctagatcgagatggaaacttcgtcgcggcaggaggccgtgttcttggtgtaaccgcgaaaggtaaggacattgaggaagcaagggcaaaagcatatgacgctctcgacgttgtcgactggccagaaggatttttcaggcatgacattggttggagagcacagaaatatcggcgcatggttgcacactgataggcatgtactgtaaatctgtaactatgttatgtttgtgatgttaatgggaatacagcgacaggggaatgggcataatatttaagtagtggatgcatggagatggaagtaattggcagcttggattagttccttgatcgaggaacacgttcttctcatcactagtttctttttggtagtacatgtgtttatattttcaccttctgtattgtaataagaactggtgtggaccaatgatgaatgcaacttgcttatcaatatactccctcccttttttaatagatggcgccgttgactttttct

SEQ ID NO: 57870 - DNA, 4751 bp, Oryza sativa
tacataaaatttttgaataagacgaatggtcaaacatgtgagaaaaagtcaacgtcatcatctattaaaaaatgaagggagtattttgatattgaagaacatatccatttatatttttcctattatatttagatatagtaaggctctaataatgataaatctcaaggacaaagcaaatcatttatttataactcttttgacaatgcatctatataatttagccacctttgacaataagagtcaatggcaaatctaggataaaaatagaggtgatgctaatactacataacgcaaaaattattggaaattgtatttcctgaaaaatatggtcttaaatatccgtgcttcgttttgaaaaaaaaaaaaacgttcgtcttgttgaattattcaattcgatgtgccatgcatgcacagctcaacgaagtaatgctgaaaaaggaaaacaagagctcctggtagatgataatatctgtttgttctcactggtttgctaatcgagctgtgtttaattatcagaagatagatgggggcacgaagcacaccgtagaactatagaggagttatgagttatctcctcctagccgctgcctgtttcaatgtatcttttctgactgtcctaatgttccctacaagccttgagcttacgggcggatacttgggaccgcaagctggacctggggcttttgcgccccaagcccaatagtgaattcccccctgatgggctgtaaaaataacatagaatattttttactctagagacactttagtgatacttttagtatatttcgttaaatttatcttgtagagtcgtcattttaactctttaaaaatgcatcatatgtagatatattttcttaagacatttaaacctgtgtagagctacttttaaaattattaatatatacgtagtaactagttataaaacacaaagacaaggcacatatgttcaactgataatatgagatgagatggctcgtacgtgggaaatatgtgttttttaaggtaaaaagagatcttgtattaatgattaaacatagggttacattcttgcactactacataactcattttcccgtgcaggcatatacatttttccgtgtggtcgtttggtcctcctgcacccagttatttgcgaaaatcagtattttcgcgtgtgggcggaacgattatcccgtgtggtcatattataccacccgcacagaataaaaaaaccaaaaataaaaaaaaaacaaaaatcgccgtcgacccgtcggcccgcgtgcaaccggccgccgcaactcatcgtcgcgccgccgcacgcacgaacacaccaggccgccaccgctgcggccagctaggctgccccggtcgtcgcctcaaccagccacggccgcccggtagccgccgcgaccagccacgaccacccggtcgcgtcattgttgagcccgcccgccgccgctcctcaccgctgtgggggacggccaccgctgctgtcgccgccacagtcgtgccggttgctgccgccgccagatctatgcgggggacggccactgccgccagatccgggcatgtgggggccagttgccgtcgcccctcgtcgccgcctcgactggtcgccgccgcgcccactctccgctgcctcgcctcatcgacagcgaaagtcaggagagccggagaggagaggagtgaaagtagggagaggagaggagaggaagtgagagagatagaggggtaaagtgaaaataaaaaggaagagagagagaggaggtgtgaaaattttgaacgcccgcagaggataatgcattttcccgtgcgggcgacagcccggcgccagttcccctattttcccgtgaggttccacttacggaccgcatggaaacagaagggggcggcgtccagaagaatctatctggtagtagtgttggttcaataaattgattatctcaggagcactgctgatagttattaagtaccaattttgaccgccaactagcacaatgaataaagggaaaatatacatttcttacatgtatatcaataacaaataatgtagttgtattaggattagagaattaacatagatctagggattatagatcaaagtgaaggaaaatgaagtcattatgcaaagaaacacacttcgggcgaatcacgtgcgagcatgaggattgatgggcccacaagtcagtgcaaaccgacataaaatggggccaaaccaccaagaaccgtcattggggcccacatgtcatcctctcatcaaaggcagtggcaaatggcggtggccatggttcggctgatccaggctttgcgcccctagcaccgagcttccacgtgacgactcctccttcactcctgatggcggttatgcctgtttcccagtatacaactgacttaactaccgtcattaggaggctataaaaggaggagcctacttcaccattgttatggcttagcgacatattttttttggctggaaggtatgcatctttcttactttattttccattaattcttcttttgtattatcaattatttcttgaagaagcgaaaaatcggtgtatgtaaagttgcttagtattattcacctcttacttgagacttgtccgagcagtcagctccctagctagcacaatctaattccttgcttttccacaattgaaggggaacctacaatatatctatctattatatactaaaagcccattaaacttcctagaaacgcttcaaaccgccatgtgtcaccctacaaacgttcctaagtcaccatgtggcactctaataatttataaaaaaaatctagaaaaagaaaaacatctaaccgtcagtttacatttaaaacggtggacctgataatactaaccattagatcaaaactaaagcccctacacccttcccttctggccggccccacacatgtgtacgtacgtacaaatcctccgtatgcacgatctatccaattcctccccgtcattctcttttttccctaattaaagcagttcaaagatatacaccataatttgttaccataaatgattatatcagtttatccatggacttttagcaaggtagtgagcgtgcaatcactagctgtttatatacaggagcggtctcaatcctactgtaaataaataattatttttaggtgtctcatatttatgggaaaaaagaacatgtttgaaatatgagtttaaggatgagttgtcaattatataagatagcataatggtgacccattatatgtatacgtttctattttcctcacactatctttattttctagctaacggttttatacataaacatcaataattagattgttaaaaatttatgaatttttaactactcaatttgtagtttgatcaatattgaccatgccttgatatataataaatacatcatttaaaagccgtatcatgtaagaaccaatggaaattaaagattatttgaaaattgataacatatgtcatgtcaattaaacaacctctccattaatgattatataaaaattaataacatatatcttgtcatcaattaaacaacctccatagtgcttctaagtaatcacgtgtcatggctaataaattattttaaaaatcctaaaatttctaagacaaaagaaaataatgggaacatcgattacatttaaatttctccacataatacatacatacatacatacatacatacatacatacatacatacatacatacatacatacatacatacatacatacatacatacatacatacatacatacatatacatacatacatacatatacatatatacatacatacatatacatatatacatatacatatatacatatacatatatatatatacatatacatatacatatatacatatatatatatatatatatatatatatatatattaaatttgttaggtgctccatagtgtccgggctccatggctatccaccatccaaatgctttaagatccgtgcaacgcactagtagataacatattaatattagcgggtctaacccgataagatattgcatgcacatactttccatatccatttttaaagtattgcgtgcatgtgtttgcaaatttagtatcctcaccaatcatgcgaggcactttccattttctatatccactttttcgaaatattacgtgcaattgtttccaaatttcgtgccctataatcatgcccaccaattataattagcactttgtattttctatcacattttccatacaatgtttgtatgcagatacttacctattgaaacatgattcttgaaaaatgatgacatctaatcatgtccgctaattgcaattattaccttccattttcaaggttactttccattttctatatacatatataaccggcgacggtattccatattttgatttttcttggctatgctggtaggctcacggtcgaagggctatccaccaaacaccactgagctacctcgctgacgacatttgctcgcaagctctgtgatcttcatcgccacgctgtgaagagggcggacgaccccaagcttgtttgtcgctgccgcagcagtacgtttcgcttggcaccatcctcaggtacgtgatatgtatgtatctcagttgttatctctcgcatagtttacattcacatgcagtccccgttatgcacggatgatttgccattttgtttcgtggtatctactaactgagcacatgatgaatcacctggaatctaaattttacattttttgttgacatgttgcttaatttagattgttctaggtatataa

SEQ ID NO: 57871 - DNA, 785 bp, Oryza sativa
aactggtgttgctcaaggtagacggctggagtaagagcgtcagctagttcatctgggagaagagcttggatgtctgtgaacctttcccggatcggtccacagttggttaccaggttatccaatgatgcttctagccgatgagagatgtctttgagcgttctctttacatcatcgggcagaagagctgttgctttactggtgatgtcttgttctgtttcatcaaggtaatcttttatgtcgaaagagaacagatcggctaaaacctgcaaaaggtaatatcgtggatgattaaggatcaagacataattgcccgatttcaagtttatatcaacagaacttactggaataacaggagcagctagttgttcttctccttcaacatgatgactgtctgcagccgatggagtgcggccacctgattccacctgcacaagaggagaagaagagggaggaggctgcaaaaaggataaatgttagacatagttggttcagattagctagagagacgatgaaaagtatcttactggtgcagccggtttaggagttgatgtagccgatttcttccttacagcggttttctttttctgtagttattaaaactatgaggaatcggctataaagtaaaacgaatacaaaaggaagtcgagagaagctgcttacacttaggaagtgaactggagcagaaggagttgaaggggtatgcttgggtgaagccgatggtgttctttctgtgtcacttatttcggctgcggcttgatcgacatcatctccaatcacttcttcat

SEQ ID NO: 57872 - DNA, 941 bp, Oryza sativa
ttctgacaatttttctgtggaagtatcagcttgcgatttatttgcagtaagtggtagttttttggcactttcacttatttgtgatgaattctctgtggtagcaccattgttctttttatcttgaatgatctgtgatttgttatcagcagtcacattggttttctctgcttcttcagcaagtacacggttttgtaacggtttgttgctagatatatccttctctggctctttttctctagacacgcttctttgccatggctttttcacaaccacgctgctttggagcgggttggtgctagccacactaacttgtgatggtgtcacaaccgacgcaccgctttgcgattgcttttcagttggaacattgcgctgccacaatcttttgcccattcccctgctttcaggtgtctttgcatcagttacactgctctggggctgtttctggaatccgatgttacgttgccattgctttttaaccactgctgcagtgctctctgatggctttacatcatctgcactggtctgtgaaggtttctccgtgattccactgtgttcctgtggcacagtgggtgttgtactggtttctgccagcttcacatcgatagcactgctagatgacttctcagtgtctgtattgttctgcagtggcttctccgtgtctatattgttctgcagtggcttctcattgaccactttgtgctcccatggccttttaattgatgtggtgctttctgatggctttgtatcatttgtcaatgatgacttctcagttggtccactgttctgtatctgcgcctcagcagccacagcacgtgccatggttttctgatcaatttgctgttttctgatggcttcacatcatctgcactggttgatgatggcttatctgatggcgaaatgctctgcggtagattctccgtagctaccctccgttgccatgg

SEQ ID NO: 57873 - DNA, 1093 bp, Oryza sativa
ccccttgtgaggtaccacttgatagatatcacctgataccggttaggtatcaggacatgatacttgaaaaatatcagaacctgatacatgtttttatccaaacggtgatacttattaggtatcagacgattccaatcaggtatcacgctatttctaccgagtatcatataatacttgcgaggtatcactcgatacctgataggtatcacctaataccggttaggtatcaagacaggatacatatttccgtccaaatggtgatacttatcaggtatcagaaactggtattaggactacccgatacatatttctatccaaacggtgatactcatcaggtatcggatgattccaattaggtaccacgcgatttctaccaagtatcaagtaatacttgagaggtatcacctgataccagttagatattaggtcatgatacctaaaagatatcaagaactgatacatatttctgtccaaacgggatatggtcttgtacaattcatggaatgagaacagcacaatttccaaagagacgaacgattaaaaaaatactattaaagtcccatgtcttctcagtgtgaacatgcacccataaatacactgatttgcctagctttatcatattgtattgtcaccaactcagatactggtgtgacatgtctgctcgtgtcacgtgcccacgagtactcatgaggattgcaggcctgcaacacacttagctgctcatgtccgcgtgtcgctggaggtatgattgtgcacgaaatcaggttgacttatgtccgtatcgaggaagtcatagaatacttcattaaactattccgttcggacggtatcccgtacaataatttttctcttttctcaaagcatggggaactacatttatcttcctgcttttgttcccttcttaccgtgtcctcctttttattgggcttaaccatcgcagtattgttactttcttctcaatccacccatccagtcaatccccaattatatacgtgtaggccgtgctttattcctaatctgtccaaccaactattctttaattataagggaagggcatgtaccattacaaagcatgatcaagccttaaaaagag

SEQ ID NO: 57874 - DNA, 3730 bp, Oryza sativa
atggttctttttgcatatgagacctttgccgcccttgcgaattttgcacggaggcctcttgccgcccaaacagagggcggtaagggggccacgcccaaaattcgcagccccctaaaaagaccgtcatgcgtccgtgtgccacgtcagcttgccacccaaatggagagcattagtgtctatttttgtaaatcttttcgccgatataatatttctgtaaatattaaaaaaataaatttaaaaatgaaaaaaatcgcatggtcgatcgccccaccaaattttccccataatttttcatctgttttttccatttttcctatttttaaaatatattttgtctattttctctcattttcccaaattttccatatgttcttttctttttcccactatttttgtcattttttctagtttttccccataattttaggcctgttcactttgatgacattttcaaccttaccaaattttaataaagttgccaaaatagtggatacatttagtttgctaccaaatttggtaactatataagaaatcctgccaaaatttttggcaaattttggtaaggttttttcatcaaagtaaacaggtcctttctttttttttcttttaattttcctttttatcttatttctcttttttcggcctcgtattcaaattctgtgggccaaacgtgataatgggcctataccggcccacatgtcatatttgggcccgtgccggcactgcccgtattttccatggaccgtgcttgggccgacgccttagcacatgggcctgcacggtacggcccgctacaggagccatgcctaatcgtggctgggccgggccatgacgttcggcccatttgttcacctattgacggccacacgcccacaccacacctcgtcgccggcaaccgccacctccacggcgccgccggccaagccgcgcaggccagcgagatgacccggaagcccaagcggaagcctccgccctcgccggagccgtaccacgaccacccctccccttcccccgcccaatgcctcgccgtccgcgacgccctcctcgccttccacggcttccccgacgagttcgcgcccttccgccgccgccgccgccgcctcggcctcgacacatccccggacccggaggaggacacggatggcgatccgtctccgccgcccaccgtcctcgacggcctcgtcacgaccctcctctctcagaacaccaccgacgccatctcgcgccgcgccttcgccgccctcaaggccgcgttccccacctgggaccaggtttggtggccgcatccaggaagcttctagaagctccctcgtgtcctctgatgcgcgattcgttttcgtttttggaggtggtggatgaggaggaggggaagaggctggaggacgccatccggtgcggggggcttgcggcgacgaaggcggcgaggataagggcgatgctgaggggcgtccgggagaggcgaggcaagatttgcctcgagtatttgcgggatctgtccgtggatgaggtgaagactgagctatctcggttcaaagggatcgggccaaagactgtgagttccatctctctcttctcctgtttcttcagcgaatttggttttcgtcctgttggatttcatcgtaatgtagagaatgctagtattgattttgttgtgaaggatgaggaattgataaaatgtgactagtgagaagtagttgtagtttgcatgatggtagataatgatcaaaagcaaagcaagttgcttttcttgttgccatgtaagttaatacagcctgaactcaagtttccgcaaaagcctgcaaagtattttggctaacagtagtgttggtactaagttgtatgaaaaggaaattagagaaagtatgcccttgtgactgaaatcatatgcttgtgtcggttatacttaaatattgctgtgtgattatggatgggtgttagtcaccaacaaccagttttgctttgcaatgaatggctaacagaaacaggtgcctggtagcctccgtgcaatggcatggagcttcttctagattcttgtattcggagtgcaattgtccaactattttccttctactaagggtggtagttacaatcatggctggagttgtcaatggaaacttttgcaattatgattgacagtggaattcaaacagcattcccaaatcaaagaagggaccttacttgtgaatgtttataatatctttttcgctctttgattgcttgcttaatactatattgctgcttgagtaagtgtgcatatagctgatgatctttctaatatatgcaattatgcatgttatgacaggtggcgtgtgtgctgatgttctatcttcagaaggatgattttccagtagatactcatgtatgtgtaactttatgtggttcttgtccataccaagaagtcagtttagtgtgtatggcgtatatgtaataacatacatttctataataggtactccgtattacaaacgctattggttgggttcctgcaacagctagcagagagagggcatatcttcatctgaacagcaaaattcctgatgatctaaaatttgatctgaattgtctatttgtaactcatggaaagctctgtcaatcatgttccaaaaagttaggaggccagaaaaccaccggttcaaattctatgtgccccctagcaagttattgttgcactgaagaaaagatgaagcaataggccaatagccaaggtaagctacttggtcccatttcgaaatgatatgtatatgctgcgtgccaactatattgtgctctccagtaaatgttcttcaactagctgttttattattcgaaagttagatcatgagctggtttctcaactttagaattttcgtaagcactacacttctgctgcacatcttaaagtgcataatataggcccaaaatttatcctagagaggtcaactattacttgcttcttgcttattaaggaagtacctatgtttaaaagagagttatagttggtatgtcaaaaataaagagagttatacttcatgggtaacatgctgagtttttacaatgctgttttattctggtgtcatgaaatttattcaatgaaaattctactgtgttatttgcctatgggaatcatgccctctttattgtgttgggatattgtaagttaatcatatgaccttgcttgcagctactttcttactggcaaaagcactctgaatgatgtaaaatatgatacctaatcgctgttccagtctccacccaatcattcatgacataatcttttgcaaatgtaggaattgtttgtggttattgatattttctgaaggtggtgtcataacctcccaacaatgctaatggtaaaaggatttatgcgctgaaatgtctcatctgatggaaacctcaggttcggtttcttgttttatcagtagagactagagagcttccaggcttcagttgtatgatatgaactcatttctaccatgtaagtgacactagctagggaatttagtttggaactttggatgagaagcaaaacactgggggaatatcgacttaatcgatacatatctcattgattacactgaccaaaggaatcctaacatttttgctctaaagtcgctaaacagagaaaaaggcaccaacagaccacaccaaaaccaattgtatgcaccaggtatcctcgacttttctggtgcacatgatgtcttgtgcctgacaaggaggcttgtgatttccaggcaagcagtggctgacggtg

SEQ ID NO: 57875 - DNA, 9595 bp, Oryza sativa
atcgatgctctctgagtttgacatctttttacattatgtattaaagctatgcaaattattttgggagaacaattttatatgcgccggtcttcttatttgatcagttttctgtatttgatatgcaaaccaaatttactcctatcgatgttgcgtggttgtatgtttaatttcttaaatggcaaagtaccaattgtgacatataatgattcttgcaatctactacaataatttatcgtgttgtcagtgatcttgttcaacatatgtaataaagcactgtttaagactactacttgggatattctagagtgtgtcgttcatcgacagttcgacacaaattaaactaaaaatgggagatgtcgatgccattggttactaggctagtcctcagattgaattggttgtcgtttgtgtcaggcgatatttgttgtagttggacggaatttgttcagctagtaatcctgccgtggtcaaaaccctaattctgaacaaaatctttcattggaactagcattagttgcaaaggaatgttttggtttggttggtgacatcacgaaattggtgtctttcaccgtgcctattctctggaatcttgtcagcaaccaatttccccatatcatttctgtcatttctctaaatcaagtgcaataatttggttaatattggaagtgtttcaaggaactgaagacacaagccaaactctagctaaactttgccggactaatactatatccgtaaaccactatcactagcatacgaattctcaaatctcaagcccttaatacatatgccagtcctcacaggagacaaccaaataacaataatgaaaccaatgaactagcaccaaatacatgctagttgtaattttcagtgtatggaaatttattccaatgtatgatgagtggtggaatgttccacgatcagtcgatcactatatatatatatatatacacacacacacatgtgtgaagaaaaacatttgtatatatattgtggaaatttattccgataaaaccatttttttttctaaaagaccacatcagtgatgggtgaagggtggtaattaaaagatgcacgttacaaataagccccatccgtatcgggtgagaatactacttgacacggcccgtaaaagatgacctagttatttgtgtcggttaatttctttcctgtgacctatcaaagatgaagtcattagggcaagtactataatgttccatatgttgcccttaaaaataccatattggatagagtgatgaggtggaggagagaagtgaggagagagaagatgagccatccctaagtcaagaggcaacatctacacaaatttcaagaagagtgtgagagtattagaaatatttgtatttgtgtaccaaatacgatatattgtatgtgttgcatcttaattcatgagtgaataaaatagataaatttggagatggtagtcacatctaccatagcacttgcccttaggaacaggtgatagaacaaaggcaatgtttttgctaatcaagtaagctgatgtacacacaacgctaatcaagttggcttctgttcgaactccatgagaagctctcagggccaggcaggcaggcagataaaacgtacactccacagctcacaccttcccaaatcaatccgtttcatgcatcatcatcctcctgtcgatcgaaaaatctccatctgatgatcattgctactatatatcaaatctagctcggatcagatcatcatcaagacacatcaacactatataacggactgctagctagctagctagctaggtgagctacgtacacaagaacttctccattgcaataatcaatcgagttaattaattagttagtactagcaaacattggctaaagtatatatatggttttccaagtgcagccgccatggctgctcctcctccacctcatcgccatcgccgtcctcctcctggccgtggatagtgtgccgccggcgccggcgccgccgccggcggtggcgacggtgttcgacgacaactacgtggcaacatatggtggagacggctaccacctggtcaaccagggcacgcagattagcctcaccctggacaagagctctggtatacacacagatagattatatatatgacactgttagattcagcatttagatcagcttgatcatagtttttgcttcttttctctctctattttatgcttaactagcttgatgtgatcatgcaaattaattatcatgcatgcaggtgctggattcaggtccaagttgatgtacggctcagggttcttccacatgaggatcaaggttcctgccggctacactgccggcgttgtgacagcctactatgtgagtgctaaactgctaaatcaacttcacttaattatataagtgttaattcctatcacatgttctttaatattgactaaaaactaagcaccagtaattaactgaatgtaacaattaatttaatttatttctgaaattgcacgggtagctggcgtcagagccagactgggacgtgcaggacgaggtggacttcgagttccttggcgacaaggatggcaaccccatcacccttcaaaccaacgtcttcgtcggcggccacggcgaccgcgagcagcgcctccgcctctggttcgaccccgctgccgacttccatgactactccatcctctggaaccccttccacctcgtgtaagctcagttcaatgtcaccatgacggccgtatacacttttgttttaaaacaaatagtagaaatagttacatcttccgtctctaccaacaaacacttgcacatacaataagcgatgggataaatccagtgttttaaatagcgggctataacatttagcagttgacccttctcaagcagctctagacggagatttaaaacctggataaatctaactcctacaaaatgaccacctgaattctgtagaagctaagacaaatcacatgtacaagccatcgatttgattaattatttggcaggatattcgtggacgagacgccggtgagggtgctgaagaacctgacgagccggggcccggagttcgagttcccggcgaagcctatgcggccgcgggggagcgtgtgggacgcctccgactgggcgacggacggcggccggaccaaggtcgactgggcccgcgcgccattcaccgcggccttccagggcttcgccgtcgacgcctgcgccgccgccgccggcggcggcgtcagctcggacgactgcgggtcgccggacacgtggtggtggaacggcggcgagtacaggaggctgacggcggcgcagcaggcggcgtacgatggcgtgagggggaacctgacctatgactactgcaccgacaatagcaagaagcgcccagtgccgccacccgagtgcagcttcacctaagctaactgtgaataaattcactgcacaaaattagcagaattaattgcgaggatgaaaggtgcagcagtatactggtatatgttagcaattaagccccgtgttcatccattggaattcggaaaggttgtgattacagatagccattccgatataaatatggtgtgttcttgacttaaggccctgtttagtttcgaaacgaaaatttttcacctgtcacattaaatatttggatacatgtatttaatgtttggatacatgtatagagtattaaatatagtaaaaaaactaattacacaaattacgtgtaaattgcaagacgaatcttttaaacctaattacgccatgatttgataatgtggtgttatagtaaacatttgctaatgaaggattaattaggcttaatagattcatctcgcagtttccaagcaaaatcgtttcgttattagtctacgtttaatacttcaaatgattgtccatatatctgatgtgacacagcctaaaattttcgttcgcgaactacacaagcccttactagtacaattttgcaaccaaaatttttttctatacctatatgttgtagtcacattttagtaatgctgtgtttagttcacactgaagtttggaagtttggttgaaattggtacgatgtgatagaaaagttatgtgtgtataaaaggtttgatgtgatgaaaagttggaagtttgaaaaaaaactttgaaactaaatagggcctaagtctgagttacaggacacgttaaaaaaaaagaagaagcaggaggttgtagaggtcacaccaatgggttagaaggaggatggaattcaagttgccgattgccactgcagtgcaaggctgctcattgacaccgacagtgccctgtgcgtccgtgtgtccctcaggcagagaggcccagacaccactgccattgttgggccgtttctcgcatccaaaacctatactatttcggccgggccgtcgcccccgcccccattagtccattccacctcccgccacggcacgcagccaaagctctcgttctcctcctcgctgctgtgcccgccgagcgaacgatcccgggacaccacaccacaccatcatttgcacgggatatccgatcgatttgagtcgtactccagtggcgagcacgtacgtacgctttccgcggccgtgtgcccgcccgtgcgtgcacgaagctagctagcgccatgattcgcgaccaggagtccgcccgcaaaagagaggcccccggcccggcagaatgtgcgcggtgcccggctggccgtgtgcgccgcaacgaaaggttttgccagcggaaaagaaccaaccgctttacagccaacagaaaaaaccggccgcactccatcgcatttttcttttgcccgaaagctcgccccgttgtctagtttgatacgagtactcgaatagctcgccagcccagccacctctcgccgtgcgggcgtgcggcaccgcacccatacgacggtagcgatcaggttcacagttttcttcgactccaaactttaactttcttattttccattagtatattttttttaaattgttaaatgatgtgtgtttttttttaaaaaaaattctacatagaagttatttttaaaaaaattaaataaatctattttttaaatttataatagttaatatttgattaatcatttgctagtgagttttcttgtttcgcgtgcaccggaaatctttcttcaaactcatctatcgaaccaagcctgagtgagatccgatttggatttcgtgaaaaccggattaaaaatacaaaccactctttttttttccgttaagttcaaaaatccatagtgaattttaaacttttgataaaatttgccggattttatcggtttgttaataggttccacgaaatctgatgatacagcttgtgagtggattttgatccgatataggggctgatcttttgtgctgctttgcagcaagctatggctgtggctgtgttgtatcggaaaaaatttgtaaatatactttttttttcaataatttaccattatatatatgcatggaaagaaattgtaaaaatatacctatctcgcgacggtcccacaggacggtagtgctgcaccacgacggtcccacggatccaaaatgcgggaccgcgacggtcccgcgcgaccaaaacacggcaccgcggctagagcgattttattatccgatcggcactgtttagtactgttttaaacactgtttagcactgtttattacagtcccgcagacccattgtgcggaaccggcatgcaaacagtgccaaatagtaacattgccagatagtgtgtgaacagtataaaacagtgcgtgaacagtgtcaacgcattgataaaaatcgctgctatggcggtgccgcgttttggtcacgtgtgaccgtgacggtcccgcgttttagatttacgggaccgtcgctcccgtgtttttagagctgcgggaccgttgtaggatgggtatatttttataaatccttacaatacagatatataaacgtaaattattgaaaaaaataagtatattagtaatttttttcgtgttgtatctacagtagtagacattatattaggtttgctgcagctgttgcgatcaactctatagcctcatcttttcgcccatacttatcatttaaaatttaaattttcaactttaaatttaaaagttaattttggattttttttatcatagtttattttttagtcttacttttagatcattaagaacacgtatatatataagtttttttatttatatacgtgacaaacgattggggctgaattgggaaccctggtgggcgacagcgccctacgggctccgccagaaacggacggcgctcgcggcgccgctcggcgtcgggagggatgacatcgacggcgccggacggtggggccacaccctgttgcactttcggcgaatcggccataataagcccaatccgcaatccccgatcaaccgtggtaggctacccctttgcatgacaggtgggcccttcaaccaagaggcggggtctgtcagtggaacttgtagggtaggtacatgcatggtgagtacgaaaaaagcggaggagatatgcaccggcaagagttggctgcgacgggctggatcggatttggagaggggaaagaaggaaaagaaagaaatcgtcgccgggggccacttcggtggggaaagtcggggggtgaaatggtacggtcacggagatgttgcacacacagacacactcttgtttgttatttttgacatgtgggtgcacgatagtgtagggtctgcgtgtcatgctcgtgtttgggtgggctctggataatggaatggtaaaggtgcaaataaatgctcccttagtaggcaatgataatgctgagagtacatgttttatgtaccaaatgtctaataatccattttcttaaacggttaaatgaatattagtagatgctatcttacggtctaactttattgacatgacaggttcctatttaaccttgtgttcgtgtgatgcaacatttacggagccatccagcgaaacagcttatttgcaaatggaaaataattcgtgaataaaacttttatatacgtgttcttatcaatctaaaagcaacagctaaaaaataaatttcgatgaaaaaacctcaaaatcagctccaaatttaagattgaaaatttaaattttaacttataagcataagtataagcgaaaagaagatgccttatttgcatatgtgttcttgtctaacgatcaataattttacgtttgacaaaaaaaatactttcttttacgttgggaaagttgtttttttctattcacgcaagtgatcatactgcttgaaatgtaagagaaataaaagaacaacttgttaaaaaataattataaaacagtctagaagtatagtaacaatgaatgaaaaacactaccaacacatataacgctatggatcattgatgagcacggacaaccgtttatactagcgcgtaccatctataactgataaagcataaaatgcattggacaattcacatgtattcatctatgggttttccattctgttcaaaatcacacagacaatattaggtcaaagtttaaaggctagtagagagaggcgatccttcgcttaacttcatgtgtagttagtgtcactaacatagcacatcatactatgcatgtctctagtagggcagtcgcagtctcgcagataattatggccccgttaatatggggaataggtcgagcttattaaccgcacgtaaaattgatctaaaaaataatttgtaaataaaacttttataaacgtgttcttagcgatttaaaagtaaagattaaaaaataaaattcgagtaaaataaaccttaaaatcaatttaaattaaatttaaggttaaaaatttaaattttactagctgataagtaagcggaaagatgaggctcttattcctttttttctcgtcggagtgcccgtagcatttccccttccttcctttttgagcgcacaccgcacccactcccccgtttcctttgcgctgccgttccccgttattcgccaacgcttccctccacccgccccctccccaagctgagctgtgctgccgctgctttcgccttcactaatcatcatcgcctcctcctcctccttctcctcttccccaccaccttcctccccacacacacacaacctcgcgcgcgcgcggcgagaacgagaagcatccagggcggcgcggaggcggaggcggaggcggaggtggagggggggggggggggaagccgggatggcggcggcggcgtggggcggcacgacgcagaagtgcgactcgtgcgggaggacggtctaccccgtcgaggagctcgccgccgacggccgcgtctaccaccgcccgtgcttccgctgcacccactgcaaggccaccctccaggtcccccgtcccctactctgctcgatccatccattaattaccagattttttttttgtactggctttatgccttgtttttgttaatctgggtcgatgctattattgcgagtactatcggcttcctgaaatcatatccatcttggaatgctttagttgttgttgctgtactgtatggcctgcttttttctttttctttttttcttttctcgagaccagtcgaagatgggagttaggttgcatgctcatttcaataatcaagttgcgactgtgattgactaactggataaccaatcactttgctatccgtttatgtgataacgaacccacgaagcatcagtaaatttgcctaaccacggtttatttgtttaatccatcttcgacgcaatttcttggcgtcttagtaaatatcccaattatttttcttgttattgtggcatgagggatggactggaatggatagggtagcaaataaatgtttgttttttttggtacaactgttgtctgttcatcatattcctgaactgactggttcacctattaaatatagtgctggctgatttgctaggttggtattatgctgttggtgagtgccgtatgattagcctgccttttgaaagtaataacatggaattaatcatgctgtcctcaatgcatcatggatgtaaatgcagctagcatgtttttttcttggttttggtatatttctgttgagaataataatgatcacactaaatctttatgcctcatcatactagctagaactacacctatcttgttctgtttgcaactaagctacatatatgaaaccagctaatatttttttattatcttttacagtttagtaactattcttctgtcgaaggtgtcctatattgcaaacctcactatgaccagatattgaaatcaaccggcagtttggagaaaagttttgaaggtactgaagagaaaactaaatccactgggcttgatgccttaattattgctagtgtctttacctcgaaattgttgctattgtctcatgatttttaggcctgccctaaattttgactatattatgccagggacatcaaaatcagctaaagcagaaaaatcgaatggaaacaaggtatcgtaatatatttctaagatatgctcttttatgtttttgaagcacgtccctagtatctaaattgtttggcagctttgatgtagaggacataacattcatgtccacttcctcttttatgttatccaaactgcaggggcaaccgaacagattctctagcatgtttgttggcacacaagacaagt

SEQ ID NO: 57876 - DNA, 4276 bp, Oryza sativa
agtgcaaaagctagtctaacaatcttatgcatcgtaaaaaagaaaaagagaaggtctaaccatcttgtgccatgcatcctttaatattgagaatgtcacatttttaagtgctcacgttttttaaacatccactcagcatttcaactttaaatttgagaagaaagtcaatatagtacgaaaccatcagaaagaagtaggagagaaatttggttgcatgtgatatcattcatacaaaaaagtacttaccccatcagtaatccaatataaatattgtatgtccctaatataaaataaaaacaaaaagatagaatggcatctggtttgctcacaagatttgcaactttaccaaacattcgaacaatcaaactacactgaagtatttcatcaagtatgtgtggagttgtaccctcaaagttttgttccctagaattccttttgctaggctggatgcaccaagaggaccaccatagttgccactagagtaaatagacaaagtacatgtcagttagttccagaaaatgaactaccaatgtaatcactaccgcagtatctcagcacaacttcatatgcacactcatcatatatcacatataaagccactgggttgtgagcaactaacttgacaaataagctccgtagcacattattctcaaggagtgcttctgcaatacttgcaaaaccctgctccaagaaaaaggagatatagtaaatagcaatccttcaataaacaatcatatggttagtttttcttttctatttgtgattcaagtgcatgtcttcgatgaagtggatacatatacatacgctgtattctattgtgttgttgctgagttgtaaagtacgtatcgtcttgttctttttcaacatatccgaaattgcttttgccccctgaaaagaaaatatcatgttacattgcagtgcacgcgcatgaaacaacacacaaagagtgcaagagagacagagagagggaaggagggagagatacaaacctcgtctccaatatttgtactgttcaataggagcttctggatacctacattctctaccaatatatctgaaagacactgtaagtattcatgagtgttacattcagtcaggaggacttagttaaagttaagtttacatctatacatatcatgctgggtaggttctatcatatttgctcccaatgaatgataatatcagcaagatgagtatttgaataatcgataaactatcacagtgtacaaactccagttaggcataaaggcaaacaataacaatgcaactcgtaaaaggtgctaatgtgaaacagccaaccttttgataacaagttaaaaggtaagtaataacatggttatgtaatcatatgagttcagacttcagaaaatgaaattaagaagagaacattgtctgcatagtatacatcacaccaacaatctacaaaaacaaaatgatacgaagaggcaataagattgagaagaccttagctccttcgtctccaatggcatttccagataagttgagagattttaaggctgtatttatctgaagaatgccatcaaaggcttctatccccacagctgttatcccattgccagaaaagtctacctcttctgcactctgtgaatacagagaacaactcgttttcaaaaagtattcaaaagagctagtatattagtaaggaaaaatcggtaagaaagtaagcatgtactcatgctcatatatggattgcaaccaaaacaatatatgatatatcggatatctgaccttgttataggctaagctttctgctagaaaaaacagaccctcatccccaaattgacgacctgccgagtaagtaaagttttaagtgtacaatatgcaacacaaatctgaaggctcagagcttggtttcagcattttctttcaaatattttaacttaagtacacatagactctagttacctgccatgttaacatttttcagagtcctgatttccttatagaacttatttaaattcttccttgattccttttcagcattaaagcttgcagatgttgacaaattggaaccagcggcaaaggaccacatgatcccagaaggggtagattctccagaactctggtcctttgtcttcccgggaagcaaattctgaaccaccctccatatgactgtcctctgaaacagagagttagtattgattccacacaccgcagaaaaaattacatgctctgtaacataacgtgataaaaatatgaaaagttcggcataataatccctctgtttcattatttcatattataagttgcttcgacttcttttgtaatcaaacatttttaagtttgataaagttttaaaaaaatatatagcaacatattaacacaaaataaacatattatcaaaacatattaaatgttagttttaatgaaactaattattatctagatgttgataattttgttccataaatttaatcaaacttaaaaaaatgactagaaaaaagtgaaagcggcttataatatgaaatggagaaaatatatagcatctaacggtgtactagtatatccgcgagatataaatgttacaagcccttgagaaattcgcatgagcttgcaactgtggtaattgtgcacatattcagatatattctaccaagtcctgtgaaacgatgccatctaatgtgcagggaacagagctccccacgcatgttggatcaatgggagtcgaattggcgaagcaaaaggatgcgccgcggcgggggagggggaggaggaggaggaggaaacaaggcaaaggccgtaccaaagctcagggcgaggaccgccgcggccgggacgacgtacggcgagacgcccctgaccgccgccgccgccgccgccgccggtggtgcctccccctgctccacgcggtactccctccggcgcgcgcccccgcggccgacccccccggggggcctgtccgcgctgccgtcgaacagctcgcgcgcggcgcgggtcacggcgaacgagtaggacgcgggcgatgcgtggcgggacgaggacgaggaggaggggaggcgccgatgcggcggcgtggggagggagaggtggtgatggtggcggcggcgcggggcggaggggaggaggacgaagggcttgaggaggagggaggactccatgggaggcgggaggggtggtgtcgagatggagacgaggaaggggagagtcggagaggggggaaggtaaggttgtggatcatgtcaggtttttttggttttttttttagtattttggtttatccagtttttagcctggctggccaattcaacctttttttatcttgatttttgattcgttaaaacgatatttatttgagaggaaccaatttaatctatagatttacaaattttgcgtatggagggcactctttgtattaaccactctttcctctcgaagcaaaagtcatccaacataaaccatgagttgacatttggaagaatcctagaagatagccaccaacaatcctgatgagatgatgagatcacttctcttaaactaagggcctatttggtatagctccaactcctaaatttagctccaggagtttggtctggagtggagatgtggagctacctaaacccagttccacaactctagttcattttatgagagagctccacccagctccactcccagttttggtggagctgaaactgtttggctgagctccagctccaggaggggtggagctggagctggagctgtgcgaaacagaccctaatactccctctgtctctaaatataatggattttggtggatgtgacgcattctagtacaacgaatctggataaaacctctgtccctaaatataatggattttggtgggatgtgacatatcctagtacaataaatcttgtctagattcgttgtactagaaatgtgtcacatcccaccaaaattccttatatttagggacggagagagtataataggttagagttagagttttctttccccctcaatgtataccaagtgtgttcacaaatcactccccccgacctagtataattacactagtagcatttatcccctaaagggtctatttgtattgaaatcgacaaaggtggatcccacttcatatagactgcactgagccataaagtactgatagatatcttttcagcgttgtatgctcgtttattgctatatgaatattctatctgccctcaaaaaatattctatctgcgggcaccctaggtaatataccgtccagtgtccaacgtgaccatcacatgtatttggataagtaggataaaaatacatttgggctgcagg

SEQ ID NO: 57877 - DNA, 3721 bp, Oryza sativa
tggtgatcacgttggatattggatagtatattacctagggtgccccaacactatccatctctctttccacaatcacatcatgcatatcacaagcacattctaactatctaagctaccaagactaagaaaaaaaagacaaaaacggagcccaaaacaatcatcgaagaagagcttatcgtaaggccgcacaaagtcttcgacttcacgagacaagtgttatcattgccgagcttgtcgcctagcgacatagcagctccaacttcacagctgttacatcatcattgccaaaggtatcgccaaaacgaacaaaacaacaccaactgcttgctttggacatcaacccaagccaaccaagcaccacttcttgcaaacacttcttgcaaacagctaacaccagcacccctagagactacaacgtgttatcgttgccgagctttgttgcaccacaacgaagtagcttcgacttcacctagccgaaacgaagaaagttggatgctcaccacaaccaagacaaaagccagaaggtgaatgccttgccaaacagctaagcctatggagtttcgacactggagtctaccaacgaccattgttgcacaggcaaggttcttgatagtggaggagaaatgacgccaaaacgacgcctccaaggagggaaacaacacctaagggtttcgtcgttgtcaagctagccaaaggctagccaaggctttcaccaacaattttcatccaacaccacacaacccacctgcacaacatcgtcaccagaccatcgcgttgtccctctagctgccaagcctagccacatcacccacagatcaggcaagttcacgccgcccccaatctggccatggcataccatttacgaggattaaaactgtataaaagtttttcttcctgtctctagctacatcttcatttgcatttcatactaaccgattgttccaactctatacatacgaatactgtagcaggaagtggaactttcttcgtcgacaatcaacatttgttagagaacggttttaaatagttacttttaccttgatactacttcatccgtttcacaatataagactttctagcattgtctatattcacatagatattaatgaatctagacacaatgctagaaagttttacattgtgaaacagagggagtagtatttaatttatttgttcgtgccttgataatcgttagaacacagcctaaagtatatgactacgaaatgatttcacttgtgaaagttgattatttccccttttttttcctctctgaacagcaagatattttctttttatacctactaatttgaatttctccgtgttatcttcctgcactaatctaagattagactatcaatgcttcgaggcaccgccgccgccgccgccgccaccgtgcgcgccgcgatcagccgcgcgggccgccgttgtaggcgtcgcaccggcggcgcacctcgccgttggcgccgttcttgacgccgtggtggctgagcctccgggcggcgcgcgcgaagtcggcgaagaacgccgtctcgttggcggcgtaccgctccacgtgcggccgcgtccgcgcgtcgccgtagagctcctggtcggtggcgaggaggccgaggcctcgccggaggttgacgaagtacatgttgtcgaacctccccggcgtcatcacgtcgttgaacgccgcgatggtcgggcccctccggtagtccctgcacgcctcctgcagccgcttcgcgagcgccgggttcatggtcgggtcggcgccgccaccgccgccgccgtagatgcgggcggcgaactccttgcaatgggagaagccgagggtgtgtgcgccggagagcgcgacgaggtcctggacggtgaagcccttggcggcgaacacggcgacgaggcgggagacggtgaggttggcgtgcgggatctcggcgtcgggcgccgacggcgaggaggagagcccgtccttgcggccgaggcggagcgggtagtagggcccccccgtcatggtgacgaggtcgcgcgccgcgacggcgaggaggtcggcgcaggagacgacgcccgggcactccacctccagcgccgccttggcgcgcgccagggcgtcgaaggcgtcacccgggagcgacaggttcacgtcggcgtcgcgctcggagcgcgccgcggcggtggacgcgaccagcacggacgcgtcgcagccgccgacgaagcagtcgtggaagaagaggcggaggacgcccgccgccgtcgtagggttggagatctgcttctgcgccagcacgtcggcgatgatccggtccgcgcgcgggcacgtcttgctgtagtagtccgccgacatcttggcctccgccgcggcggcggcggcgagcaatgccaggacgacgacgaggtgagtgtccatggtcggtttcttggcagcgtgcgatgctacacctaccttttgctagctagcttaccttcaggtatctgagatctcgccatggatggaggaaggattagatggcgggagagcttcttggaggagagcaaatggagggaaagagagtggtagggaatggtctcaggacttggtgtcaacagagttcataaagccgatcgattttcgttaaaccgttaggtcttggttcgtaaaaaccgatcgatattaaccgggttctgtacgacattgatcgaaaatcgtcgatttttattggttcttcgttgttgatgaggagcggtttttacttcgaaaatgaaaaggggattttattgtccaatggaaatatggaataatttgaaattatcttatactccctccgtcccataatagcttacgtttttgactttttatttgcaacgtttgaccattcgttttatttaaaaaaattagtgtaaatataaaaaaagataagtcatatgtaaagtacttttgataataaagcaaatgataaacaaaataaataataattccaaaattttttgaataagacgaatgatcaaacattgacaaacaaaaactcaaaaagacaagtaatatggaacggaggtagtaattcaataaaaacaagagttagttgcgttcgataattcctcttcccaatttctactccctcgtttttcgcgcgaacgttttccgaactactaaaacaatatgttttttttaaaaaaaatatagaaaagttgctttaaaaaaccattaatgtatttttcaatttttaatctaatatacttaattaatcatataatagtatgttacctcgttttaatccattttgtaattattgcatgctttgggctgacggcgatcacatgatcaataacattttgggccctcgttttaatccattttgtaattattacatgctttgggctgacggcgatcacatgatcaattacattttgggtccttttggaacgaataaattttgcctgaggatctcaaaggacgctattcagtgctagcaaaatcgttgacaacttgagatgtgaattgcttgttaaaagagagattccatggagttggcatctcctatggctcatggcaacattccatagcttcagaattttgcaaaaacggcaacttagttcgatgcaagaatactttgctccagcttagcatgcatcaacaaactacacatgaatgacaaatccaaaactgggtaaatggtttgtctttcttacacatcaggaatccagacgagggaagaaggtacattatgtacagcaagcatatggtgaaaagaacctatattta

SEQ ID NO: 57878 - DNA, 3776 bp, Oryza sativa
ccaaaatcccttatattatgggacggagtacaaaaatgactatgcaatagaattgtacatactgcttgcatttcttgtgtgtatctgctggtcatctcagtgaactttgccaaaacctgtgaatctcggaatatgaaaaatgttgacagctgacgcccagtgcatagaaagaatgtgagggaaaacaaggggaaaggcagcaaccacatacttctctgtactcggtctcaaatttggatagctctgctcgttttgtgagtatctttgcctcaacactctggagcttctccttttcagcagggaaagattcaccacatacaacctctatagtatagttcacacttctgaagaaattgtcacctgagtgaagcgtagagtttaaggggattcgtactgtcttaagtaattgacactgcaccaacaaacaaagtgattaccatagacagcaaagaagtgtgtgcctggttttagttcatttatatcacatggttggaagctgtccaatcttttaaagaaggcactatcaggatcctttgcagcagctgcctgaaattaaaaggaacttgtgagaaatgaatcacagagaagcacttggaggattcaacaacgatgacacatatgtaaactcaccaggttgttttgttcaaaacgatacacaggaaagccaagaaaatacatcccagcagaagtaaccttcccagtctttacactgtcttcctgcgaaaggttgtgcagatggaacaagagaaaacaaacttaagccacttgcatattgcatgaagcaaaggttgtcaaagcaaaaacatattcaccggtttgctcattacatggtgttacagtttaatagcgaattcaatagacaagagtataggactactcaaacttgtttgtgaatctgcaggactgacaactatgcagcattttatattgctacatagttgaaactatgataattttgcagataataagctaacttttaagtcatttttgcacacacaatgtttaaatagcgagaccaatttcttagtaatggatagtttagatagggattgcgcgcaaccccttgaggtaggcagggttttaatctctatccaaaacctctacatgctcagatgtaaagctgattaaatttatgtgcagaagaacaggattctggcactcttacctgcaaagcaaggctcaggccaccattttcttcaagctcaaagtaaagcaactgaaattgtatgcaagaataacaatgttaagggtctaagtaaaggaaaaggacattaaaccaagagaattttatgtattcaatcaatagtattgaataaatgttttacatgctaagcattgtgtgactcaactttatcaaagccatgagataacaggataaacaaaagctgacataattattacagaaacacatgtggatgatgcatgttgtattccatcatttaaactgccagatcaaaataatttcattatcagagccctctcaaagaacccttccaaaagtgaatacaacaaaacaatatttttttgtaccataggtgtgattattctatatatgcagcacagccagtacttattgatcacacagaacatgcatttaaaggacaggttaccattgtttattactccctccgtttcatattataagtcatttgacttttttcctagtcaagtttgactaagttcatagaaaaaattagcaacattcaaaataccaaactagtttcacaaaatctaacattgaatatattttgataatatgtttattttgtgttgaatatactaatatatttttctataaacttggtcaaacttgattagaaaaaaagtcaaacgacttataatatgaaacagagggagtactatatgtcaaaagtaaatcatctaaatttcaccaactgaagggcaaattttctcattgtcaaacaaggatagcttcactacgcaggataaatgtacacaacttgaacaagtctagatcaaaataaattaaaacagaactgacaacaccagaaccgcatgaaatgtacttacgaaacacaggttacatgataaaacatttgctaacaaaaaccaaccttaaatttgcttctatcagttgatttcacacgacaaactaaccccattttagcttccttttctgttatgtcaacagaataaaaatgagctgattgcttttccacctggccacatgcagctttcaattatttagttgctaacatcaagaaaagaagcattggatgatggacagctagttgccattacctaccttcctgtgaacagagtttccaagctggagctgagaaaccataaccgatccattcaatgcctcctctaaaactgttgctgatacggttgtctttatcggcacaccaagtttgctgcacatacgtacgcacagttaagaagaaaaaaaaagcagcataacaagctagtagcaaacagtaaaagaaatataacatcagtaaaatgtttttacctgaaaagagcagcaaacacggtgttcacggtattgagactcgataggtccagctccaattcctggctatcggcttcgatggcctgaacaaattgcaccagttgccataacatggtagattaaaaattaccagttcatgcaagaactaacctcaaatcctgatgtgtcgtactgccgcctcttatcgggatctgacaggatgttgtaggagaatgtgacttcctggaacatgtctgatgcaacaggatcatcgccattcttgtccgggtggtacctgcctcaatttgcaaggaaaacttctgaaaccattgcaacattgatagcaaagcaaaaaaagaagaaccaatctccacacaagaatggctagcaagattaaatgcgcccccaaatccctccaaaagttcactaaacagtaaataagctcctataatttatcttatctcgcacgaattcccgcgagacgcgttcatctaggactaggatgccagaaggatcgaatgagggggccgaatctgagggtgaggcggggagtgctcacttgagcgccatgcggcggaaggcgctcttgatctcctggtcggtggcgttgcgccccacgccgagcacctcgtacgggtccctcctctgcgccgccgtggcggccgggtcccccttctccgacttgaacgacccgaacctcgaacccgccatggcctccgcctcctccctgacctctcctccgccgccgcgtcaacccctcccggctcttcacagcagcaacagcaacagccgcgtcgcgctcggatctcgcgccgagcggtggggggcggcagtggctgctgcgctgttgcggccggggcagtaggcgcaggctcaccgccccctcatccccgtcgcggcgaagacctccgccccttctggctcgcgccgtagcagcggaggcggaggcggagtggaaggcaaggggaagccgcgcccgcgcggcggtggcgtgaggtggcggcgcgacgcgacgcggcggcgagcgaggccggcgaaaatgggaggagggaggcgtgggagtgaggtggtggtggtggggggaagaggtggcatagtaggtgtacctcgtggtggggccgtggggcccgcagctcagtgggtgttggtgtagtgtgggccccgtcagttgtagccattcgctgtacacgtgacagcggttggcctggccttggccttgtggccttgtgggggcacgcctgtcagtgatagcggccattattctctactagagtatatatttttctctttgaaacattagagcaagtttaatagtatagcc

SEQ ID NO: 57879 - DNA, 2646 bp, Oryza sativa
ggctacgagcaagcgtcaaacatattttaaaaagtcaacgacgttaaacatttagggaaggaggtagtactacactattaatatctggtcccacatgtcatatacatactatgtcttggagtccgtgctatatttggctacaaatctatagcccactgcttttctctcttcttatttatctctttataatatgtttgtagctagcttgtagcctgctattgtacctgctcttaggtacatctaggagtactccatatctttgatgttagtgatagcagctattagcctaataatctctctttttttttttctttttaactgttttgaaaagcaaagtcgttctctttcctctcctttaaagaaaggtttcaaaaaaactcaagtaaactgatccataaaaaaaccacccaaaaaacttatgatcccgttatagcatacttgtagtgatcctccaccatcacataaaaacatttttggtctcataaaatccgtaaaccttgataaacagatttctttaaaagccaaccatcgtaaaaagaccgaacaacccaccattgcaactcatgcttcatctctcctggagttgaagcccaaccaaacagtttcagctccacataaactaggagcgaagttggatggaacactatcacaaaatgaactagagaagtggagctaggtttagattgctccataactctactccagacccaacttctatagctaaatttagaagttggagctctaccaaacagagccctataactacatactctctttgttttatattataaattagtttgattaaatacaaaatattttaataatatgtttgttttgtgttagaaatgctatctttttttatgaatttgaaacttaaataaattgaacttgagaaaaggtgaaagtgactcgtaatatgatgaaacagaggaagcatttatgcgaagtgagcgttccgattagatttcttgtggtgaaaccaacccactcagattcaacttagacacaggtgctcggctattttgcggtaggcgacgtatccgtcgataacaaggcacccgtggtgactttgtaaatctcaagatatatcggttcagtcttctggctatgctcataggggtaggatgtgcgtgtgtgtattcataggaggtgagtgtacgcgtgttgtaagcgtcttcgattgcatattgttttaaaaaaaacggaggaggtatgtatgaagtttcagttgccctctcgcccctggcatgtggggcccgtgtttttgattgatgagccgggcccaatgaggctgttgccgaccggagtgactccttttgttgcatttgcacggttgctcacgcctttagactttatcaaatgatgatacttaataagcaaacataagtagtgaacgcttacatgttcttgtagtttaaaactgtcatgatctgttaaagtttatgttttaggctgcagcttatatagacagagacaatgtaatagtaccgttgttaggtaacatcatcacggttttctttatgcgaggataacaccaaaagctttagacctaacctaaccacttccgtcaaagaaatgacaccaccccataaatttctttgggcttgagctaaataaattagcccagtgaataggcttcagatcacaccactgattctcgaaaaaccgctgagtagcagaagtgagatttttttagaaaaaactccgagaaaatggtcaatttatcatattattttcattttaattacgctctagcctacttacttagcgggtcaaccgatcaatttccctaaagttaacgatttcttaggtttgggacttttgagctaaacagattttaagcatttggggattattcttagaatctgtttggaatgcattttttgctacggcttataagcgaagatacgttgcaacctccatgaattctattcttatatattatgttcatgtaataaaatcagctgtgttgctatatatttttgtgtacatgtgtactcactaactttagttttgtgctttacaatttcattttcactgaattagatggatagtataaatatatgataaaatgtttcttcgaaagaaaatccaatttcaccttgtcgcatcgcattattttcttgctgtctatactcattacatagagatgacattaacaccatcaatttaaaatcctagatctgaccctcgtagtttatactttataggcctacccctccgtctcaaaataattcaaaggttgagttattttggaacgaagagagtacacgagtatgactggtcgatccaaatacttcaaaactataagttaagacacgtgatctaggatttgaggcaacgaaaactaattttaggatatgacttatacttttacgtttaacattttcaaaagtcatggctgaaaaaagaaaaacactaaagttaattctaaaattaaaatttggctatggatcattagagcttaagctatattgacaggcgcgatgttactacagctcctttagttgatgacatgatcaatatttgaagctaagaccatagctaatcatgatctatttcctcgatttgtactgttaaggtgcagaaaaacgtgcatacaacattagaccactatagcattatttactgtagctacatatattg

SEQ ID NO: 57880 - DNA, 1698 bp, Oryza sativa
cccaaagtgtagaagccatgtcagaaccatctccaagtgatgcagctcatcaggaaatctccgagagggagatactgacagataaattaccagaaagtaccatggctgttgagaagctatctcaaactgctactctaaccaaaagccatctaaagaagatgctgcagagaagctaccgcaaaccaatgaaccttctgagcagccacacgagagtgaagagactgctgagaagccacttcaaaatgaagctaatgctgaaagcacaacaaaacaaagtgatctcagtcttgagaagccacctcaggttgatgccaatgttgggaatcctaccgagcctgaaagtgatgccacttctggtgtgaactcatcagatgctcaaatcaggccaactgctgagcagttagtaggacctcaaggcattgtatctgccgagaagacatctgaccagatattagaagctaacaccgatccagctgctgaccagtcatcagagtcccaagatgttgcacctgctaaagttgcaacggagcaaccattagaaaatcaaaaggctgcagcttcagagcagccattggaacctcaacacgaagcatatgaagagaatccacaagagcataatagtgatgcaactgccaaggagtcatcagaacctgaaagagatactgcttctgatcagttggctgagcagccatcagaatctcgaactgcaggtgagaaggcaacactgcgtgaaagtgatgtggttaccgaggatccagcagaacctcaaattgatgcagctgctgaaaggtcagctgaggtgttatcagaatctcaaactggagttgagacaccagtgctgcatcaaagtgatagaactaacgaggttccatcagaacctcaaactgatgaagcttctgacaagtcaactgagcagccattggagcctgaaaatgatgcatctgtcgaggatgagaagccaccggaaatcgaaagtgatgatgtgcatgataaaccatcagaaagcaccccagatactgaaaccctgcctcataacactccaaagagtagcataagcattagcgaagctgcagacggcaacgtttctgaggaggcaccacctcagagcagtgcatccatagaaacgccatcagaaagtgccatagctgtcgaggaaccaaaacacgacgacgaggccagcataaagccatccgaagacagcagtgctcttgaggagccgccgcaggacgatagcgccagcgtggagccatcagagaacactataactcttgagaaggcatcagaggaagatgagggaagtgtaaagccatcagaaggcaatgatgctcttgagaaaacattggaggaggatgaggcgagtgccaagctaccagaagacagtacgacctttgagaagccatcggagaaagatgatgctggcaccaagcagacagaggaccctgtaactcttgagaaggaaccagaggaagacaagggaagtgtggagccaacacaggacaatgctggtcttgagaaaccgttggaggaagacgaggcgagtgcgaagccatcagaggacagtgtggttcttgataagccatcagtggaagatgatgacagcgccaagccatcagaggatagcatggaccttgaaaagccagaggctcacaaaccatcagaggaagaagatggcgcgaccaagtcatcaccggaggatgc

SEQ ID NO: 57881 - DNA, 3937 bp, Oryza sativa
gttttgtacaatgcttgagttgtaaaatttgagggaaaacagaaaaggaactataggtattgatttgatttgctcacaagcaataagcccctcccaatattaggaggagagcagcattgaggatttgagctttacatacttacaatatagattttgcgtgtggcttgattaatttgttgtacatcggatgatgtaaatgatatttatgcaaattactgtgtgcttttgctcatttgtctctgataatctgtggagctgttcttgattgtgccttgtggcttgtggtttgaatttcaattcatccacaaatttcagaaataatttcttggacaacctgtcaggccttctttgaaatgggaaaaatttaaaaggtttttaaaataactgaactagtagattctacgaaaatccagtaaattctaaattttagggttttaaaggaaccctgatgaagaagaaattctaaaacctccccaaaacccctgtggctctgaactctgaagtcagcgaggaagggagaaggcgggagttctccatggctccgaagcggaagccgccggcgagggcggcggcggcgaagttggaccccgacggcatgttccgcggcgtctccgccttcgtcgtcccccacgccgtccagtctcgccgcctcgaggtcgcggctccaccgagcaatccatcccaacccccaccaactctctctcctgtgcttagggtttcctggctttcgtcgtcggtgcaggtgtggaagcagaggctggcgcagatggggggacgcgtccaggagaagctcgccgccaagggcggcggcggcgcggtcacccacgtcctggccgccgacgccaaggcgctgctccgggagctcgacgccgcctggctccaccgctttcgcggggtaatcggcttggctccctagcttgaaaccctaatctcctctcggcaagcttggtgtgccttgctaccatctgcattttcacagcccaaatctactgctagtagtagtactacattgagttatagagatttcataacatggaaagatttctgctaacatcaagtgattgtgtttctttctataaggactggatttttgttgcagagagatctcggctaacatcaagtgattgtatttactactataagaactgattttttttttgattgcagagcgtggtgtcattcgagtggctggaggagtgcctcaaatccggggagaggctaccggagcacaagtttgctatcaactacgaagaggaatttaagccgaagaaggaaggtggtgctgcaggttcaggtgtgttgcagtctgcaaagaggagcaaaatatcatcagacggtcctgagaatcggaaggaaactgctgggggtaatcgagaatctcgagatgcaattgcacatccaaatgaagattcggatgttgtaaaggggcctagcacgtgtacaagtagccaaagtgcctctggagattctaaggaaaccatagcttctcaaaatgcattcaaagctgaggtataagcatggtcttataaattatagtacaaactaactgggctctaaagtctgggttatgttgttttgctgcacttatcctctttggtttgctcaaattcgtacaagctccattctgaacatatgtaaacaaaaaagaggaaacactttttagcttctcctttttgtaattagcttactctaagctctaagttacatctacactgacttcaacatgactagacttgagactgtttttcttctgctataaaaatgtacgcagttgcctttatctgttcaaaaatgaaaacactgctgtagcaactttaagacctttggtggtcagctgtatatctattttgcaccctcaatggtgatatattgctctgtaccatacaacatataactcctgaaccctgaggatttatatttcctagtgttgattcattgcttatataactaggaagcctcttctggagaatcctcaacgtatgctcctccagacttgaacaggaacataactgagatttttggaaagctgatcaatatatatagaggtaaggacattgtacagaaatcttctcattcttcttattcattgtattaacatttcatatactttctctacaaataacatttccttccctttcacttgaagccctgggagatgaccgaagatcatttagctattacaaggctattccagtgattgagaaattgccattcaaaatagaaagcgctgatcaagttaaagacctccctgctattgggaaatcattgaaagaccatgtatgttaatccttttctaccattaattcatattaattggtgatttacaagtcaacatatatatttttggcctttgtacaagttcatgattctatttttttatccactatggtctatgggtgatgtagtaactgtgtcataactctgttttcttaaaaatatgttggtcttctattttgttttgctgttgagggctgaaaatttattcacaccttcattgagcaaacaggttctaaaagtaccacagaagttccaaggaaaatatgaattcatacattcatcgttctacatgtaatatctcaggtgtttgattgtctaactacccttgtatatgcagattaatgagatagtaaatacaggaaagctttccaagctagagcactttgagaatgatgagaaggtaacttggttttcagtgaacaggagtagctcttaagcattatccagccatactccctgatatttactgatttgcatatcaccttaaaggttcgaactgtcagcctatttggcgaagtttggggtgttggtcctgcaactgctctcaagttatatgataaaggacatcgtacactggatgaccttcaaaaagacgattcacttacaagtgctcagaggattggcctgaagttctttgacgatatcaaacaaagaataccccgacatgaggtatgtattctgtaagcccattgaattgttttcttttcctattattactagctattcgaagtacaatctaacattacacgtattttactctcctgttatctaggttagtgagatggagaagcttttgcaagaagttgggactgatatcttgcctggggtaagttccatatagtatttaaaggaaccatttgtctccattacatataactacacaagccattcaaaaactaatactgaagcatcagttccatgttcaatttgtctcaacatatgcggtggttattgtttcctgtagcagctagttgcttacacctattttttgtagttccctattagtctgaacctgactacttattttgtttggagaactagatgggttggttcatcaccattcctccagtcatcctctgaaagtacacatccagtacaaaaatgaggaatggggtcatcctatcgagatcctaggccgatttgattcttgaaaacaaatagctcatatatttaagattttagtagaacaataatttcccttaagtgattattgggttgttatacatgatcttttttatttggaggtgataattgtatgtgggggatcatacagacgtggaaaatcttcttgtggtgacatggatattattatcactcatcctgatggtgaaaggtatacttcaaaactttcaaaaattgttggttattgagtatgccacgtgatttttatttaagtatgatgagaaattacccatctgctgtgcgttcagtgtattctattgaattcaacactgaaccttggcaccacaccaaacagccatttagttattttacagtcatggaaagttattttctggcaacttgtaggtttggtttatcaatttgtcatctatcataagcataattattcattatgaccaagtttctattatgcggtctgcacacaacacatttttatataagaacatcaatgattaatcatctggacattgtaaaaggg

SEQ ID NO: 57882 - DNA, 5335 bp, Oryza sativa
  unsure (1)..(5335): unsure at all n locations
tacacgttatcatgatcaggaatgcaagaccacagcttttttttacaagtttcgtaattgaaacatgcagattaagaatactagcagattccaaaggctacattcttgacgacactggtttgtatcttgctacaccgggcagggtggaaagcgtgtatgtacatgtgatttttcattccaaatccatacaagttgtttgctttgctccattcattgtgagtttttgcaggggggaagatcagatgctataattaattgtgacaccgagaaggatgtgttcgatacacttggattcccctggttggaacctcacgaacgtaatctctagcctttgtcgaaacccttctgtagaaaatgcagtttgctagagctatataccttttgtatttcccctactttctattgccagtaggctggctgtttccaaacctgtctgtagaaattaggaaaaatgtagatgtagtttgctagatttttatagttttgttttctcgtactgcagaaaagcagagttgtttttgtctttgacacttgccgcaatggtcaaactctcttttgctggcatgtactaactgcagacaacagtatatatataactctgttgtaaatccatttcttatgacctctcagacatcacaatggtttgcaaagatcataagcagagtgggctccgtgcgcgggtctatttttcagtcgtatcaagatgatttttaaataacacagtgcaacgtctcacacactatcaagcaaccatgcatgataactcaacggcaaaaaaagaagtgatgttaaagcatatcccatcgggtcaactatgaacacgaaacatacaagacttcaggcctaatgtggtccatcttgaatgttcttgtgaaatttgacaggtcaaaaggcatttcttaacctgttacactgagataataatcacaatcctaaaactctcctttctcttgacattgcctatccaagttccgcatgcagactaatgataatgctgcatcccggacactagtagtggtgtcaaatttgtaggcataaacactcaaaagtcaagaaaaccctttagtccataagtagtaccctacatggatgtgatcatgtgaagattatttacatctctctgtgcctaaacctacaactggaactaagaagtggaactagggcagcaaaaactgtgatcatcagaagctattgctgggaccacctccaagcatctcctccctgtcgatgaagcgctcaagaagctccttgttcttggtaacgatgcattcatcatccttgccaaaccaatcgtagcgattctttgcaatgtaatcgtagattgcatcccgcagtggggcggggatgatcagcagggagctcaaagctgagtagggaagaggcaggtacgatgcaactttcaaagcagctgcaaccaaaacatggaagatttagtaccctgattaccacaggaaataagggtgggcaaatatgacatgattaaacagcaaaaagtacataaagaattgctgtttattttttttccctaaatgagtatcattaaaaggatccttcagttagtactttcgatcttccagttagtgctgctatatggacagtacaaccatatctataatctatgtattctgccagattaattgggtctcagggaatgattgagctacattatgaaaggaactgtggcctctagaaatttgtacttttttgcaggagcacagcaatggctatcattgcaataacttggttgaacaaatgcatgatccaaaaaaaaaatactagagtgtaaagcatgttgctctcatgcattactggtaaataagggggcacacctatctatcacaaacctagcaaatgttgaatcctgcatttgacacaactcataaacaccagaaagaagttcagaggtgatcccattcagaaaatcaaagccataaccacagacactagatggtactgaaaatcacccaaagcatttatcaagtggcctctaaactccaatgccctccatgatggcattcttgcagaaaatgacaaagaaatccactgcatttcccaacgaattttgcctcatgccatgcaaaattgctacaaattcaaacaaggtatgcaaatccagcgagtacagggtactaactatcactcactggtatccatccaccaatggttgcaaatttttctaccactcttagatccccagcattgctaatctactagtccgttgatacagagcaagtttaatagtatagcccactactagctctaaatcatctatagccaatgtaatagccaattcatacaatagttgcttattacactattaatatctggtcccacctgtcatacacacattacgttttggagttcgtgctgtagctggttacagatctatagcccgctgttcttctctatcttcatttatctctttaaaatatatttatagctggcatatagtatgctattgtacctgctctaacaagtagccaacatgttcttggaaagatcacaacattgccccgatttccgaatcatcagagatgcaatgctaacctgtggatccctcgtagtaggcctcaggcccctcgatgaagaggactcgccgcagcacgtcctccctgtccatcccgaccagtctcaggtacggctccgcggccttggactgcacgcagcagaacctgatcttggcgtgcttgtccgccttgatcacccacttcacccctgcaatgcaaagccccaaaccgcatttcgatcacaaccaaatgcccccaattcgtcgccgattcgaggtagaaatgagtccccccacaattgggggcctgtacatgtgctcaccgcggtggcagaggtggcagacgccgtcgtagatgagcacgcgcggctgcaggacggtgggcgcagtggccgcgatggagacggtggcggcggcggaggcggaggacgcggtgcgcggcgggggctcctcgtcgccgacgacgacgaggtcggcggccgcgcggggcgcgtagccgcggaggcccgcggcagcgaggagggggcggacgcggccggcgagggttcgggtgagcattctctctctctctccgccggcggcggcggcgcggcgaggcggtggttctacacacaacacgcgggtgttggtttccttttgcttgaccgctcactctctccaatttattttggacattaaaagggccttctggcttggagggtaagtaaaaaaaaagttttatttttccatttgtgcttgtgtagttgccaaagattatgtgtgcttatttttaaagaattatgctcatctgcaaaaaaaatggtgcattttaattaaaccctaataaaattgatttgctattacaacaactataaaaaaggggttcaatttactccatcacggtattttctctccatatgtaagttgtatttcacactgaaatttgattggatgatagatgggtaacaatttacaacttatgtcttattatccttttagaatattttttataggtgtttacataggttggaaatacctaagattaattttgaactttgagattttaaagttcaagtaaacgatcatgaaaaaagttgcaaatattatttgaactttgatagtggtgtctctatggtttaaaaaatttcaggtataaagagaaagaaaaagaagaaaaaaatgctattagtgagtacagtgaatcattttcaatagtttagagacaaaatgaaccaaaaagtacttaggggtaaattagaaaaatattttagtggttaagtgatccaaatgaaatacttcgagcgagtaagattgattttttctcctttttgttttccaaaatagatatcataaccaatttagtgggattttccttggtcttaccactcggccctgcacctttagaattctaaaaggcacatttttttttgtcaaaatttgaataataaaacttaattttagagttaatttaaagatttttcatcgtattttttaaacattaacgtttaagttgttattagttttaaccgtaaattatttttaatcgataatatgttgtttggcgcattatccgtaattggccaaccgatgaaagcctgagaatgaaagtatatactaacatttatattaaaattatttttcattgctttcatcactaatgcttcgttcgttttttattaacttttgcaactccattcaccgtgagcatgctttctaaacatcaattgaatggtgcttttttttacagaattattttatatataagtttttttaaataattcaaataaaaccatttttttaattttgtaatagttaaaacttaattaatcactactccctctgtttcatattataagtcgcttttgatttattttctcatttcgtaagtttaaccaagtttatagaaaaatatagtaatattttcaacccaaaagttttatatgatcacaatatatttacattcaatgttacatttattgaaagtaaatttaaagttatagatattgttaattttttttgaacctaaaaaagtttaattatacaaaagacaaatcaacttataatacgaaacgaaagtagctaataacatgtctcagtttcatgtgcaagaaaacagctcagtacaaccgagtatatgtcccttttcaagtcacattcaaaatattgtaaaatattggggattctaaaagttaaaaggcagttcagattgtaatcaaattaaaccttatcaaattttgtcattggcaacttagtaatattgccaagttttaacatgatttcttatgtatttactaaagtttggaactccctccgtcccattttatgtgcaaccatgattttccgcgctcaactttgaccgtccgttttatttgattttttttcaaaaaaattttaaaacataagtcacgagtaaagtactatttatgttttattatcacataacaacaaaaatactaattataaaaaaattcaaataagacggacaatcaagtttgtgcggggaaacttatggttacatttaaaatgggacggaaggagtaaaaactaagggcttatttggttctctaccctacctatttattggtagtgccnaantctangcnaattttggcactaccaattttttggtagggaaaagttaattagactacttttggtttaataccaatatggagccaaattttagtagtatggtgaagaatattctagaatatgtccaaattgagtatgggcactatcaattgtttggcttcaaaccaaactagcatatttactatttaaattaccaaaattttggtagggcacagttttagcttcaatccaaaacggtcctaaatagatgcacatctt

SEQ ID NO: 57883 - DNA, 10112 bp, Oryza sativa
ttcctgcagccctccaacggtgaaacggtagaacccaaaacctcaactccaggagcttccagctccagctcacccctcctctttcacgataagaggcacccagacgaacacctaagctacgcgcgcgatgctcccatgggcgccgccgccggcgacggcggccaccacctccccggcctcgtcggctccgctcctccgcgccatgccccggcgcgcgcgctctccgcgcctcccaccgcccccgcaccacccttcccctcctccgccgccgcttctctcggttggccccggggcggcgccgcgcgccgcgcgcccttcccacggcgacgtgttctgggaggagccggacgacggcggctccgggagcgacgacgaggatggggatggggcagaggccgaggccgagcggcaggaggccaccgggcggaggagcagcttctcctcgttcccttccccctcgctgttctccaggctcggcgccgcgcggcggcaagagcagcgagaagaagaggagcttcgaggaggtattggttcatctgctgcatgcgctagacaaatcaaattttcttttttcatttttcagtttcttgatcagctgaattgaaatgcttcatgttctacacttaattctgtcgaatttttctgtctagaaatcgagcttctcttgacgcctgaagaaatggctatcctggatcagaacgagaccccggatatcaccaaaatatcatcagtaagtgtcactctgtaaatgtctgacagatattatattttggtgtgtcataaatttgttacattgctacagaatcttgattaaggaaatgtgcacaccattgatattttaactgttcccaattcctgaaattggactgttttgtgcagccgaaatggcatccacttcatagttacgcattggcgctgcagatacctctcatggacagcctgctcgatagtggtgtcgatatcaatttacttgacaaagtatgttctttctacataacatgttgaggaagcatgtttcatgctcatgattttctattttggtgcctgtgaaaaaccccatcttggattatgcctgtgaaaagcttttgcgcattcacgaaaaagaaaaccgtgttaattttgggagtgctgatgatacaggatggtttcaccccacttcacaaggctgtcataggcaaaaaggaggccgtcattagccatctcctgcgaagaggggcaaatcctcatgtcagagatagggtaaccttgcaaggctgcaatctctttctatgaattatgtgttccataataacattagtatgtggaatatagtaaactttgtgatgttagcgcctatcacattgatctggtttctctctctagcaacataagtacataacaatttccactccagtttgagatattttttatgtcatgttggcccttgaattaaatctgtctgatttgcaggatggagccacaccattacattatgcagttcaagttggtgccctgcaaactgtgaagttactgattaagaatagggttgatgtcaatgttgctgataatgtaatgtgctatggtgcttttttttttcttattagttcaacccttttcagtgccattgatttttcttttattttgtctcgtttcatgcaggatggctggacaccgttgcatttagctatacagagtagaaatagagatatagcaaagatattgcttgtcaatggtgcagataagacgagaagaaccaaggtatgttatgcccctatggtttactgggtttttttttccggaattgcattatcccaaaaaattagacctataacagctgcctcttgtgcactcagagccttgattttatttggcaaattggcatacattttcatgtcatttttagccgcttcacagaaattgacttctatggcattgtcatctcaaatgctcgtatttccatggacatcagctttgtattacagtctataggccaatactgctttctgatctcagatttggttacaggatggaaggactgccttggatataagcttgtgttttggaagagatttcaagtcttatgatttggcaaagcttgtcaaacttgttccggcaaatagaaaaatgtgactcagctctgtcacaagaatcagagaaaaaaaaaagatttagatgttagcaactgttgatttgggtcattcctcctattgtttttaatgggatgattcctccaatttgctatagttgcttgttcaatccattttagaacctgtttattttagagaagttgtctaatcctgattcatgatcaacttatgtaaaggggttcgaaaaagctaatgccacaatggaagaaatagccaaatttagatgatctttttcttatttgcaaaccgaggttcctcagaggcgttattttaaacgtttgatgtgttaccgttcggctatgtgaatacaaagctggctaagcaaacaggacacctccataaaatgatctcactgagattgcataacagtcgttttgtaattggattaataaaagaagtaaggatcaccacatacataagcgagcgttaattataaatatatttttttcatatcgaagccaagttttaaacctcagatgatttcatttggcgtttagaaagagttgagaaatgcacctgtctaggcaatgaaacagaatgggattgcacataaacctcaaattttctgaacatgcaattatcacacgactagctacagtaagggcgcatgtttctacagctacagataagacacatgtttctacagtaattcatggggtttggcaacatgtcactgcaaacttccaaacagagcatgtaaggtagacaaacatttcacacatcattactatggtatgagtaactagtacaccttaaacagcaaaattcatgcaacataaatttgtagagatgacacaaaatccatacaataggtgcaatggcactgcaggctagtaaattcaagagttgcctactcttgcaaggagatgcgtctaaagatggcctggaaagtctgacctccatttcttgcaaccttctgaccttcttcagtggcggtagacagtagcttgacaactgggtctgcttttgtctcttcctctgggatagcttcgaacagcgggtgtttctccaggcatgaccgcatccattctccgagctcctccacatctgtgattgtatatatgattcctcccacttccatcacataagcatactcatctagcagctgcatgctgatcaccctccgccggtggttcttctccttgaagtgaggatcagggaacaggaagaacattttcgaaagctgagccttcctgaaatagtttggaatgtatttcatcgaattggtgcgcacgacagatatgttgtcgtactttcccggattcgatgctcttaaagccaaaatccgctctttgacatactcagtcacctgaaaaatatagacaacgaagaaaaaaatgaatcaaaagtaaatacgtactagctttgaaaagaaaaaacttccagttcttttgttaagtagaaatacatgtctattgcataatataataccatcacaaactaaactatgcaacttttgtctagtagaaatccatatttactatagaatctaaattggaaggcaacccaaattcccaatatttggtacactaaacattcatgaagtaaaagccatgcgcgatctaatcattctacaaaggaaagctcaaatggtctctatgagtaatgtaacactgaattcttcagtgtcaccttgtgctgttatccattcacacatgaatgtatctctactgcccaatcaaagtttagggggaaattctaacaaaccttgtccctgagctccatgccgatcatgagggtgtccgggaagagcgtagagaggccgacgagcagcccgccgaacccacacccaacgtccgcgaagcggatccgtggcaccgccgcgtcgccctggcgggcctcgccctcgccggaggggaagtaccgcgggtagtgctgcgagaggtctacctcgtcgggcgatatcgggatcgggaagtgcgagtcgctgagcgggttgctgtgcgcgcgcgcccggtagaaccgcttccgcgggagcttcccctgcccgccaccgccaccgccgttcgcgccgtcgccgctcgccatcgcgccgccgtccccgcctgcagctgcttcttggtctgggagaggcattacgccgaacacccggtgagcatgtcactcgacgcgagcggtgttgtgggagagggaagcgggagaggggtggggagggagtacgaaccggagagagagagagccctcgcgagtcgggagagcgggggattcgccggaccggtcggcggcggcggcgtcgtgggcggaagctggcttggcagcgagtctcgagccgcgcgggttagggcttggatgttggagagggaaatggaacgaggcgggggaaatggattgggccgcgcgagttggtttaggccctaagctgcagcccagcagcgacgagatgggccaagtgccgcgaaggccccgagcacaccgggtgttcggcgtaaggaaaaagttcagctgaggtcccttatgccttatcttgttatcgtttttaaaattattatccctgaatagcagatataacacatcccgaattttacaaaaccggatcacattggatcccgaggcagtattgcttctggttttgtacaaataggaagtactccctgtgtgtttttcttggttttgtcctttatcaaactatgcaaattttaccaaatctattaaaactgcgataatattacaatatcaaattattttatttaattctaccattcaatataattttttagaatatttttgtttagtaaacttgattaaacttgataatgtttgatttatgacaaaaccagaacacctgatattttaaaacggagatagtatatcactacgttagtcatcataaatacgtctgtaatgtcgcatgatttttttattatatcttggttgatgttaaaagtgataatcagaatgagttttgcaagagcacaaaaaagtggaattggtgaaaaattgcggctgcatgcgaagctatatagatgtagcagcatgcaagttgtctacttgtctgcgtataaatctaccgcttcaaatcaaataatgatgctcgtcatagtattatcatttcttcagaagaatatcttcggctattactccctccgtttctaaatatttggcaccattaactttttagtacatatttaaccattcgtcttatctatatgtatacatatacgtacatttaaaaatgaatcaaatgataggaaaagaattaataattactaattttttttaataagatgaatagtcaaacatattttaaaaagtcaatagcgttaaatatttagaaacaacggagggagtattattcacaggagcatatctctggccacatatatttctttacaggctttagcagtgaagattaatgcatggctagctagctagctactccctccatccataaatataaaggattttggttggatgtgatatatcataatcaacgaatctagacaggagcggttggatgtgacatattctaatacagctcctgtccaaattcattgtatcagatatgccacattcaagcaaaattgcttatatttagagagagacatagggagtagttcgttggctctgcagactgcagcagtgtcagctcgtgatatactcctccccagtgtgggtgaatattggggctgtcagtaaaaacttgagcacagaaaagggaccttactaaaaatggagcatacaacggtaaagttcacccgttgtggaaagttcccaaacgttgtttccataggagtcgggccgtgtttcaacaccgctgataattcaagtttagccagtcaatttcgtccttttaataaaaccagtaatcatgcacgtgcaatacatgttctttccatcataacatgtttcgactaaattttacaatttatcagcatgagcccttaaaaatattggcggttcatcttgagaaataaagcaacacttcaatgtgtaaaaatacccactattatacactggaatccatgtagctaagaaataaatctatttaaacagaagtgaaacaagcatcatttctattttcatgcaaacataaatgaacaaacaaccaattcgtgcacataggaatccatgtagaatattaattgagaaaacacactcattcttacaatctaatttgaagaggaggtatatattataaatccacactcacattattatcctttcatcacaacaataccatatagatacacccccaagtgttgcacataattttgttaaaacttgagtgccccgggccatacctggaggaccacctcaacaaatccacaatggatttagccatgcagaatcgatcatccaaaaacaaattcctaatacatgaataaagataggtcacaagttttagctgagaaaaatatcacacatatacaattgtacaaataaaaagttatatctgcaatcgtaccagcagacctgtaaaggcacctcaactctaatgctaacatatttgtttccatttggcagtggaactgatcatctgcacagtcagaagaaaaagaacataacagtagatttgtcaggatcaatggacgtgcaaaaattcaccgtataaatgttcaatgggtgaattaacaatgaaaactttgatgtcaggtcacaactctaggatcccacttacagaacaaccaagatttttcaagaaattatttctgcttcaatctgcagtttccgtttaaccaatcatgaggcaagtatgccaaaattttagtggtttttcctaacaatattgcctataaactataattacttcactaatcctgaacctatttcgataaaagaaaacctagaaaatccactttgcagtttgcaccacgtcgagcattctcattctcattgaaacaaaataatagatatttttgtgtcattccaccaatcatatagatcatctcctccaaaactaatttgtgaactatgggaatttgtccatacatattttagatcattaaagcatctgatagtacatcacattgtattcctaattctgtaagcaagatatttgcacgcaggatgtttttttagagaaaaggtcgaagaacgaccctgcttatatagaaagcaaatttgtcttgctggggattccagcttacatcaatgtgcatacatcgaccaaaagaggcccctccggcctagagaaacaaccaatttttagacagcagggacaacacaagacccataagtgaagatacagcaggcgcatcgattcaaaaagctttccaaaacacctccacaaagtaacagacagcaaaaaaaactctaactaacccaccccagttctgatattttgcagtccagcacagcattccttcagtcttcttgtcagcaactccagttcatcagtctccacacctttgaaaagtggtttccactgcttgtctttgcactcaggatgttgataaaatacaaattaattagcctcattttgttggtaaagggatgatgcgagtactattgcaactgcctcctagcatcctttccattttgttttcctggccctttagctcattttcacttctagaaaattataattggtaccctttatatttagtctaaatcaagactaattacctcgtctgaatagaagccaaagcatgtgtaggcaccaattgttcataatttactttccaacttccttaaatcctaattaaaaaaagtgatcatgatataccggtaatcacatgacctgtagcagacaacgtggtatgttcaatttataaaagagcgtatgctataaaatttatgtgtattgctcatgtatcaacccaacgaattcattgtaatctagtaattcaggttcagatgaaagatcaacatattggctattcacttaataaaatagcatcaatatgaataccaggtataggtacataccaagaaaatgttcaggtttgctctgttattccaatttcttacagattttcctacaaaattaaaagaaactgcagtatttagcaccaaacacagccaatgattatgcattaaggaaaaactacataatttacaaatctaacctgaagtagttaatgtaaatcttcattggtcatgagagcaacatcatatttcaaatagcaaacaccatgttcaaaactattatacataaaaatattggtaattggtgcagcccactaattttaggatgattttttaaaaaattacctcaacacaattagaagaaggatcgatgtagactattgtagggtttacgcaaatacatggggtgcttgactgctcgatccagcggttgtggcatggcggttgtgggtaggataatggcattgatgttgtctcggtagcgaccggggcgcagtacaacggagtacttgaatatgttaaaatagctcttcaatttggtgctaatataaacagactcatcaaaattccccaaatctacctcttgaaatgttgatgctttcccttccttttcaatccatcttcccaattcccaaatccacaaatcaggtattacaatttgcaaatcacaaataagtatatgagaagagaaaacaggatcccaagcccagctagcaaatgctggccgactgatgcggtcctgtttgctgcttactagggaggcagctgattgctcctcggcgcccacccacgtgctggctttctgcccgcacaacacagttgcattgcgctcttgtggcgccgccgccttggcctctggtagtcaggcctcggcccaccaccaccgccaccgcctttcgtaacgcatgccgcccgtgcccgatcaccggcgccgcctccctcaatctcatacgctcgcggcggtagtggcggctagggacgacctcggctccggcggggacagcgatggagggcagtggcggctggggacaacctcggctacgtcagggggcagcggtggagtgcggtggcgggtggcggtggctacggccgggggcgaccacggctcggtcttcggtgggggtagctgtggagtgcggcaacagcggcgacagccgggggagacctcggttccggcggggcagcgatggagtgcggcggcggcaacacggctggggacgacctaggcttcgacaggagtagtggaggaatgcggcagcaacggggacaagcaaggaggagcgaggagcgcggaggcggagtcttcgcgcgagctaaaatcatgatggatggatagggtgaaatcacggtcgctgtgggaagggtgaaatcgccggtgaacggtgcggattagggattaggcgatgcggatgcggatgaacggtagggattgattcgggtgatttggcctgtaggattggagggggacaactcctcctttttatattagtatagatatgatgttgtaagtttaaccaccagccaaacaacgttcttttgctgagttgggatcctctcctgtaatgcatgtgcagtaagtgccaatgacatgtgggcccggtataggtgggacccacatgcatgtcagtgacacgtactgcaggtgcagtacagcagtggatttgcgtcctcttttgctaggttctcaacttctgcactccatcgtttttagcttcccgagctgttaaacatattttgcaaaaattttctatagaaaaattactgtaaaaatttataataatctattttaaaaacttttatttactagtacttaattaatcatgtactaattcattactctatttacgtgtcggtgtgaaatgttcccaacacagcctgacgaacgacacatcatcctcatctctaggtagcgctagctgcgcctctcgcagattcactacaaatgaagacttaccggcaccggccgcgggttttttgtcatggttgtacaatggcactgcttttatcatcatgctatgcacactactacatgaaagatttttctggacgccgaacccttttgtttccaggcggaccatatgtggaaccgcacaggaaaatggggggaccggcgctaggccatcgctcacacagaaaaatcaattttcatgtgcgggtccccatatggtccgcctggaa

SEQ ID NO: 57884 - DNA, 7756 bp, Oryza sativa
  unsure (1)..(7756): unsure at all n locations
cgcacacgaaaataggtgcccaccatttaatccggccgcgcgcccattcctccctctcccatctcctccctcctcccatctccatctccctctccccctcctcccaagctgcccggatctggcgggcgggagcagcgggctcggcgaccgagagcggcgtgcgcacggcggcgagctcggcggcggcaggcgacgacgatggcagtggcggcaccggtctcccagcgtctggatccgtcgccggcgatcgcggggcgatggctggattatggttagggttttggttttttctctttttttgattttttattttaccgtgcggcgtgcgagcacggaaaaatcatgattttcgtagacgttgggttccagacgagcgaaactactgcacgtgaaaatgagtttgcaacacacggaaagatcgttgttgtagtagtggcagccatgcatcgatcactgctataaaatcgatttttgtatgtcctagctaggtttttctttgcacatacagccgaaatgtgtttagctaaatagttagcctcgccttaggtttgtagatcatatgtacttcctccgtttcataatgtaagttattgtagcattttccacattcatattgatgttaatgaatctagacagattcattacatcaatatgaatgtggaaaatgatagaatgatttatagtatgaaacggaggaagtaaaatatatttctgttaacggtctctaaaggaaccacttgtaagaataaattagtgcagacagtttgttagtaaatccgtgtgtcaaaacctttgtttctttattctttaacaaaaatacctaaacaatatcatagaaaattttcgactgagatgaaccaaggcgttcatctaaaatccttataatacctcctttaatatgaccaggtcaataattcctcagaatattttctttaacatgacataaatgaacgatcgtgacagtggcgtatttgtatatatgtatatgggtatggcacacatgtgtgtatacatgtaatcacatgattgcgaaagaacatgcagtctagtatttgtaatgaactaagcagcacttcaagagtgctgagtttaaatctttataagagcgaattttagattagattatttgaggggctaagttttctatttaaatcagtggcggatcttctcttgtggcaagggatggcaccggccatacctatgccatgcccaaaatagatagggtatttaagcatatggccatctcagccttgattacatatgctaattatgtgattagttagctgtattttaattggtacaagcttattcgtctaattaactggaggtaaagacctatagtgggactgccttgtgtctgcacaaatgaatgaatagtctagctaacaatcggtaaaaatcaaatgctaaataatagtgaatgtctacttgttatgaataaacacacctaaaaaacaggggaacactcgtggaaatgtagtttagtcgtaaaagttatacggcgaatttaagggcatcagttgtaaaaactgcataacaaatttaagattataatcattgtttgttattcgacgaatttaaagtgtcagttgtaaaaattgcatcacaaatttaggattataatcatcgttaatagcatatattctaataaatgcgaacatatattatagtttgtgtataataaaatgctacttcatttttaaaatattcgttctggtgtgatgatccgccatagctaaatttttatgctgtgtccgccactgatttaaatggctgcataatctagttggatataaaggccgggtaaaaatacatttttaaaaaaattaatcacatgattaagcgtactaccggtggctcctccggtgatttttcacggttgcacatgcttgcagatccactgacacgccgcacataatgcaacgaccagctagctatagccggcgtcatgctactatacaagcattaatatgttatagtacaaatactgtacatatatgtagcggaccagaagaataatggtcctatatatcctgtaccatacgacgactttcagctaagatcgatatctctacgacattatatttaccaacttggttaagaaaaaatcacttttaatcatcgatcactatacctagctagactagcttgtccgaggtgagcatgaattgagacgagagctagcctagaccgtagtctaatggtctaattaagacgctagacttgtccgtctagacagttaaagacgatcctaaactgtcaatatcacacatttaaataacaataagatgagcctaaaccataaaattatcgtttaactatgatccaagcaacactaatgtattttttgtgagagaggagctaaaacttcgtgtcccacccaaggtccatattgcttaaggttttgacaccattacaaacccctatgctctgcacgaaaccttgcgttgccatgaagttgcaatgggaagagagaaggaagaaaatggagaaggaaggaaatgaatgaaaaacatgaccctagcatggttccaaatttgtaaaatccagtgacacaattataaatagacaaattataatgatatttatctaaatagacatatttacaatggcacgaatccaatttacactaaaatttagtagtggtttctattattttggatctcctgaagaccaaactaaaatgaccaaaaccgatgggttttcattatcatgcaatgcattttgaactttattatatttctagcgaaccgaaatatattgttttggtttgaccgaacgcccacccaaaatcgtgccttcatgactgaaatcaaaacttttaagtaaaataagagcgaaggcaatatatttttgtattgacatatacaggcatgaagccgttgcagtatttgactggaggggtcaaacctgcatatatatgggcccggatgggcagccactcgaccagccagtacagtagtactaccgcacctactcataaaagaccaaaacatgtaggagtaaaaagctggatccctggcctatccgctcatgccgtgcagcaggcagtgctgtatatgcaatcaggccaggacatggcccatcatatctcctacgaatgtgacttatatgtgcgtgatatatatgcaccagatctatgatccatctggctagccaaacatgcatggcccatatctgcatcttgcctttaatagttcagtataatactaccttcatcctagaatagatattttgggtgtgattagttcacgccaaaattaaaagtttggttgaaattagaacgatgtgatgaaaaagttagaagtttatgtgtgtaggaaagttttgatgtgatggaaaagttggaagtttgaagaaaaggtttggaactaaacaaggcctttgaaggaatgagacatatactagtactacaaatttaaacataaagattgtctagattcatactactagaatgtgtactatccatttaaatctcttatattctaggataaagggattagtcgctaaaagtaaaataatattatatagatacccactttgtttcatgacattatattgttttactttgactactcctgtttcatgaatatttttttaaaagaaacatggcacaaacgtaaacgcttacagcaaacacacactcacccttaaaaacacactcacacataccatacctctataagcacctcctaaaaactaggctggcatatcttaaattgagtaagccatcacgaggcaactcacccctaagaacttacacacgcacaccctatcctataagcacattcaaaaaattgtttcagcatatcttaaaattgatgaactcaccacggatggcacgctgtcgaatgatacattacctactattgaaagaacaattagtcatacacccgtgtcatttctaggatttaaacccaggtgaataggattctagctaaatacactcacttcactttcatgaataaatttgtaagagtgtccaacatactatattattaataaagtatattatacaataagtatataaaaaatcccgttcatcatgattaaacgatttacttcctctatcttaaaatatagctatttctagcacaatatcttgtcccagaatgaagctatttctctaactacctcctcctctcaaccaatcacaaccattcttcttcacctatctcctcttttcaaccaatcacacacctcctccaatcattcccacctacttttttaatactcgtgccaaccttaaaagcaagtttaatagtacagctaactactagctcgaattcatctatagccaatctaatagctcattcatacaatagttacatactacactattaatatatggtcccacctgtcacacatacactgcgtcttggagtccgtgctacagctggctacaaatctgtagcccgctgctcttctctctcctcatttatcttcttaaaatatgtttacagctggtttatagcctgctattgtacctgctctaaaaatacctatattttgaaacggagtaagtagaagatatcagtgatcaaattaaagcatgcactgctactctaaattatagaatattatgaaacggagggagcacattcttttgtatgcgtatggacggatgcagccttttacatgcacctatgtacagtctgctcattgaattatggagttgctagaaatatggcgccatatgctacaatcgattttttttcagtcacttacatatgtaattagtatgtaattttagtacttacatatgtaattttaagacttacattataaatacactaaaattacatatgtaatttagggatttacaatgtaaatacatgccgactatttttttataaaaaatatggcgccataaatatagctacacccttgaattaaccaataaactttgcatctcgtacgcagaagttgatggaatttggattttggatgtttgatacggccgtcacactaatgtcattgggcagtacgtactgactagccggtaattacatgcttgtacgtctggccaattgcccaaacctggtgtttaccgaaatgattgtactgttgtgaaaggctgaaatggccttaagtgcgagtgtacaactttacctgctagggataaccctgatgttcatgtttatgtacatgtaggtgcatgctctttaacagaaagttttgtaagttgtacgttcggatttattgttttgattaatttgtttattatgggccctgcattgcagtgatataaatcttagcttctattttcataaaaacaattgtacctacatggctacatctattaatccgagcaatctatgccattataatttggtaccacaatgattgatcaatggtcagcgtgaattttttttctccatgaattaagttttgtttggcacaactttagatcagaattttttagagccaatacacttcagaaatatatggatctaaatttgttattaataacatttggataaacacttttctatatattttatatgaaatatatataaaattttaaaccactttattttaacttacaaagtctaaatctagtagttatatatgtggagtagtaggaccatttcctgcttcagctctagaaaaaaaagtggtttagattttactactactcccaaaaaaagctatgtggagtagtaggaccattatctaaaatctattactactccacgatccactttattttctgcttcagcttcagctctagctccatttcttagagctgaagtccaaccaaaaaaagagtgaaattctgtttagaaagctctagaatgtgaagactccttgtataatctttactccttaaattaaatttaggataatctttaaaccctcgaatgtgaaggctccttttataggctttgataacttgtgtttagccttgagtttattgtcctttttaaggaggattgaggcaagaggcagcactcagccaacgtacagtgccgttctgccgggacagacaaataaaaccaagcatcctgcaggtttcatttccagttctcatatccagcgaattctcagctttgctatcgcccacagtgatccgctgctccaccgctacgacgcacgccatcacacgcgcgcgcgcgccgtcgcatcgcagcctgcaccttgtggcggccgtagctcgctctcgctctcgctctcgcggccggtgaaatggcggcgcacgacgcaatcatgtcttcttgctagctagctagctaagttcgtcggcgcgatgatgtacaagcatgtcggagacgacgcacgcgggtcctccgcgggcgtagtgtgctgcgtggatgtcgtcgacgacgacgtcgacgcgctgctgtgcggcgaggacgccggcgagctggagcgcgagggcgagccggcgcaggggtcgtcgccgtcgtcgtcattgtcgtgcgccgccgcggccgccgcagccgctgacgacgacgacgaagacgaagacgaacacggcgtccatggcgaggtggtgcaggtgactccaggcggggaggagcactgctacgactacgactacgacgtcgacgtgcccgtcggtgccgagctcgtcatgcctgcttgctcgccgccgaggacagccgtccaccggcccggctggtcggagtccgtctcctggatcctcaaggtgaagctatagctagcaccgccgcaatctagctagctcgatccatggcaatctaattaacttgcacatcttaatttcactcgcctttcttctccaggtccggtcagtccacggcttccagccggcgacggcgtacctcgccgtgagctacatggataggttcatgtcgtctcgcagcttgccggtaaatcaatggccgcccacacttttgtctctagctgtgtctagttactggattaagcgcagtgcactgcagagagccagagattaggccttaaaaaaagaattagctgcagattacgaatcaattgatcagactatgctgctgtagcatacatacttagtacagagttggcagaatttgcagtaaaaaaaaagcacacttgcactatagttatgtgccgatgatatgtgggttagaatggtactgaatttctaagtaacttgtgtgtccgtcccaaaatatatatacttttttgagtttttcaaaagtactaaaggagatatatanaattanattggaanatanttgtgaatagtttaatgagctgaggagncatgtgtatgaattanatatataaaggatgattgtgattgtttaggacgagagaataatattttatttgtggattgtagggaataagtacctagctagctagcacacaaggctaacgaatgtttttggcagatgcaactagtagcagcaaattaattgaggtcattagggatggaattctgaatctatgttaggtggctagtagggcattattctctgtcagaggatgtgtctattcaacagggaattttaactttcccattagtagacaaaaaacatgcatgtgaccggtgatgccattttctgcccaggtgtgccaccacaccaagattgagaattatgattggcaggggcactattttgatttggatttggtctcaatccccgatctacatggtcactaccctgattaagaggtaggacaaggcactttttcatggatcgacgttctacatatttttgcatatgattatcatgatccctctgctacagaaagccacagccattccttttcttaaacggctccaatttataatcgtctatagaaa

SEQ ID NO: 57885 - DNA, 1651 bp, Oryza sativa
gttgtcgttggttgtactattccatcatcaattctcattgtgatcagttgcatggtttgtgatttgatgttatacttcagatttttctcttcgaacaagatttcttttaatcgatctcctcttgttcctcaatgctcagagaatgcggtgcattctttgttaatgcagagatagacagctgaatttccagttatcttaagaactctactcatctgattctagcttattattgcaatttgatttctttcacccaggatcatggttgggcatcccaattgctatgtgtggcttgcttgtctctggctgccaagatggaggagtcctctgccccacccctccttgaccttcaggtaactaacttgatgtgaatagtgagtactcaatgtctttatttgcttttgttatgaatatgaatttcagcaaatgcaaacagattgaaggaacaagattcatttttgaacctcggacgatccagaggatggagctcatcgtcctcgtggagttggattggaggctccggtcagtgacgcctttcgcctttgttgatttcttcgcttgtaaggttggctcctctggaagaagctcaaggatcttggcattgcgtgcttgccaaataattctcagtgcaattcatggtaatgctaacgttttctttttgagggaacagaaaacaaaattttactctaggatgcatataggttgatcatttattcgcatgccatataatatactagatgaataatcaaaattgttttcgttagagtctagttaaaatatctaaaataagcaaaatgttgattatattttaattttattaccatactatcactagtagtaaaaggtggcataacataagtaaactaaatgccaatgtcaagaggtgcaaaatagtacaatgaaatataatttgttgttttcattgcctgaataatattatcattgcatctttgactctctattgaagtacttttttgttcccctctctttgatgaaaagatgaatcactggagttatggtgtgagtagtgagtactcaatgtcatggtcccgaaaactgttggttttaccggtcaataaccggatggcaaccagttccccgggtagttaccggtcggaaggatgcgaatataaataaaataacatattgtaaaacttgaatatagaactattctgttcgggaacatgtaaaattctaaatttagatttgaattcaaaattagcatttaaatttcaccaggcctgttcctgccaaaccggtattctgaaccttgctaggtagcactatttgcgtcaggattaagagggtgtttggatggtgaccacactttaccacaactttaccaaaatctgttgtagtacataggaaggagattattggatttccatttcaatcaaccagttagctggctaaatgatcatccactacctgggccaatccaaacacatttgtaacatcctggattcctggtgacagttcaatgtgacaagagatcagatgctttcttaaccctgctaaaataatagtacttgcaccattttctgtgaaaaactacatgagtctcatcatcattaattacatattgaaattaagtgctagtaattatccttaaacatcccaactaatgctaaacttgtcctgaagggctgcagga

SEQ ID NO: 57886 - DNA, 1573 bp, Oryza sativa
tttttatatttgttattacaggagaggatcagcagttgctatcagctgctgcagcgagctctgaatgctactgcgaggaagaggaagcgacatccgatgatacttgcagcttgttcatcagtaacaagttcatcttcccggagcaaaaggcgcaaacttgatggccattttggagaagattgaatctttcttttcttttcttttcttttcttttatttgagtctgaattatattacattcctcggcgatttctgttcctggatgagctatttatttgtttatttttgcatccttgtggttgttgaagctttgataattttgtagcttaattcagaaagatgacatatttgaacataaatgtggggatcgagactaggattaaagatttctcaaagaaaaaaaaagagtaaaattaaaagaggagcacctgtatgatgaaatcgatggggaccaatagggcagcaacctgtgtgtatttctttctgcaaagtgatgcgaaagtgaagcaaaggatgcattcgatacgacactttggactattgggcacactgcactttgcagggctgatcaagttagctaccactagattagcaaaagcttcctccccttgtttagccctgtcaaagatttgtgtttgtttagctagttaaacctgattagtattatttagtagtactttttttttcactgctcaggaggactactcctaggacagtaggacctccattttcagtgacatgcttatactacttctgttttaaaatatagctatttctagcataatatcttgtcccaaaataaagttatttctccacatacctcttcctctcatccaatcacaaacattcttttttttttgaacggaaaaacagcactagagtgccttttcattgaatagagcaggagaaaatacaaacccctaggggtaaaaggaaaacagagaaccactatagaaccactatagctgtatagtgtgcgagattaactcacgcaaccacttagctcctgctaaagccccaaaggctcgcctcctctttgattttcattagtaggaagttcgttgccacctatttgtgatcaaaaatccgccgattcctctctttccaaatttcccagacgactaacagaatgagcgatcgaagtccttttctcgggacactaggcgtgtttgcaatgttctcccaccactgtttgactgactgggcttcctcccattccgttgggtccatctgctgatagcccacccatgcagagacgaggtgccaaatcctcttggtgtatctacaagtggcaacaaggtgcaatgccgtctcaatctcgcggcggcaaagagggcaacaaccattgttctgccatcccctggtcgcaagccggtctgaagtccagactctgttctgaatgatgagccaagcatgaaatttgcatttccccgacgcccaggctttccaaatcaaggaattgaattttgtgctcggcgccccgcagcactgtgcatggtaagccgaggaggccgtgtagtgcccgttgtttgtgaacttccaagtaatctgatctggttctgggctgcaggaat

SEQ ID NO: 57887 - DNA, 12596 bp, Oryza sativa
tgacgggaggggtatagaagggatccaaactgaaatttagggacatggaagggaatgagcaaatctcataggtatagaagtgattgggcgaactttccgagatacacagagaattttctccaaagtatacctacatgtcaatagctatatgttcacctatctaagatcacgtcctatatcatactttcctaacttttccaaacttgtttatcgtgtgtatgctactcaaacatttaaacaatacatttttaaaacttcttttataagaaagttgcttaaaaggtcatataaaccattttctaattttaactaatacttaattaattatgcgtcaatccgctgctccatttttcttgcgggaagaaaatgttgctatccttttcaaaagaacaaaaccttaagcatagcgagcctaactcgactgattagattccttgtgatgaatcttgctcactggggtatataccaaacacgggtgcccacccatgttcaagtagacttgacataagtgctcacatttacaactagtttttttttcacgacgtactcgttgacatcaagacatataaagtgactttattaatctcaagatatgccgcctaattttatgagcacatactattgtactacgttttttttaaaaaaacacagccttagggcgaaggatcttgttccgacttaatgatgtggtagcgccaaaagattaccttagaggctagtagtatatagatgtgtcgatcttgccttacaaaagatcactgcaaagcagatcgccgtgcgcctgtgtgtgctttgcttgcctggattctttgcctgtaacctgatcctgtcgcaaagacacagcttaagtagttaagtgtaagcatactttgcagttttgagccatcactccactcgcaaaaagtggccaaaaggagatcgagaaatttaaaaaaggcaaagctagtttaaaatcgaagggaattgtttgaccgattttgtttggatcatatggattctttgatgcttttctcccaggacgtgccttccatgccataagctcagcctcagctgtcgctaaattctatcgctatcaaagagctcgtgcacaacaattcgtttacggacagaagcaactgctagtttttatttctattttttaatttttgcccagctgctagtagaatatatatggaataatggaggttttcagtttccagttatgaaaaaaaaaactttacgtcataatacgaacaaggcctagctgttgcattatgttactggaaggtatttttggaagttgcaacaagtcacgatatcacataaatttgcatgttcccttatcttagatgaaatttaccatttgctagtgaaccaaaattctgtctaaaacaaagtgaacgtaacttgattggttagcctcgttatggtgtgcaacttagggcctgtatagatccactggcaaaatttttcaccctgtcacatcgaatgtttgatacatgtatggagtattaaatataaacgaaaaataactaattacacagcctgcgtgtaaattgtgagacgaatcttttaagcctaattgctacatgatttgacagtataatactaccgtaaccatttgctaatgatggattaattatgcttaataaattcgtctcgcagttcataggcgaaatctgtaatttattttattattagtctacgcttaatactttaaatatgtgtccgtctattcgatacgacaagctaaattttttttacccctaatctaaacaccgccttattatccccctttgagttttcaacccatcataatcgtatgggtgatttgcgcgtgcgaatatgagcgtaatttttttgggactgtatttaaaaaggattttttttgttaaaaagcatttttgtaagaattttttttgttactagaagtattccagctaaaaaagtcatcgtctcccaaatggcgcgtcttgaaacgctgtagcgattggcgttggcgaccaccacaagtagccgtcgctacaaaccacggtgcgcagcgcatccaagcaaacaaaccaatcacacgagacgcagccgacgaacgcgtccatggccaccgcctggccacggtggcggccgtcctcgccgccgatgccgtcctcgtcgtcgtcgtcgccgtcgtcgtcgttcacggcggacccgccggcggagttcctctgcccgatctccgggacgctgatggcggacccggtggtcgtcccgccggggcagacgttcgagcgcgcctgcatccaggcgtgcgccgcgctcgccttctccccgccggccgtcgccgccgacctctcctccctcccgccctccgcctcctcccctctcgtcctcgtccccaacgtcgcgctccgcaccgccatactcaactggtgcgaccgcctctccctcccctaccccgcccctctctcccccgacaccgcgcgcgacgtcgtccgccgtctcatgccctcgccaccgcctcccccgccgaggtcgaaggcgccgccgaccccgccgccggcctccttcgtccggacgaggagctactacagcgacgacctcgtgcaacagcagcagaaggcgaggcgggagggtgggtctaccgaggagaggatcatggccatgctcggcgctggccccgcggagcaggaggcggcgatggcgttgctgcggaagatggcgcgggagaacagggagatgcggagggagctctgcacgccgcggctcctcgccgcgctccgcccgatgctgctgtccggggacgccggggtccaggtcaacgcggcggcggcgctggtcaacctgtcgctggaggcggagaacaaggtgcggatcgtgcggtccggggcggtgtcgccgctggtggaggtgctccgcagcggccacccggaggcgcgggatcacgccgcgggcgccgtatacagcctcgccgtggaggacgagaaccgcgcggccatcggcgtgctcggcgcgatcccgccgctcctggagctcttcgcgtgcgccggcgccgcccacctcgcccgccgcgaggccggcatggcgctgtaccacgtctcccttccggatgaccggtccaagatcgcgcgcacgccgggggtggtgcggacgctgctcgcccggcggaggcggcgagggacgaccgcgccaacgaggccgacgccgccgccctccgcaggatcgccgtgatgatcctcgcgaacctcgccggctgcccggacgggaggaccgcgctgatggacggcggcgcggtggccgccgtggtgaggctgatgagcagcggctccgccgcgccggggagcgcggaggaggagtactgcatctcgtcgctgtacgggatgagccgggggagcctgaggttccgagggctcgcgcgcgccgccggcgtcgaggccgcgctcacgccggtggccgagggcgccggcggcgtgggccgggacatggcgcggcggacgctccgggcgatgcgcggggaggacgacgaggcggcggtcacggccacggggctgctcggccggcagtgggacgacgggagcgtcgtgtcggaggggctcgtgtcgatccggcggccgccgccgcgccggagcagctacggcgccggggcgtccgggtcaaacaccacgcagttctgaaaagtcaaagtcttcgcttctcttcttttatttctttcttttttatttctttttttttttgctggctcttgttgaagtatttggaactgtatttgccataggccccaaaaaatctggtggttaactacttctgatgaatggtgttggtgtaattggatggtggattcttttgttggaattaagctgtaatttaattggatctttgcacatgttaaattctttatgactgaatagtggaacctagaactgtgacacctatccaaattaggtctgtacattaatccatcggttctcttagaaggtatgtatgtatgtatgtgttactgggatttctgagttctttttcctgttcttgtgaaatatttgggatgtcggtgttctttttttctaaaaataatatttggaagttgtagcatgtaaaaattctcagaatgcatctacttgtttagcttccatgattgagtttgattagcacgagatggtttcatctacggtttacgattccgagatggccttccgtttcgggatctggcggaattacggttttcgcgaaattcggtgtaaagccggtagattctgaataaatttcataaaccaaaatttgaatacaaattctctgagtttacggataagcttgcgaaaaccggtcggctttgacgaaattccgagtgaaatcatcgaaatttcaatcggtaactagaaaaagaggtaaactgaaagtgttcccctctttttaattcattattattttatttcccattataaatttcactaaatacatggaatacatcattttttaaaataatatatcccaataggttctatgaatatcatactatttataagattttatttattttttcctttttatcaattcaaatttgaatttgatgaaacttatcaaaatctcagacggcttctactttcgagcctcgtcgaaatttcgaaatttcgcggaattcgaccggttttcgtcgaaattgtgaaccctggtttcagctgaagttcggaaacaagtatcatctcagcatttcatggttgtcaccaactacaaattaaattttacattagaaaccataatatttctcggtatcttctcaaccaatgcaaactcaattaatgctgtgtttagttccatcaaatatatggacacacatttaaagtgttaaatgtaatctaataataaaacaaattacataaaccgtatgtaaactgcgagacaaatttattaagcctaattaatatgtcattagcaaatatttactgtatcaccacattatcatatcatggtgcaattagacttaaaagattcgtctcgcaatttacacgcaaattgtgtaattagtttttttttcaatatttaatactctgtacatgtgttcaaacatttgatgtgacggggaaaaaaatttgccagtggatctaaacaccctataacaaatagtatgcgacagtgcaaaacttttgatatgtcgggtgtgttcttaaggtaaggttgggaaccttccgtcctagcatgaaaaacgaaacagtagattagtgcatgattaattaagttgttaactaaaattttaaaaataaattaatataatttttaaagaaactttcatataaattttttaacgaaaaacacaccgtttagcaattcggaaagcgtgcgtgtaaaaaatgagaaggtaaagttgggaaccttaagagacgaacacggttctagaactcttttcattggataaactttgacaaacaaactgtttaaagcgctgttaccaaagctagtcctcattttgaatgcatcattcttttcccaaattacatgtaaataaaacagagttcatgtggaaccctataaaatccttatattccaaaagcctagaagtagaatttaaggcaataccattccttcttccttcgactcttcacttctccagaagaggtcaactcttggcactctggcaatgtcttcaccacatctcagctcatcgaaccgttccacacaacagctacttgcgtaaatcccccatttgacataagcaaagactataaatccagcacgtaactgcgcgtaatcaacagcataataataaattaattgtaaccagttgtaggcattcataatcctaattggctcggataatgaagtatgacccattgagttacacattttaccttggttttttagcacattttttaatactaaactatacattttgtgagaaaattttctatataaaaattgttttaaaatattatataaattcattggtcaagtttaaaataattaaacctcaacatcagtgactcttattttatgcgttggtacttaatcttccgtccgtcataggttcgaatgtggcctatacattttcattgatccatgagatcttccatttcttatgaagttaaattaagggtgaatagccaattcaattttgaacttttgctcacggatcaaattagttcatggtgttttgtattgtccaaacaaatctctaaagattgtcatgtgactaaatatagccattggacacacttgacatgtcacatcattcatgcatgtacagtcaatatttaagggcctatttggactgatgttattttcaatcatatcattttttttataaagttaccaaaaaatgcctatatttagtttgttgccaaacttaatttggtaaacacgtaagaaatcatgacaaaattttggtaatattggcaacttgccaaaatgttatcagtaggtttattttggctacaatctgaacaaaccctaaatatccattttacccttacattttcttttaaaaaagagaaaaaaaagaaaaaacatgaagaaagcaatcataaaacaaaagaaaaataccacattctttagttaccaatgcaacatcttttttccaatggccaaatgcctttcttttactaattctttttatttatttcctacggagaatgtaagggtagctagatggatgtttcaaatgttgaatttgcatgcacgggtgatgcggcatgtagacgttgtatccaaggactatattaaataacataataaagtttagggacttatttggataatacgaaataccaaagactttatggatccttaagcgaaagtttaaggatcatgttgtttgttcacactttaattaataacactcattatttaatcaataaaaacaagaacaacaacaaccaaaaaaaaatcatcttgtaaaaagaaaatttccaaggctaccattcaaccagctgtccagattcaacttaaccctgtcctgtgagacgctctctaaccgccaaaacgaccagaccagtgtgtgcgcctcgccgttgacttgaccacgtgccatggcgggcgccgccgccgccgccgccgccaccccgccggaattcgtgtgcccgatctccggcgagctcatggccgacccggtgatcgtccccagcggcgagaccttcgagcgcggctgcgtcgaggcctgcgtggcgctgggcttcaccccggcggcgctgccactgtccgtggacctcgccgcctcgccgccaccggcgctcatcccgaacgccaacctcaggaaggccatctcctcctactgcgaccgcgtcggcttgccgcgtccgctcgccgtctcgccggaggaggcgaggggcattgtccgccacctcatggcgatgcgggagcctggtcgcgccgggggagtcaacggcgagcggttcgagtcgtcgtcgtcgtcctcgccggagttcgcggcgttggggttgaccttggaggaggctgttctggtgaggctgctcgacgacgagccgagccggcaggagggcgcgctggaggcgctgaagcagacgctgcgcggcggcgagaacggggtgaggcgcgcgctctgcacgccgcggctgctcgacgggctgcgccgcctgatggggtccggccacgagggcgtcagggtcagcgccgccgcgtgcgtggtcaacctctcgctggagccggcgaaccgggtgcagctggtgcgcgcggagctcgtgccggtgctcgtcgggctgctcgccgcggcgtccccggagctccgcgaccacgccgccggcgcggtgtacagcctctcgatcgaggagaggaaccggatcccgatcggcgtgctcggcgccgtcccgccgctgctgcgcctcctcgcgagcgccgccgacggcgaccgcgcgcggcgcgacgctggcatggcgctgtactacctctccctcgacgagatgaaccggtcgaggctcgcgaggtcggccggcgcggtggcggccctcgtcggcgccgagggggacgccgcgctgcgccgcccggcgctgatggtcatggccaacctcgccggctgaagcgaggggagggaggcgctcatcgacggcggcccggtggcggcggtggcggggctcatgcgccgcgccaccgtggcgccggggtccacggaggaggagtactgcctctcggcgctgcacgggatgagccgcggcaacgtccggttcggcgggctggcgcgcgccgcgggcgccggcgaggtgctccggcgcgtcgcggagggccccggcggcggggtgcggcgggacgtggcgtggcggacgctgcgcgccgtgggcggggtggccgccgccgccaccggcgagtctctgtacggcggcgaggacgccgccgccgccgcgccgtggatggacgacgtgagcgtcatgtcggaggccatggcgatgccgcagttcccgagacggctggtggagcacgcgcacgcgcacggggcgccgccgcggtcgaacaccacggcgctcgacaggctcaggcaagcgcccaacggctgacgtgtgggtcccagtgtcagtttcgtaccgtgctcgaacggtttgatctttttctcattttgcttaagaaatggtttgcttaaatttgtatatagtgtaaggaaattagattatttggtgatagtattgttgattccatatttcttgctaagcttgtatatacacatttccgttatgtgtgagaacaatttcttcgtatttatttacactgtatcatataccaatattgtcaggcatgtcccaaagtactggaatagacatattacatgtttcttttgctagtactatcttatcagatcaatggtcattgttggaataacaaattcagatcaattagagaagctcagtttccataaacaaacataataacgtttttattcaagatgaacaagatgtgttcacagtatgtaaatatgtacatagcatatataattaatttactgtttatctttacaacatacatataaacgtggtgcgtcgcttaggatgacttcagcaaggcccggttcctgcataaatcataattatgttaaaaaatggtttcttggcaatagatcagatgcacattgtaagttcatatctgcaagtttgttgtatactcacttctcatattcaaggtattcagtgggggatataggcttaggacccccaaaccaatcaatcaaaaatatgtttttgatttccaatttgaagatttggaaatgatgattctttggccaacctatcaaacagccatacatgaatgttgtcataaaataatcaccagttaatctcacattagtaaaagacacaaagaaatacttggatttaccctccatttcaggatgtttagtaaaaagtgcttctttggccaaatctgcttcagatgattgagggtcaatcaacttcaactgaaaacatgcaattcactggttccattacaacttagtaagtcaagaaatgatccaactatatcacatctatgtatggttcttatggctgagattaaatgaagtgcctatagcccctgctacttgcctacttcattgatctcacatgtcacaacagttttataaactataatttcttgatgaaatatcatctacataactttataaaccatgatttcttgaccatctgctgttttcttgctcacagtgaatccatgatagataatttgagaggggacggacacagttaggaacgtgggggaaaaaactataagacaatggagtatagttgttttgtctctcgatcatggttatcatattgtctactgagggtatctccacaacaactggaagactaggcgataacttggtcaccagtccacctagttgtgaagaaaacttgcaaagaacatgtaaaaattgagcctacaactacaatgccacaagctaaaccatccacaaggctccaaagttccaaaagcctgagctctcctgctgaagtctctcaacctctcatccccatgccaagaaattgaggcccaaaactataaagttgaaggcagacaaaacagtgataatgtttggttacgactcaagtccagcagtaagtattcactctacagcaatttataacttcaagctgaattaagtatgaattaataaaaagaaattaactactgtacattcttagaccagtcagcaccaagaaaaatagatataagaagataaccagatcagtcactaccaaagcaaaatagaaatagatagataaacagcaagtgaataatcatggtaccatggatgcaatttgtctgtacctttccagtaagagtaagttttgcacaagttgggttttcaggatcaatcttcccacatgtcccaagagggaactcgctaagggtaaagaggtcctttcatcctccaatgcatctctcgcagtgggatctagcgttgtcagatagaagtaggggattccatggctctcacctggcactccatcactatatgaaactacattgctgtatgtacaggaagcagggaactaagttcagcaatcagaaagggtttgtaaccatgtgcgttggttgttttcaataccaaaacaagaaatattacccaaaaggagctccacttagatcacttgatattgtgctgcaaaaagaaattgcatatgtgagtgaacaatcagtggacatctagcagatacattattaaaagaaagtcaaaacaatatacaatagtgttttaaatagccaactgcactcgcgtaagtattttttgacagtgactgctacgctattgtagtatcatgtaaaaaccagcgaaggcagctatgacaactctgctaaatccactaaatgctgtaccgctactcaatcaattagtttttatcaatagttttattttgcctgcttaatttgaaatttgttttcttagaaatcaaagactatttagaatcttgaatatccttgttttcacctgaacaagtactaaaatattagttaagaaactttcatactttttatgacttttacaattaatttcaagtaatacatgacacatatgagtaacttatgctctaaataatatggggggaaaaagctatattgaccttgatgctaaaaccatagcttttcattactagataaaaatctgtctggtatatttgacctaatgatgtatgcagacattaaaacgtggccagaggtttccaacttcacaccaatttgaagaatattgtctatatttatttattttctttgcgaggaattttgatggaactgtaagttttcgttatccaattggcacagtaggacggcaatttagcaaaacacctattcaattgtaaatcatgacactgaatgtcacacaagtaagggaagagcaccaacaatttctcaatactaagcagcctcaggcgattagattactagccactaccaacacttggccgcgctaagaacccccaatttcgatcgagccacccattgtcatctcctaaagaaccgaggcatcaaccaatcagtccccccaaacagtaggggatcacgagcaagaagaaggcaaaggaattgggagggggacaacctgaggacgccccacgtgttctgggcggcgagccacctcgcggtggcggcggcctcggtgggggcgggcttgccgccggcggcggcgacgatggggcgggcggcgagggccggcagcggagggcggaaggcgaggaggagcgcggcgccgacggcgacgacgaggaggagggcggggggaagcatcaccggttttcttggtttggtttgtgtgctccgctcgatgggagactggaggaatcggaggatttttcccttcttcgtcaattgtgaattgtctcttccaaattttcttggttcttccggcggatagggttgttgtcgtctgaagcggcccggccggcgataggaacgtctcatagagatggaggagctgataagggtacagagaatcggagagagaaagactgattgatttgcaagcagtgtctttttgcttttggactttatagataaataaacatttcgaaaatagttgtatgtattttagaaacggacttgataaaaagatgtcgacactttttttggctgatctcagtcggttttgctatccgtctgatcgctaaacgtacgtataatattacaagaaaaaccctccctcattttcagttacttttgaatggctcggattgatttaagattcatgcaactatagtgttttcaccttatactcttcttgacagaatgctcgttcactggatgtcgatgtcgcaacgtccgcctcccccgccctcaccggctggctagaaggcgccaacggcaccggcaagccccttcccctttcctcttctcctccttaagctagcggcagtaaagtgccccgtcccgccgtctttcctatctccgacagttccctatcattggttcccccaccatcgactatcgccttctaaccactcgcttcgctctggccctaccaccaacaccgacccaccgtgctcctccatccttgtggcttcggcaccaccgccgacgtctcaccacctgcccgtgtccactactcactatcgagccgctacctctcacggccatccctttaagcccggcgatctctccttctttctcatcccacccctaccccaacccaagacctcgtcactcgctagagcttcatcggagctagaggagaaggagtt

SEQ ID NO: 57888 - DNA, 1509 bp, Oryza sativa
  unsure (1)..(1509): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttttcagtcttactatccgaactttttgtcccgttttcttgaattttggtcttttcttttggttcttgcttcgtttctggtgcagtttccttcttgacctggagaatcaaaattgccattagtcactgtgagatgatgattcgctttatcaagcacccggtaatggagtttgcaggtttcatcagggaaaagttaaattatagttatccgttcctcttgggtcttaccttgttcttttctttctgaagtagctctctgacaggatgataagctgccgtcacgcaaatattctgaagaaaaaaaagtacagatttaatatttcagagagtgacgactgaataaatcttctttataataccaaaagtccaaaagcagtgtacagaccttcaagtcactgctggtgtatccttcagtcattttggcaagctccttgaaatcaatattttcaaccgtctctttcgacaacaatgtcttcagaatcagctctctactctccaacgttgggaggccgaccatgattctatttaacacaaatgactcataaaaaaactcatctagagaagctgaatttaatcaaatagaagtttagatacacataaacgaaacatacctgtgctcaaatctccttatcaccgcatcatcaaggtcaaagggcctgttcgttgcagcaaggactaatatcctttcgttggacttagacaagagtccatcccagtgagccatgaactcattttttactctgcgggatgcctcattttcgctatggttatctcgtttccctagcatgctgtctacctcatcgatgaaaatgattgctggtgcaagtttagcagcaaggctgaataaggcttggatgcacttctcagactccccgtaccattttgatgtcatactagccatagagatgttcaagaagctagctcctgctgcgtttgctagggcctnnnnnnnnnnnnnnnnnnnnnnnnnnnnnnnnnnnnnnnncagaacgcccttgcatggcttcaagagaccacctttgaagaaatcaggtcgttgaagaggaagcatgacaagctcgtgaaggcattctttgatatcagccagtgctccaatgtcatcaaatgtcactcctatttcattggctggtataaccgttggtcggatcttcttttcatactcattgtctggaacgacctgtaagttaagaatagcaaaattttaaacatgtaattaaactaggaaaattacttaattataacttat

SEQ ID NO: 57889 - DNA, 15044 bp, Oryza sativa
tgcttccactgtatctttcccaaggtcgttgctctcttggaatatgcgtaatccatgggataagctgtgaaagtgccatgttagcaaaagcgagataaagcaacaatggaccacctcaaactcaaagtaaatttagctaacctctccgaagatatgacaagattcccgtttctgtatttagggttcttgttattcatcagatggtaagagacagatggggttataatttcttctaagtaagccacaatgattttacaatcatcatctgcattgatcgagctcaaatcttcacactcaagattgttttctgcgagcacttccgcgatgtagttttgaacgacttgattattggtattattcgaatcttcctccatctgggtcttccatttctcaagaaggaccttgtctttgggaggctttgtctccagaatacaagggaaaagagcacacacagattcttcaatatcttctctatcctcatcatcatcgaggaattgtgaaccaatcacgattacccgtccagatagttttttcaacattttctgaaacatacagtatgctttttctgaacttccaagcaagtcatcaacatcccttatgtaaagaatgactggactgatttcagaagcagaaactataatctgcaaaagccatccaatatcagcttgtacaaatagggcacgtaaatttggactatactgctgaataactgagttaccttgtaaagggattgtatgagaaccttctcattcaaactccagcatggtttaactgatgctgcatcaaaagagagggtgatctacagatagctaaaaactaggcaggttaggataactgcagatttcagttggaggaaccctcatgggcaggcacatttgaatatacaggtaaatgaggatgttgggttgtctgaaactagttgaagctggcaacatatgcattatacatctaatgtgcacatgtgcaattggggcataaataaacaagagagcataaaaaaatggatttcactcaccaaggtatttagaagattcgggatcatggtccttctcgggaggtaccaaggataactgaacccgtactgaaggtgtgttatgaggacaacaagtgctgcaaaagcaatagcataaaatgctcagaaaatcaatatctaatacctctagttgcatatccaggcagagatattacctagtcctgagatcaaggatgcctgtttcacggctcaatggtcctacattagtgtttcatgaagacacagtcagaacatcagaaaagttggagcatgggcatcgcttcaaaatcatgattgagagaaagaaggataaagcattgcagaaagtaaacaggcaaagaaacggtgagtgcacaacaggaagaaacagggtacctgttccagttggttcttccttcttgcgaaacagattgaaagctccaaccaaactagacactctatcgaaggctgcctctgtcatggatctctcacgggtctgtgttatgaacagatcagaattgattaggtaaatcatcagacaaatccacgccacttcacaaaattgtaacaaatgctcctgttcgaaaaaaactgcacattcagcaactctactagctaaattgttcagtgtggacagagtagactaggttctatcctcctcaagtaccccgtttaagttgtgcagaggccggaatcgtaaaacgctattccataatctaaagaaaagtacccattgtttcaacagggacaccatgttttactttgactcattaaggaaaaaaaaaaggccaaactgataaacagaaatgaaaatcctgaatttcccatgtcgcttggtatatcaaccaaatgtgctatacaagatggaactaccagttaccacctagaaaaagaaggcagaaataggatacagacctgtgtattgcttggaccgccgtacttatgatggagctgcaatggcaatcgggaaaagaacagtttaggatcataagaggccagggcgacaacaaagctaaaatttctcaaattgcatctaactgaccttgcacgcgaagtcgatgacatcgagcagcagcaggcgagcactgaactggtttgcgagagccttcgcgagcgactgaaggtacgcctctgcaacagagaaacagcggctgtgagaaaaaaaaaagatcgcgcttttggcgaaaacgaacaacgcacattgcggttcaggaagcggagggcgaacctgatgggccgcagagcagtatggtgcggctggacgcggagaggacgcggatgtgattgggcaggatcgttgggctcagatgcacgaacgccgtgctggtgagggccagcttcgactgctcgctgcaagaaaaccatgggaaacacatgctcaattagccgcccttcaccaaacaccgcattgatttctactgacgacgcaacgcgtatccatgggatcagtaattaaatcatgtgatcctacccgaaatataccagcaaagtcataaactaatcgataaagctaccggtcaaaataagggaaaaaaaggtttggttttttttttccttctcccacattggattggggggtttttggctctgaggattcgcatcgacgacgggacgaacctgaggtagtacgggaagtcgtcgaaggagacgccgacgtcgcggccgtccaccaccagacaccgcagctccgcctccacctccgccgccgtggcgccgccgccagtcgccaacccggtcagccgcgacgagacgaggccgatgccgacccccaccccgacgcccacccccacggccgacgcgatgatgctcccgtgctccatgtgtcctcctcgttcctcctcccgccgccgccgccgccgccgacacgacgaccacacctacgcggaagccgacttcgacagcggcatgcaaaactttcaggggcgcggattcggtacgggtgcgatcgaacggcacagacacggaggggcggtatttatagagaggagggttggagagagttcgggtcggtcccgtcgcgtcgcggccaggatcgagccgagcgagcccacggcacggggcacggcggcgtcacggggcaggagggggtggtgccgattgggattgggacgcctcgcggatgccgatgccgacgcggatttggcccaaaaaaaagaggggtgaaatttccggtgcacaaacacctccggcggcggaatctcgttgtcgcggatcgagtggccgattcctattgtttatttctattatttcgctatactagatagacttggtctatgtgtaaaactcaagtctatgtaaaattctcctttcatcactagggtaaaagtagcaccttttttttctccgccttgtaactccgtcatgccgtcattcgattccctctgggttttttttttctttttaatgctttctgatttggccgaatgttaacggtgacagaatagttgtacgctttagcaccacggcagattggcgaaaggcgtgtgacacttgggccttgggctgtcaacaccaccaatagcagagacgcgtgggggcggcggtattgatggatgtcatgagatcatggtttttgccgagttggggaccactagttcgcttctcgcttccttttcgagcgtaacgcagacaaacgtgcatcacggctggtgtttgaaggttgcgagatttccctttcttgctataacgtctttggatggttgtatcaagactattatgtgacactgattcttattcatcgaaagttcgaaactaccgttggttccacacttccactgtttaaccacggcgggagcaggagcgacccagcccagagacaagtcccgagccagcctatgctaatttctcagggtaattctaggcagaggtatcttccttgtaactatgagggtgtttgggagaggtactaatagtccctctctccaaaaaaataagtccctagatttagtccctctctcccaaacactctctatatatctcaacatgacatgatgagtagtcggacttctgatcctattcaaaaacatcggacggtgtttcatggtttcttcgaattgtgttagcatcgatggcaaggggtgctccctgtgcaccatctttttctgaggcagacattgtgtccctttcttaagaatcagtggacgacatggcatgatccacatggcggtggacccacgacgaggtccaatcataaccatgactagtcgagcgtgtctgaagaagaccaccgagcaatatggcgatgcgacccttttgtcacgtcattgggcttaccacccctagactctcgatggttgaatagctagctcgctcaatggtctccctcagccacacctagttagtcatggttatggttggatcttaccatgggcccattatttgcgtggaccacatcgtatgtcaatcactattaaagagatgcaaattctgtcactctcagataaataagagatgaacattacatatctatgcctgtgaagctgacatacacgctattttttaatcatctatcgtcatggatagccgcaaacctatacaataacccctgtgtatgcatggatgaacttcatttcacttccgtatttgttgatctaataatgacactacagttgcccatgacatcatcattatttttttttaccatgcatgacatcactatttcactaagatgatgtttaaagagctcctgggtgggtcgggggctttaccacaggatgaggacatgagaactgtggcaaattacgccgacaggatgggatggccactatgaagggaaaaggtgaggagggcatggctagtgtgcttctcgatgtgattaacggctaagctaatataacgtgaatggcatttaagaagaaattttaaaacagtggcgaccagataagaatactactcccgataatataacaacctaaaatcaggtgaaacatttcagagtacaatgaatttagtcacgagcttgtcaatattcattgtattataaggtagtgtttggttttgggactatgtgggatgggatagaaccatccctgatttttgagttgggatgattccacttacatgtttggtttgtaggatgggatgatcctaaatttttgtttggttgaagggacgaggggatcaacgatcacctgatttgcccccacagtcctccccatcgccggaggaagagcaagaggaagagctggcagcgagcaagagcaagagcaggaagagaaccatggcttgctcacctccccatcaccggatccgccgctgcccctcgacctcctcctcgcactccgccgccgctcctccctatcgccgaatccgccgccgccctatcgtcggatctgccgccgcccctcaacctcctcctcgcatgccgccgccgctcctccccatcgccgaatccgccgccgcagtcctccccatcgctggatccgtcgccgccgccctccccaccactggatccatcgtcgccgagtcccccgccatcgctgtcgctgtcgcccgagctgtttgccgttgctctcgagggcgagcgcgcgagtaaggcgccgtcacgccgttcgctcgtcccaggtgggacgagttcgtccaccacattttcccggatcggttggacccggatctgagaggaatattcctctctagggaccaacccatcttactcacccctcaaccaaacacccttaaaagtgggttcgtcctatcccatctcattattgcaactaaacactacctaaaatgttccatccgatcctaaattgctatattatgggacatagagtagcaacttttaggtcaaaaataagaaagcttgccaagtttgagaagaaaaagaaaagatatttctctattaaatagtaaagataagagttaaattgtctcattaaattgactatatttcaactgattaagtttttctttggtggaacataccatctgaatttaagtaataaacttgatagttgacatgagtactcgcattctgactttaccaatcttaagacacggggtctagcacccttcctagaaagacccgagcttatttggaatgatttggggggagggggggaggggggcaagtaagggtagggtgtagtattcttctctactctgccactgtttctagccaatagaacacatgtgcatacgcatgcgcacatcacacacgcgtgcgcgtgcgcgtgcacggcaatgatgagatatgctagtgagcgccggtattaaagggttgtctcatttattacaggatctattaaggtaaggtaagatatgctagagtgtctgaatttatactgatatttttagaagtaaaaaagttgtctcatttgttgcacgatctatcaattgtttaaaggttttctttatagtacttccctaatatatgtcgtttgaggtatcacctatagaatttatgggacccatccttttgcttaagccaaatgacatatttgcaaacgaaaataatgtgtgaataaaacttttatatttatatatatatatatatatatatatatatatatatatatatatatatgtttttagcaatttaaaagcaaaagctgaaaaataaacttcgatgagaaaaaccccaaaattatatcgttgataattcaaattttgactgataagcataagcgaaaagatgaggttatgtactaccatataattattttctataatatatatctcgtgattaccagtttgtcactagaaacatacttttatctcttaacacgtactctcttcgtcgcataaggaataggaaaacttgaaaatgcgtagtacactgtgattattactagtaccttagtccttatccggtcagaaacaccaacaaaaagacatataaaagagagataagtgcgatattctgcacaagcctccgacgtggcagagcatgcatgtggaaacctttccgcaaaaggctccgacgatgatgtacagacggactccaacattcacctccaccatccaatgaagtaacaaatgcaacgaaatttcgcctgcaatcatccatgttcttccatcccaagtttacttgagggatcggaagacttcgtttgtcgtgtaggtttcacatgcgtacacatacaccgaatccctatcacctatcatcaccatcaccccgatgctatcctacagccgcccggtcgtttacctcctcacctctcttgtgcacgctaacatacaagtagcttgttttaatattacccgcgacgaccagaacacggcgagtcagtcagtcaacgtgatacggatgcgattttctcctgtagttgagtagaaaagctaggaacagagactaagttgggtgtcgtgtgtggtggagtccaccatggatccatgatgctagcgctgcttgctaatcctgcaacgtttgttcggtgcgtgtccacggttgttgccccgttggagcttagctagttggcgaccactcgatcgacatccgatcaggatgatatgtgtcatacgtggtcctgcctgcccctgtaaaaccccatagcggcaagggccatcgaccgaccggccgcgtccgccgtacgtactacgttcgtgcggccggcctgccgtctccggcaggaattctccgccgcgcgtggcgggtgcgcacgtacgtacgggcgcggccgctggcgttggcatattggcatggtccatcgcgcggacgaaaccgagtcttcgctaccgtcgctgttgcggtggggctcgtatacagttttgtgctcgtttctccctccgatcgagtgcacgtttcccgaagcaacgatcgtctttcatttggtggttgttgtcatgttgggctcgcaagtgggggcgactctgggagattgtgttctcttgggatacaatacgctgggccaccatgaaaaggaggtcggttttccggtatggatccggacctggcctggctggcccagcatgtcatatggtccatggcgcggtgtgtagtccagcgaaaaccatcacccacccatccacccaccgcacttagggttagggacgcgcgtttagttaagagccatgtcactaaggaacgcgttaattaatttgttggtgaacgattgaaaagccataataacgattgcgttcggagttgcggtttgtctgtatatccaaattaagagttttgtataggttgcgtcaactagagtttggtgcccgctcgcctaaatagatatataggtgtctgtttaaatgaagtcaagcgtcaacaacaagaaactggagtgtactctctccccgtatcaaaataaaccaatatatcattggagggaagtaaaacttgatgataataaagagatgctcccctgcgaaatcacgcatgattgcaggacgggatgcttcagcacgacatggaagctccaactgattgtcgagttctcgatttaattaaacggagcacgggagcaggatatctcctaacaggacggtggtatatgagaccggaaatggaccctctgacttattatcctctgacttagagtgacttttgaatccacatattagtgacacaagttaaaaataagtaagtttgaggattttaatccctattagacgtgggacgttagctagatgctaacgaacagttgatctcaactcctcaagtcgaagtcacggtgttgtgactttgttattccctctgcttgcatcagaggatctgcgttcacggcacgcgcgcatgttcggccatgcatgttgcacggtgcaggccctcaggccacacgtacgcggtacgcgttaacagctcgatcgatcgccgtcgcgtgtgcgggccggacatctgattgcgaggttggcgatagatgggccgtgtcccgtgggcgtatgtgacgagatcgctaattagtttttttcccaccactttcctttttttcttttggcacatatagttttttttcaggttaatttaaagtttcgcgccaaaattttataagttaaaagtttatatattcgattcaaatttaaatttaaatattttttatatagaatatatatatatatatatatattttatacgtacgaaatttacggtatatatttataagttctatgcacgtgtataagggtattattatttttattttattttctaacttgttttttattaatttatggtgcatgaggaggaggagcgtgggggttagggaagggaggggggagggggagggggagggatcgctgtgggtgatcatccgcctattagccctctcccgtacgtgaggcgtggactagtctcagcccgcgcgctcgtctccacgagtgtttcggcagctctaatgtaacagtctatactatagtaatggtggtgtctattctcacatcattcctaccattaacatttggctcccataatatatattattacaccctttgaacaagtcctctctcatttcattataggctcctcaaattttaaaattatctacttgtataataagaaaaatcatagtactactaagactaaataagtaagctagaaacttaatttgttttctgttgcaactcacggactctaggcttactagctaattaacgtacccttacgtcacgtaggatcaagttatagtgctttcacagcctactatatagtccttagtttttttaaaaaaatgtgtattaaaacttagtccatcctatctaacccttgaattttcactaaaatttgagacctatttccacaccctaagtacagtatgcacgcttgtccattctccctactcatgagggagggacacagtagataacggtatccatgtcgacccggtttaagacttaattgtttgacttatgcttgtgcttttaagctaaattttgaattttacaacttaattttaaatttattcattttcttatcatagtttattttacaatatttatttttgagtcattaagaacacgtacacaaaagtattactcgcaaatacttttttatttgctaataagctgtttagagcatcaccaaccgtatctctatattctatccccaaataatttttatgggaatcctaaataaaatttaagatataaaaatagtgttccctcaaacagacttgctaaaactgacctcctaagaactaaaaagtggacccatgaaaaattaccaactgaaattggcttctctctccctcccatgagatcataccagccacgcgtccactgatcgtgctagatcaccgatcggtgtcggccctctctatatgatatagcatgatcgatcccatccagtggcgtagctacctaggtggcactgtggtccatggaccacctaaaaattttatcgagattaaaactatagtatatgtgctagttaatataataaaaattatatagtgtactacctattaaattgacctattacatatagatggaccacctttactctaaattctagctacgccactattcccaactccagttcccctgtagcttcccttgttctctgcatgtcttgtgtcttctgctccttgcccttgctgggtaatcttcattccccttcaaaggaacaaggaaagatagccaaatgctatggtcaaaaccttaacacctataggaaatacatcaccatttacttcctttaaatatttgttgttataatattcttgttcaggctgcaacttgcaaccatcaacaggtctgctgttcctccctggtctttgtcgccaaagttaattgtttgattaataagatgcagctagcacaattgtactggttgatcatacaatttactgcaaaatgacatggcagtgggtatagccagctgctagctatactattgaccttgctctaagtgatttcatcatctaaacaccagcacacatcgcggttggctaggaaagggaggagccaacccaactcgagagtcaggcagtggggcaccaggctgattcacaccggcgcctcgaatcgaagcggcagtggtgcttgggggagcgatgacggctgtccactgccaggcttcggctgaagtgcagttgccaccatatcatgcgccgccacgaggaagaaaaattgacactagggaatcatgggggagctacagacttattccagccagccacgggaagacaatgctggtgacgggatagatcgacacggcggtgtacgagagcgcgaagaggagaacatgtcgccaaccacgcgcgaaggagtgaagtacgatgtattgggaggcagacctcgtccctagaagtggagagcaaacaatccagaatcgggatttccaactattgggagcttcgctagggactctgttggagtcattttttgaacaaaaatctgattggaaatcatatacagacactattggtgatgctctaaacaacgtgacacttaataatagcttgtcaagtagccttcttcctggaataatgctatctttttctcgatcgcttcgtacgtgcctaccacatagctgttctaagagatacttaggttgtgttcttcccctattttcccaacccacatctctcatttttcgcacgcacgtttttcaaactgttaaatggtgtgatttataaaaaactttctatatatgaaagttgttttaaaaaaaatcatattaatccatttttcaaaaaatatagttaatacttaattaaccatgcaataatacgtgctttgttttgcgtgccgggaaggaagggttccagccttagggtgtgttcagaatccccctttcccaactcacctctctacttttccgcgcgtaagcttttcaaactgttaaacgatgtgtttttttaaaaaagtttctatacaaaagttgcttaaaaaatcatattgatttatttttgaaaaaaagctaatacttaattaatcatgtgctaatggactgctccgttttcggtgcagatattttagttccaaactccccacagcgaacacagccttagatactcctactctatatccattcagtttttttttctttttgaaaactataaccattcgatcaatcagcgattcaacggttacacgcacaagtaataaagaaaacaacgtacgagatctagtactgcgtacatacacggagttcccaaatgtttggcgatcttatctgggccgtgctttgtggacgagagcaactattcagatgtactctcttttttcttttcctttggaatgccagtacaaactttatatagcgtgaaggaatcaattgggctgtgtggacatgagtagatcatgggccgtattcgccgcactctgttggtactgtggtgcatggctcataagcttgccagataggacaggtgagaacgatacgagacatcacaactcgatcgcaagttggcgaaacgaacggtggaatgggcattcgaattagaggtggagcatgcgcactacactaaagtgcaataagctccaaactaagtaacaggctcatcgtttgtcctatactcctatatgaagtccaggcgttgctaaaaaacaaaattcaaaacttagctttgaagttgattttaggatgtttttcacgtagttttttatattaccttttaagtcaatcaatggtacatatataagtaagtcattggtttctaatcaactcatggctaatcgatggggcttttgccgcgctgtgctcgcctagtcgccttgccgttcatgcgttcacggttggagctttggtccgattgggtttcacatctttacgcaagttaggtcatgtttgtttcagcttataattattataatctgaattattagaagtaagctgaaacaaacaaatagcttattatctataaactagattactataatatgataatctactctaaaaatgtttttttaattattggatggttaacagctaacaaacatctaataagccagagaaacaaacagctaacaatttattctatatcggcttattataattcagcttatagtaatttggatcaataatctagattacaataattttaaattgaaacaaacagtgccttaaatgtagggccgggttaagacggttttaattatttgaatcgaatttgtggactctaaaatcctcacgtgtaggacggttctcaaatatgaattcagtaagatcccaggacatagtagtactagtaatttgttattaggtacttgagttattttgtaattttttgaataagacggacaattaaacgttatacatagaaacccacaactgcacttaaaatgagacggcgggagtaacaaactctttgaaatattggaatttcaaatgtcgatgaaaattgcccaaaaacctgtaagagcaaataaaaattcaattaatgttcccagaggaatctattctgcacgctaagaacatattctgcacggtcagctccagcacagtggcacagcatttcgcgtaggcatgaagtcctaaaatactttagtatttttcatcttttaagacatgactaaatctttttcatacccgttcagcatggataaaaatcaaagtctctagaatcttcaaggctcccaaaaggcacgacggaaaataagcaaaaaggtggtaaaaaaaaagaagaggatgcaaggaaaaaaaatcctcttgaacctcggaacgtgccatgtgatgtggaccgcaacatattgtgttccgtaccggcgatgtgattaagatggttttaggtcaaaattaaggggcccattccgtccactacgtgacgtccagatcagaggagatcacgcacctgttctcgtgttggcgtcaccacacatggaaaaggagaatacgagtatcacagaataaaaacgagaggactaataaatagtttactgttctaaacatggtttattagttcgtgagtaaatgtaaacaaatatgacccagagagcatcacttgttggaatttggaaagtggcttgactagttaagagctatgacgtgcagtactatcggattcgtccaagtctctctctctgttttttttttgggaaaaaaaatgggggtaaaatgagtgttcgatctgtagtacccaccgtacgcatagtcgtcagtgtgtgctacgcgtgctacagcggagactggaaagttgcacgctcaaccgtgtgacgaccgtaagtcttcgggacccaggaaagtgaattggattactacatcgatgatgggagtccaggaaaaatctgttcgataaaaaagaattggccactctctgttcgccagattgtattaggcaggtgaatgtaggtacaaagcacatattccaatcgtacgtatctgcaacagcattacaggtgcaaaggtggttagttctgggtaattttgttcgattgttcttcttttatccttgtaatcaagttgcaccgactgaacagatatgtacgtagaccattatctaaagacaaaacagataatgtagacaatgcaattattctggcctctcgatatatgcctcaatgtactaccttgctgctagcgatggatctgattaaaatgattattttgtgctgtttgggaattctcggtgatgcctcacatctcatccataataaatttctcggtactaccttgctgcatgctgaagtctgagtactatactccgtacttcataattcataaacttcattggcagattaggtcatagacagcgaagcggtgcggactacagaaacatatacagaggacccatgtcctataatcatgcatgaaaggaaccaatcactggtggagaagtgctttttagttccggttcgtaacccccctgtagtcccggttttccaaccgggactacgaagctatctttagtcctggttcaaatcgatctttagtcccggttgcacaccaaccgggactaaagattttttttcttttttttctgtttttaatattgaatattgatttcacaccatcccctcccatatccaaatcatcacatatcacagaacatctccaaatcctcaaatcctcaaacaaatcatctccaaatacatcacaaactcttaaaaaaaattatatcacagggttctaaaaaattcatcacagattcacatctcacacaaaaatgcatcacagattcacatctaaaaaaaaaatccggccggcggccactgccgcctcccctccgcgccagccggccgg

SEQ ID NO: 57890 - DNA, 1699 bp, Oryza sativa
gtttgttgtgtggacgggaaaagaggatcggtactatggattatatagtgtgttttaatttttattcccggttagtatcaccaaccgggactaaaaataggtttttagtcccggttggtgttactaaccgggacttaagatcctagggccctgacacggcctgacatggaatcaaccgggcctaaaaatgaactttagtcccggttggagttaccaaccgagactaaagatgatttttagtcccggttggtaacaacaaccgggactaaagatcttcctcttattaaccgggactaaaaattatttttagtcccggtttttaatggaaccgggactattgtgaatttgggtcgaccgaccaaagatggtttctctaccagtgaatttttagtcccggtttttaatggaaccgggactattgtgaatttgggtcgaccgaccaaagatggtttctctaccagtgaatacgaacggagtagaccaacacgagatagcatgtgaaggaaaggctagagcgcgagtcgatcacgaacggcatactacatcacattgtttttttgtccccggaaagagaagtgaaaaaaaaagcggtaacaatggttaaaaaaagaaaagaaattaaaacagaatggacggaagttgctttagggctttatttgtctagtctatatctacatttatgtatactgatatatatcccacatagatatataagtagagcccggccagaactatatatatatttcatacacatgtcacgtaaagtcgaagcatataaggtcatcatatgcatatattggcaaaggttaacaaggtgatatcgcttttctattcaattctacaagttgatcttttctactctcaagaaaaagttgatctttattttatttagaatttatcaaggaaaagatatgcggagcgttgtgcttaaagaaaaaaaaaaggaggagctttaatttctagtaggaggtttagcgcgctgtccacttgttcagggttcatttaggatttagatgactcatgctttgtcacagtgacatgtaattaaggtgagttcccccaattaaccaagcaaatttgtgttagataatgaaattcatccatgctttacttaaaaaatatatataaccaattattataatataggttgcaggaagaacgtttatcaattacaaaactacgcggcttaattaaaaaacaagaaaactacaaagcaaatatatatatatatatatatatatatatatatatatatatatatatatatatatatatatagacacacacacacacacactaaaaatacgtgtatgcatggcatcaggaacaggaatcaggatgctgaaatattggcacaataaactatatctagtatttcagcatgtgacagtatgacaagtttacttttgagaaactgattcctgtatttaagcatacgtatggaaatacaagtatttttaaggcaaccatacgtgtgtatattaagcatttgagaaattattattgctcatatttccaaaagttagattagatctgattttaaatgttaaatatttataactagatggagtatcacatttttacgatgcaaatggacatttcattacacataaaaaaacaagaggacacaaaaatatcatggtccctagtgacagctaacactcttataagtaagatgaaaaggtatatagctctgcat

SEQ ID NO: 57891 - DNA, 707 bp, Oryza sativa
atttgagattagaaaactgggaagaagaaagaacatgttactaacgtgttatgctggcaataaatcacaccggatcgatgagtggcctctacgcgtgacacggcagtcgtgacagacgagtgaataaaaaataaagaaaaaataaacgaaaagtaagcgcatgtcatccaatccgagccaacggacgcggcgccctgccgtccggacgagtccatggtccaattcttgtctgttaaataatcatggtggctgcgaccaaaacagatcaaaactagtacacgtcacaaaacaaaagaaagagattaaggtgatgtttgtttgatgtctaacattgccataactagttaaagtatagtggcataagtgtggcttagaaatagttagccaaaatgtggcaagcttaacttcaaatttaagagtatgacatgtgggtccttaaggttatgaaagtgtggcataacacaattgccatagcgagccaaacacatacctaagaaattgtggcataactaaagtgtggcgtagcaaagtgtggcaaccaaccaaacagccccagtcccattactactaggtctacctccttaaaaaaattggtttattttgaaaatatccaaatttatgtatgaaagttaacatattttaggatagagtaattaattaatgacgtacaggtactaaaacacctttcaaatttttattacgtgtac

SEQ ID NO: 57892 - DNA, 2210 bp, Oryza sativa
  unsure (1)..(2210): unsure at all n locations
cctctttcgccgtgctggccgcgccggtatgttggaaaggtgcccgtgcactagctagctagtgtggttaattaccatcggaaagcagacacgatttttcatctcaagaaaaaaaaagaaaagcagatatacattttctcatgcattttcacacacaccatatgcatcggtcggccggggagaataaggaaaaggagaaaacatttcggtgaattttcacaggatcatatcaaatgcacagtcgtactgttttttaacaaccacatgtgtccaatctggtccttggaatttggttccattctgacgtgttatatgcgctgaagtacgtactccccgtggctgttacgtacgccccactagcacatatggttcgatattcctgttctaaacttcaacaacatcctgatttttcctcggttttcgttagcacgtttttcaaactactaaacggtgtattttatgtgaaaattttctatatagaagttgctataaaaaacaaataaatccatttttatttttttttaataattaaaactttattaattatatgctaataacttgtctcgtttcacgtgcgcacttaatcttcatccctagnnnnnnnnnnnnnnnnnnnnnnnnnnnnnnnnnnnnnnnacctgtgaagcagctggaaaatttcaagtacaatctcaacttagggaaagttgtgattgagggaggatgttagataatgttagttagtttgttatagagatagattagttctgttaccgcatgtactttcttgtatctatctctatatccaggattgtctcaggttgttgagattaatcctatcctttgtacacgccacggtagaggctctttctgcctatatcaacaaaggtgcggccccgtaaaggggttcaacgcttctcattccgttttacaatcctccttcttcctcctggtgttggaaattcgttgatcgagttgaaactctcatccttcatcatgtgctgcagaaactaacgcgtgcacagatgatggatgggtgtggtgtgacatgaaagtggatcaatgacacgcggcacatttaggggagtgtgtcgtgtcttgacttcttcatgcaaaagtataccaaccctgtataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaagcatctttgtgcggtgctgatgttgctgtataattggctctgtatttatgttctggttggtgttatgctgaatcgctgataagtgataactagtttagccttcgggctggtgtgttcaacaaaaccggtatgggactagtattcggacccggactcgcgtcggactcacaggctcacagccggtagtttccatataaagccgagaccaaccacgcacaatagcagcagatcgatcacgtattcacgtctcccgtagtcccctcttcatcacacccggagaagaaagcgatcgaccgaatcaagcgagaagatgcaggccgtcgcgcgggccgcgtctcgctggtgcagccgctcgctgctttcccggccaccgacggcggcggcggcggcgggctagcgcggctactgcggtggtggtgatgtgcggtgccgatgcgccaccgccgggacgggcgagaccctcgagacgattgcgacgaggctgcgtcggcgcgaggcttacaccaactgtgccgccttcgctgtctccggcatcgtcacggcacaggtgctgcgctactgtgatctcaccagcggcgaaggaaaatcgcgtgctcgcggtggaggaaaatcgcgtcctccactctacatnnnnnnnnnnnnnnnnnnnnnnnnnnnnnnnn

SEQ ID NO: 57893 - DNA, 3921 bp, Oryza sativa
  unsure (1)..(3921): unsure at all n locations
ctccaatttataccgcatttgaggcctaaaggacctcaatttccaggactttacactgtccactcctttctctagtatataccacatttgatgcgtaaaggacctccacacaagcggacatatacgcatctaaccaaatctattgtgtttctaagccgccacatgtcaactctcgtaaattagaaaaatcttaaaaattctgagaaacaaaagcatagccgccacatgtcaactctcgtaaattagaaaaatcttaaaaattctgacaaacaaaagcatagcatatctagtcatttattttcacttcaaccgatgggtccactattttagtccacactactatgggactaatcttgaaaataaatcagcatatcattacaacatatcatttttactcgcatttgagaaagttcaatgtttggtctcttatagtattagcacaagtatgaattgccgttgagccgcttcttattatcaaagtttcactttattactttcaactagttaacttttatgcttattgtactttggaccaccttaattctctattttctagcaatgtttagccttacttttaggtcaaaactaatttaattataaaacttttatgtgttcgtagtgatttaaaaatcaatgctgaaaaagaaattacgttgaaaatatcttaaaatcaacatcaaaactaagattgaaaatttaaaatttgtttttttttctttagcttattagacagccaatgtgtggttcttagcaaagataagtctcccatatagggaggaagtttgctgatgtgccagattcgacttaagatcgttgatgtgttaaaaagtggtttaggagggtcaaaattaggacaaaggcaaaattacctagtccaaaatttaaaaagtagaaaaaaaatggtttaaaacaaaactttgttaataaaagatggtcaaactttcatatactcttaatttaatatagagggaaaaaattattatgttcattttgaattctacgaaggaccacaattattgcaaaaagaagatacatatagtacgatcttgatggtccaaagtataacaatatagattaatcgatgaagtggtatatagaataattgtacactatttattaaatctcattctatttataaatcgagctttatacaataaaaaatccactagcctgttttaaaaggacaggacagcgaatgttggaaggccacaatttaacccccgctgaggagagcattcattgcaaatttgcaacacatgcttttgcatgacaaaataacagtacgatacatggaaccttctcttactagcaagaaaagctatgtgccagaatctaagagtacgcgaaaaattcagtagtctatttccaaagacaggaaatggatttttttttccatcgagggacatctttcgttttatgcatgtgttaacaaccaaatttggtaatatcggcatcggagaggaaaatgggatcgaagcggaatcaaagataaggattgtcgtataaacagagtaagaatcggcgggagtccgaatcggctacgattaggatcggctaagtctgggtcagattgggttaaataattcagccgattccgacaatacgacttgtgtacgacatcgggttcaggttaatgtgcttcaagatgattaccacgcacggatagagtcctgggaaggcaattgtatctattaattaggatattttatgtaaattccttataaataaatatgggcaaaagtctgccacaaagacttatggtatcttagagtttcttagagataatagtcgtatccggtatggacatatcttgtaattctcgggtataaatagactccgagtcctatgtaattgataacacacacgttcaatacaatttcggcgcatcaccacccttttgctttagttttattttgacgagttcttgctttcgggttgagctgcatcggtttcgatcttcaacaagaggtaaaacttgttatgacggcttgtatgctcgggattagtgcttccatctttatgatactctaatcttgtttatgtaattcgtcgagttatcatatatcttacataatctctggcaatatcactatctaacctacaatcggctaacatccgttagtagagggcagccgattaggttagattttgacgttgatctagattatataagatatctaccactctatgaaacttccatcggtttgattgtctagatattgtccttcttttcatacttaatgctgcatcagttgagtttgatctattaagtcgtgcttagaatatagatctctagcctgccttctggttgtcgattagggtagcatcggagtttcagccgatcttatctgatttagctatatttgttttatatgcctcattaacatgttaaatcttccctttacgtcaagatattgctatatttaagtatattaagattttgcttgatatattatacttgttttaatatcctgatatagagtagtatcggagtattagccgatacatgctaggtctatctgatcggctatgctataaacatatatagtcccgttattaatatatatttcgatctaagtgatttatactgtctcggcatggcgaccgatctatcccaatcacttgatttaaatatatatcgatataagaactatatattggtaatatctacagccgatcgagtaggtttagttctttattatctatctataaccgccgatcgattcacatatgacatcggctcaaaaataaatgatatgtcatcggcacctagccgatcggctatcatttatagatttaatcacggttcctttgcttctatttcttgttgattacaggatcaaatcaaccggcatgctcatacatccgaaggcgagctttggatctgcactggagttaagcagatctcccaggccacgtgttttctgtcaacagcatgtcgttcaaagttattaaaaatattttaaaaaatatcaagatatatcaatatatgatatattttttcacaaacatgcgagttaaaattcgacttatacaattcgaaacaaaaataaaaaatttgaccagtcaaatttgttatttttgtttctacttgtataagttaaattcgaatttgtatgtttgtaaagtgacatatcacatattgatatatcgtactttttttttctaattttttgataactttttaagtaacatgcaaaaatgaaggaatatcccttaagggatgaattgagttttccccaaaagacaaaggaatggatgttggaagaccacaatttatacctttgctaacaaaacactgattgcaatccatgcataagaaagacagaaaaaaaaaactgcggtacaacgcatcgaagctgatcttactagcatgaaaaaaacccgttcattttcaatccacaaggattcctaacacgtgggatttcgttccacgcaaatgagtagcgtgcaaaacctccattgatatgcccctgcaggttcgggttcccctggcaaaaagacgctgtgctacggaaggaaagaggaaagaaccgtctccatcgaacgcgttctacccattaaactcgatcacgaacacgaacacgagagcagcttgcgctgctattctgaggccatctcgggcgtcctccggcgggcggtgggagcgccgttggtctggaggtgatcgtcgggcttcacgccgagcgcccgccttgccgagtgcggagtcctcgccgccgtgttcacgggtttcaccttcggctgtggccctgcaagcgaaagtatcagcccaatttatcatctcgcttgattgcgctagctatgatatcgatgcgaaatgatgtgaaattgtgaatgatctaaaggttcttgcaaagtgaannnnnnnnnnnnnnnnnnnnnnnnnnnnnnnnnnnnnnnnnnnnnnnnnnnnnnnnn

SEQ ID NO: 57894 - DNA, 5088 bp, Oryza sativa
  unsure (1)..(5088): unsure at all n locations
cattgcaccgaacccgttctcgtcgccgtacagcgagttcccgtcgctgcccgaatccgaggccctgtccttggcgacgtgcacggcgccggcggccttctccctctccatgaccctgtacgcgaacatctggaacggcacgtcggcgacgcgcggcgcctcgccgccacgctgccacgccgggagcttcttcagcagctgcgcctcgatgtcgaggtagtcgacggccggcttgggcgcgtcgtcggtctggccctgctgctgctgctgctgctgctccgggttcaggatcaggaaccgcttgacgtaccggaggacgcggcagatggaggcgaacgccagccgctgcgccgggtcggcgtgccagcaccgcttcgtcagcgcggtgaggtacttgggcgcctggaacgggaacagcggccgctcgccggcgcagatgttcttgctcgtcttgtcgccctgcaggtggttgtcctcgaacggcaccttgccggtcagcagctcgaagcagatcatggcgaagctgtacacgtcggccttctcggtgcacctccccgccgccgcggcgtccgcgacgccgtcggacctgagcacctccggcgcgtaccagatgcaggagttgtcgttgccgttggcgttgccattggcggaagcttttgcgccgccggctgtgatgccagctggctgcccatatccggcgaccttgacatgcacgtagccgccatcgggttggcgcggcttgacgagcacgttggaagggttcagctcgccgtggtttatcctcttcgcgtgcagatactccatcccgcgcgcgatctgcagcataatgtcgacggcgacgacgagcgggaacgggatccgccgccgcgggcagctcacctccttgacgtagctcccgaggtccttggccatgagctggtccatgaccacgaagtactctttcttctcctcgtcgtggaagcagtacgcggcgtgcgcgacgttcgggtgcgccaccgaacacaggagcgcgacctcggcgccggcggcatcggtgtccccgatgaaatgcttcatcgcaaagctctcccccatccaatgcacctccttgagccggccgccgagccgcctccggacgctgtagtcgctgccaagaaggacagatgccgggtgcagcttccccatcgccgcggcgaggagctcggcgaggcggtgctcgtttttgctcagaggtttcgacgccgcagggcctttcatttcgtcgaacatttgcgatatcacccatctgtcctccttccacgccatgtccatccttgcaacgagctcttgggagaccagatatagcttgccgaacgcgtgctcgaacagcttgggatcgagcatgtccctgtcgtacttcctggcgagcaccagccgccccctggcgagctcgtccgggtcggagccggcgatctcgccggcggcgtcgatggcctcgagcgcgacggcgacgcaccacaggacattgtggaggtgctgctccacgcactcggtgccgtgcgccatggccgcggcgcgcgcccaccagctgccgcgggggtccaggcactgcctgacgtacgcctcggcgtcgcggaaggcgcggtggagctcgcggagcggcgcctcgatggcgcgccacttggcgccgcgctcgtcgaagcggagctgggcgcgaacctgccccgtgacggcggcgagcgcgcgcgcgcaggcgtcggcgaggaggcggcactgccgcgggttgatgtggaggtcgtcctcgaacgccatgagcgcgttgatgctacccaccgcctcgccgagttgccggagctgctccatccctatcggcgatcagccttgcctgccgataggacgatggatcaagtgcgcgcgctcttcttgattgcttctttcttcctctgcttctttggatggcacggattgaattcctttcctgacaaggataaaaaaaaagggaagaaactgatgtcaaacgtgcgaaattttcatccaaagtgctttgatcggcgtatgaacacgaacttgattgtggtttgatgatgacaccaaaaatataaggtaataaatgcagaaagtaaattttatacatttctgaacattttacagttgttgtttccatctgtttcttccagcctccaaccattttaggaacattttggtgtgaaccgagaagcatcgaatcagcaaaacaaaacttcatcaacactgcacaattcagtacttttcatctgaacggaacatattcaaacaccaaataattcaacgaaataaactaaaaaactattcaatccatcaaacacaaaaaaacatactgtaggaaacaagaaaccaaaagatgaaatcgaaacaaagaagattaaaaaaaaaacatgcacatgaaagatgccactgaaagataactcacacaagcttgtaggatcgcggcaccagggcagcagtctgaaatccttatccgaccatggaccggcgtcttgcttcaaggatcggccagagaagaaaagcttaagagagaggtgcgagagctctgacgtagagatcccgcaagagagacaacaaggaaagggggaggagtctccaaagcaaaaggaggacgatgaccaggatgccgacgaggagaaggagaagaaacaagaagaaaaaggagcaggaaagcgccgttttggaggggcttaaactgcagggagttatggggagcagcaaagcaaacgcggccgtttccttcctgaatcgtgcgtgctgctgctaaccgcgagaggtttttcgcagccccatttttaagcagcacacagcagttgctaaaaagaaaaaaaaatctctcccgtttctttcttttttttggccatcgctgtacattgactggctaatactagcacgcaggcgaatggtgtgctgtcactggcccaaatgctcaattgttgcctgaacttgctgaatttaccgtgatgagaagagtttcccgaataggcgttctaggtaggtttcacatgcagaaattgcatggggtgtgagccgtccgatcatgcatccaacgggctctaaccactatacacaatacactaacacttaagtattcagtcaggttcaggctgttttgagacttgcgacaggttgctctacgctgtttgctttcacaaactgtatacgtgatggtggataacgtagccgtcatcgtcaggtgctcggtcgcttggcacgtctccaatgccgcgcacgaacggggtaagtgtgtgctctaactaacggctttgtactttctgctggtgtaacctcctctcctaccgcctttcagccgctgatacaagtagaaaacgatgctgtacactgactctgtggcacggcactgaccgtttctcgcgctgacgaccaactctgaactctgtaccattgaccggtatgatttaaggtatttaatttaatccatgccaccacgcaaaaaaaaaaatcaaatatgtcaacgttctccacttctcctcccagaaataatgggagagaaaaaaaaactatcggactatggaactggagtagattatctagtgaagcaaatatatttagttctctctttggtgacattttgcgttgcttgtcacggcgccacttttcttgctcacggcacgattaggccgccgccgccgccgccaccgcgccgagagcacaatgagaggcagcgagggagcgccacgtggcggctcacggcccggacgacgtgggggagggggggaggccggctaggttcgttggtatccgttgcggtagttgacgcgtcctggtccggtcggttgccggcccaaccgcgcaagaactgccctttccgtgtggttggcaggcagcaccaaacacaacggctcaggtcacagaaaagtcgcgcacgacgcaccccggatcaatttatatttcctttttctgacttagctcggtcagcagagtaggtacaatagcaaactattagccggctataaacatattttaatgtaataaaagataagggagaaaagcagcggactatagatctatagccagctgtagtacggactccaagacacagtgtgtatgactggtggaaccatatattaataatatagtaaacaactattatatgaattggctattagattgactatagataaattgaagctagtagtagtggactgtacacttgctctaaccgctctggtgcgatcacaggcaaccaaatggaaaaggatttttgaggatctgccacacaatagtggtttttgaggacacatgaactacgccgattccaccatactcatggacacatgaagtggcaggccattaattagagtctgtttagtaaggtttaacttttaaatttaactctaggagttgaatttagagtgaagttatagaataatttgaattcagtttgacctatctagttcattctctgttactagtatcttatcgagtgaagctggaactaaagctatactaaatttgtccttgttcaagcttctctaaccacattgagtggttaactacattgtaatataatcaatgaaactctatgtaaaaaggtactttcgaattcattctggagaaccttattcgtacaatggatgtcgttggatttcctacaccgactcttagcttgtcgatagtagtcatttgctatttcacaccttccgtagctgcatatgggcaagcgggcaatcaatttgcagttcagttgtcctctgatgataacttcatctttgacgcggttgctatgtcactactaggaaaacgatttttcatggcgttggtctataattttcgctgacggaaaaataccaaaaccgctagcaaaattgtaacgagggggtaaggggcaccgaccgccagcgaaaatagatctttgctggcggtcgcgttataccagccgccagcgaagatatgtctattatcgctggcggtcacttaggtgcgccgccagcaaagatggataattttcgctggcggttgtgttatacagaccggtagagaaaatgcaattattttttctggcggcccannnnnnnnnnnnnnnnnnnnnnnnnnnnnnnnnnnnnnnnnnnnnnnnnnnnnnnnnnnnnnnnnnnnnnnnnn

SEQ ID NO: 57895 - DNA, 719 bp, Oryza sativa
ccagccgggatctcgcgctcccccgccgcgtcggccccaccacggagcgcagcagcggcgacggcggcggcgggtggccacgcttgtatccccccgcccccgcacccgcacccgcacccacaccgccgccgtcctcgagggaccccatggctgctacgctagggcttagccgaagccatgaaccagtagtagcagcagcaacagcagcagcggcggcggcagcggtggtggtggcagtcgactgtgctggactcgtgagcagtacaagtctctctctctctcttctctcctctccgcgaggcgttccgttcgctttggtcttggagatggggatgggaggaggaagacgaggaaggtggtggcgtttaaggcaacgcgagcgtggcgaggcgagctcgcggccgtccgatctcgatccgacggctcacggcgggggattcccgcgcccggagcatggaccccgctgtctcgggaaccggatggggatgggggccacacgggccacggccgcctggggctccgcgcgctgtcgccaactcgcctcgccggggtaggtatggcaggtgggaccacgcaccgtccgggccccagctgcagtgtctgggtaagcccgtgtagcaggtgagaaatactactcgcggctcgggcgggggtcacgtttcggtcttttcgacgagatgtttttctcgagcagcgctgtggtggaactggaaggtgat

SEQ ID NO: 57896 - DNA, 1034 bp, Oryza sativa
caaaacatgacgacgccgtatgcatatccgatggatatgatctacttccagcctactttccatcccgtgtaacggccggtacgtgtaagtgcaccatggaggatgagtatatattatagatctgatcgatcagtaaacaagttaagatgcatgtgccacaaaactcaattaattaattaatcgaacgtcatatatatcgatgcatgggtagcaagatgcatgtgaccgcacaaacataataataatactatacagtaatagagtactactagtggagtactacaatgccaacgttagtttctgcagatattgcaggataacgaggtgataagcagatacgtgcgcgtataggtgagggtcggtcgcgagggttgtggacaggtggcgtcccggccggcacaaagacactagcccatgcggcgtgtatatcgtcgcgcgcgagaaatcgatcgacagccaagctggtgtttggatccccgccacacattgcctcgccaaacatgcggctgccacaacagtttgactgatgtttggttaatacgtgagttgtggcagccacactttttgctagttcatttgtatgcttattttcgccacagctgtggcgattatttctctcgccacaatctctggcgacgccacaacttgatggctggtttgggctgtgaaccctgagcgtttcgtgcgacgagatatactaaaccggccgggcggcccggtgcgcgcgcgcgtgctgctcgatcgatcacgtcgcacttgttggtcctcgatcgtgatgcgttacaggtgcaaaagtgtacgtggttttgactggttttccacgggggaaaaagagcaggcgcgcgtcgagcggtggctggccgggtttgcgcgtggccgccgctgccctcgtcgcggccggagggtttcagggacgacgacggccgcgtgtatatgccatatagatatattatcttgatcatcgagagagattgcgagtcggggatagcaccgacaggcgagtcttggagtgcacacactgtgtgtacacatac

SEQ ID NO: 57897 - DNA, 1842 bp, Oryza sativa
  unsure (1)..(1842): unsure at all n locations
gctcccctccctcccttctctccctcgcgtctctcctccctctcttctccaccgcccgcggcgccatccatcctcaccaaccagctcctcccaccccacagtcggcggcgacggtttaggcgtgacgacgacgacgcgaggtgggcgtgcgacggcgacggtaggcgggtgggcaacgacggcgggaggcgagctcgggcgcggcggcgctcgggagcgggcgccggctcgcagggaggccagatccgctgtcgctgggccgcggggaggccggatccaccgcctccgtgccgcggggaggccagatccgccaccgtcgaccttgctccgtcgtcggctagatttgattttttttctttttgcatgttgttccagatgatgcacatgttttgatctgtgtaaatcatgtttgattgtgtaaatgatgtttgatatgtgctgatgataattttgtatttcatgtttgaatttggaaatgagcagcgaatctagatgttgatttgaaatttgaaattaatgaatcactgggcggctgcatgagtattttcgctggcggctgtcttaagccaacgccagcgaaaatgtatttttgctggcggctggcttaagatgaccaccagcgaaaatgtatttttgttggcggtcaataaccgctagcgaagatcttgatcttcactggcctttgctacattttcgctggcggctggcttaagannnnnnnnnnnnnnnnnnnnnnnnnnntggcggtcaataaccgctagcgaagatcttgatcttcactggcctttgctttgtggcggctgcaaattccgccagcaaaaatccaaaatggccgcaacgaaaaatggttttcgtagtagtgtgtgatgtcacacacaacatgtaggtttttcaccaactatagaaggtgtgtttctgtgtgttccaaattccaattaattttctttgttatccatcaaacaaaccgtgatcggtaatacatagtcggttgaactacaaactatatactaattggttgtaacctctttgaagtagagaccgaaatacactccattatccctactactataaaagggcagtcgtatctttccttcatcacattgcacatacaactaccccatcctcaagaaaatcaggaaaaacaaatcaaacgattggttaaaaggaaaatcagaaaaaacggttgatcttagagcaatcggttagatccaatcccagtatactcactcatatcacatgagccagttgcaatgcacgggcggcaaaacgtagagaaaaccgctctgtctctaaaaaaaaaaggaaaaaaaaaaagaactcttaacgaaacaaacaggccagcttatataaatgctactccattaaaggcccaaagccacgaccgcaaattgggcccaaaggcctaaccgcgttaacctgacggcccaaccaggcgaccgctctctccgttttcctcctttcttgcgacttccacctcattcctccccctccgacgactccgatccgtagagatggaccggttccgaccgctcaggcggatccaggtggaccccgagcccgccgccgccgccccgcccccgccggcggcggccgcggcgaacggcggcgcgggggaggacgtgtcggcggcccccgcggcggggctcctcatggcgtcaagggtgcggcgccgctcggcggtgtaccgcgactgcaagggcgactacatcggcgtccccaacgacccgtgcctcaccaagatcctctccaagcaaggtgccccccgcccctcccgtttctttggtcggaaattcgtgtgctgtggcctgcggggtgcgatcttgggttggtaggttcggatcg

SEQ ID NO: 57898 - DNA, 5810 bp, Oryza sativa
tttgatgtgctgaaccatgcagagattagagctgctgtgcagtttctctctgatttttactctcttgagtgacatatagaattggctaatactgctcaatagttggttgacaacctgatttgatgcaacctagctgctaaaggcgttttaaatcattcgtttgcgtgaatgctgtactagtttctaatcattgatgtttaagagcctattgtagcgtgaagaatcatctccaagcagaggaaattgtttgcggcacggcaattgttggttcctgctgctaaatatgttgtactatgcacagcatatgatattctcactgtaccatgttctttttgtatttagcatcaccagatttctaaagcaggtcatgacctttgatacattgcaggggacaacaaagttctgtttgcagataaggtattgaagttcactcaatcaggaaagatgaaaaggcgcatccttgtgatcacagattttgctctctaccttgttgatcctgatgctgatatattgaagaggaggatagcgctcgcggctgtcgataagctatgtataagcaagctcagtgataacttctttgcaatcatcgtgccaactgagtatgattgtttaatggccagcactagaaagaaggaaatagtggatattataattaaggctattaagagcaattctgaatatcagcctcaagtggcttcttctaacaggtatatggctacggtctttgtgatgaagctttggtatcccatactattaaccataggatgtactctgaacaacatctcacatgtagctaatttttctgggaatgcaaacgtatgagattttaaatcccaaaaacacttggaagttagaactgctattgatatctattttcctattagcatctactttatgagagcaaatgccaactgtcgtgataacattattcgtgattagttgctactttttactgaacctctcagcattggttagtgtcgttgggttcagtcttctgatctagcaccccagatgcctttagacatttactgcattttgttgccagtctatgatagtctaatttgtcaggttcttctctctgtaggtttgaataccatgctgctgctgaagtgattaaagaagttgagtttgaggaagctgaaggtatgtatctcatccttcatgagcgctagatgatatcatttgcttggttattgagaaattggaataggtctattgtagtgattctatgagttctacactcaatcgtgtgcattttcttccggtgccattgctgatttttgtttagctaatgctggcgatctatcctgtttccattaaaatttaaaagaaggatgcaatgcgttcttagatgttattgcttcatacttgacattagattcgaaacacttttgcttgatgaatgctcacgttgctgatttttcaatacaggaggcgttaaaactaggatcacgcacaaggcgaaggcgaagtcatgattgagaaattatgtatgattgttccctgtaaaatgtatagttcttcgagtttcaagggattcttatcagcgctctttatgcaaagttcaaacagacaattctttgatgtattgtgccttctattttctctgatgtttctctgggaaaaaaaaggtgacctgtcgctgactatatacactatcgctagatttttctttttatcataggctattgccacatgcttttgtgctattggaatttcgattttggctctgttcgttacctggagttcccaactcccccatctcattttccgcgcgcacgcttttcaaactgctaaacggtgtgttttttgcaaaaagtttatatacgaaagttgcttaaaaaaattatattgatccatttttttaaaaaaaattagcaaataattaattaatcacgtgctaatagactgcttcgtttttcgtaccggagggatgggatcccaactcaacctgtctgttagagtcttgacggctcactcttttggagaatggaataatttattcatggctagctctgtttgtagtcaacactgggccacataaccattgatacaatcgagaccaaagtagaaaaatggaatatgtggccagctgttaaactgttccagctttggcacaccacctttgatttgggacgctgttccaccaacttatatgccataaaatatctgcaaatggtgcgctaccacactgtataacaaaggctgtccgtccaatgtctgtccagatcaggggagaagttcatctggagcactgcttcttatttaatagtaattcattttttttctgtataaacaacacaatcacaaccaagcatggcaaattagatattgggtatagatgctccgtgaaagctgccacgcaactccgcgaattaagccatgtttaagagcgtacagctgatctgttatttattagtcgtacaaagcatgtatggaacggccacttagatgagatcgtttcactctgatttcccagagaatcactaatcaccttttgattaagtaaatgacccctattgagtgagtcacttgtccttgctccgtacttgcctaggattagaacagcatgattcaacgaatgtgctatcaagtggcaacgtttgcatgagaaaagtcactgaactatatggtttcttaaaatattcattcaaggagctcaaagagaagtgtgctttggctagctagtctcgcgaacgcgtcgtcgttggctcgttccagttccactgcacgcgacgccacaaaattgcatcgcatattcgcatgcatgcatttttctcgtttccagctaattaaaatagcaaagtccacagtctactgtattttagaaacacgtatacaagtcattgaccatacaagaagtacgtcttttccagcaagcgtatacactattttctctgatttctttttacgataacataatacatttgtcttaaaatatagtaacttagtactcgattaaatactacataatattatgaataatgttaagtggtatctaataaaatgctggattaccatatattttattttaatacggagagagtatcggttggaggagggatctgctaaagtttatcacacgtcgagatcagtagatatgtgccctttttcttcatcctccagacagatatgtgtctattggtgctacagaattccaccaactggatcctaccaatgagttactaccctatcacgagcccaaaggccatcatactcccatgcatcatgcatgaacctgaacttcctgaaagaacggggagaatattgcagagggcgaccacgatcgaccacataaccgcggggaaagaaaatatcactgttgatctatctacgatctccacatatccatccatcctttctttctatcctcggagaaaatgatggaatagaagcgacgaacacacatcactagccctgccaacctcacgaacacaagatcgccttgacagggacggccaccttcgcatcgcaacacattggcctcccttttgatgcaaaccacttgtgaaattgtgatctccgccttggagttttgcgatgaaaagaaaaaaaaaagagggagatgaaaagaaaaaaaaaagaggtagagattgattggtcaaattgcgttctggtttgcttgctaatccgagcctagctaccgagattttcagtaggagtaatcgttaagtagtagtaagtagtacttcctccgtgtcataaaaaaccaacctagtactggatgtgacaaatactagtactacgaatctagatataactagacatatctctgttcagatttattgtactaaaatatatcatatgcagttctagatttgtttttttgacggagggagcagtacctaaccagcgttcgatggaatgtaaccatgcaatattcaggccagagtgatggaaatacgagttgatggcacaagaaatagtggtagtgatgctgacagcacaatatccaaccaacataagcacatagccttatgatatcagttgctctttcaccggttccaatcaggttcccaatttcattagaatttcgtcgtacaaatttcgaagctctcttaaactgcttgtttttttttctatcgaattttgaatgaaatttggcggagttcattcagaattcacgaaatttgacatctcggtagtcgctgggctcgcattttaaccccagaacggaattgtgaaccttgcttccgacatggtgatgagtagcagagccatcactctctggctctctcgctcatgagaaaattcaccaatggataaaggtaactgaaagtatatgaaacagtaagcagtatatttcttgtccgggatcagagaaaggagtagacagggcagcagcagatagacaggcaccatgtgtatcaacagcaacatatacagtacatgtacagaaagctaacatggaaatctgcacatttacagccaaagatcagatcagccagtttttttttcccttctctgttgccatcttgctatcttttgacaaaactaagaccttggcatacatactatcaaaatattatatccaaaatactttccaacacgacaagatcaggagctttttggcctacagagttgccaatgaaaggggttataattttcttgcatatttcttcaaacgataactcagcatatataaagtagcatgccactttacacaaatgcagatgccacacggctcatctgcattgtttgtgcgtgggttgtggttgttctggggtgggtctctcctctggccgctacagctttcggctttggcctgactctaatccacactaagagatatcctaagcatattccttggagattgggtgagcaaaactgaaatagttaaagtgttctttcagtaatgccaatagacatgcatgccaaatggaattttagcatattccttaggctatgtttgatactacgggtatgtacagattggtgtcaaaataaaccttagcaaaggggctgttcagattgatgctattttcaaccatacatttttttaagttgccaaaaaaaatctacgtttagtttattgccaaatttggtaatacataacaaatcctgtcaaaattttagcaatattgttatcttcccaaaattttagcaatgccaaaatttggtaaaagtttattttggctacaatctgaacaggcccacaatgccaaaattttggcaaattggcatcattgccaaaattttgataggattggcttaataatattgccaaaattctatacacatagccaatatttggtaacaaattaaacgtacccacataattgtcaattttaccaaataatgatatggatgaaaatatcatcaatctgaacaagccctacaagttggaaattaatcctccatacaagtaaaacatagcaacttattagtacataagcaattaagtattagcttaaaaaaagtgaaaatagattaatatgatttttaaaacaactttttatagaattttttttaaaaaaacacattttaacattcggaaacatgtgtgcggaaaacgaagtagtaaaggttgggaaatgttagtaccgaactcaatctaagtactactacctctgtcccaaaataaatgcaaccgtgggtatccgtgtccaacgtttgaccgtttgtcttatttgaaaaatttatattttttttaaaaaataatcatacataaaatactattcatgttttatcatctaataaaaagggtgaatagtcaatacggtccctaaagtttcgcttcgggctcaatttagtccacgatgtttcaaatcgtccaaacgagtcttccaaattaattatttgggttaata

SEQ ID NO: 57899 - DNA, 7590 bp, Oryza sativa
aaccaactaaaattcggaataaaaaggagctccacgttcgctctcatggcctagaaattctcacattaatcagagaaaaagaaaaggcagagtacatatagaaatacaatttagaaatagctgaaattcagaattaaaaaataagaaatattaaaagaggagactagagtagttattacacattagtagttttgaaaagttattgcaaaatttaaaattatgttgtcattgtaatatattttataataatataatgagaaaagatatatgcttttatatgagagaaaatataatgatgctagccgcgcaatctgcgcgggccaccatgctagttagcttctaaaacatgagaaccgtccaagattataagcaacaccgaagatgtaaaaaagctgtaccaccattcgtacttagacagtatgtcgtgctaggtgcaaaactaacattcacattcacgaccacattcaccgccacgacactggtatttttaatgaatatttttggcacttttttcccatcgcgtcccatttaggtgcacgcccgcggggtggcctcagcgattttgtggtgcccccgtgctgcctctccatctcttttatagcaacaaccagcgtatgcgttctcggtttttctccgcggcgctttcaccgctctctctctctctctctctctctctctctctctcctccgcttcttcctacaaagccgtgggcgctgctcgccgcggcgggtctctctcgcgcgcgcaacaacagcagcctcaaaaccctagctgccctcgcgaccgggtcagggccttcgattggatcggccattcggttcgttcctccaggtgcgcgggggctatcgaatcctctgttctctcttccctgttcatgttgattttttttccgagttctttttttttaaccgtttgatgcagcggcgggtcggggctgttagtttttttttgtcgtttcccctgctcaaatctgtgtatgttcttggttggatctcgtagagtttgtttcgaagctttctgggcgattctttttttgaaatacaggttggtgttcttcgcctcagcctcttgtaaatcgagtgatttctcggtaggttgtatttttttcctttgcgatttgtaatagtacaagtttttggtcttttctttgtatttacaaggatctttttgctcttaaaagggccaaatttttatgggttccctttatttggacggtctgtgttcattccggaccttttccttttgccctcttttatggtttctgttcagggtgagcaatttggtgatatcgccaccaaatttgatggtttggtccttttctctcatggttctaggtcctttttatgaatccttcactgcaggatgtgcaaattcatctgatatgtttcagtttctacttgtttggggttacttacgttgatttgatgacaccactcgtaagagtggcaaatagttaattattccatttgatgagggaagtggaatatcatttgcagtgttaatctgctgtgctaaatggcactataatatattatagtataatactcttaatattttcggtaaaaacaaaactctttagtagctgatagaaaatgtcacttagaatagtataataggtataatgcctttaatagttgatacttgatagaagtgagtgtttagtggcttcacacacctactgaagacatttgtttgtttcgatggagactgcaaaactgatagatgggctatctagtattagttctaatggaatctgaaaagaatttggtgttcttctaattaccctgtggctaatacctaaccagttatgctgcacaataccatggggtacaaataacctgacttatatattcgatgttacatagattttgccaattccctcctcctatttactttacaaataaacgaaacagtgttatatacaagtatttgatataagtcgtaatgttttgttactgatattcacaatatgcttttttttgcaggatattgttggtacttgcattcctccgtctgttattcaagaaagccagtttacactgagagaaccttgctttatttggtaccactcacctttcctatcttctattttctgcccagagtagctacaattttcttcattggaccattggtactcacatcgttaatcatggtttcacgttatatgcaacgacacactaatctcagttctttgtgctttcaataacaagaaaatgtgttcatagtcgcggttaaagttgccaagagtaataacttgatatggtacccatagtcagggttaaaattgcgaagctgttaggtttagctacctgttaagtaagtgaaaccattcaattcagtccagatggcatctaccaatggagcccaactttgagcattagcatgtccataatattgtatgcatgaaaatgataccgatatagaagtatacattataaaagaatatcatcaatcatagtatttgaaactttcaatcttttgttaacatatgcatgtaaccactaatggttaaagttaattgtggagacactaatgtccgaaatgattcacttacagacgaatgcagtatatttgagtaacggaatgttgtacatacacaaggatttgctttaaagatatgcaaacattgaattgaatccaaattaaactgtaaagaccatttaccatgtgatctactagtgttgatcatgtcaaaagtccactgaattttttaaatagattttggtttccctttgttcttcaactgtcatgatccttcactattatggccctctgtagacattattttcaaagcattgcacaggatgagattcttgactgtggcttaactttttaattagcaggttcattggccttttgttttgcctgagtgaatgcaattggaaccttctgggtagaagctgaagcttagtttggaacttcatcatactgatttcatactcagaaagtggcgagaaatggatcgtgatgatatagctggtttcgtaagtggaggttgcaaggccttctgagttttctgacgaagcagatgataatagagttatgatatacagaagtcaggcaactggttcttttcatttactatttggttgacgtttgaagtttgttaactggaatggacaaagcatcatgtggccttgggtttggtgatagtatcaactccttagacacgtcccgtcattggagcactgttcagcatacttctgggcttaaagctactacaattgactattcaacgtattccagtttttctattgcaagctcaaaaacactaaaaaggaagcgaagtgctatggcaggaccagaaggtactggaaacccattacttactttgggtttagggcactcaccaagttcatctgacaatagcaaagttagttctgccacagcttatgcaatgtctccatcttcattgaaagaggctgatgaggagtcatcagctgatcttggcctgaattttgagctttgccttggcaatgatatggtacattgtcaaaagaaatcccctgttggtgctgagaattcaccattgacaaactctcataaattggatcttcagctgagtttgtctactggatcacctgaatcagctgtcaccaacacaaatatggtgtcaccgattattcacggtggcttggagatacctgttaccaactgttcaccagctattataggggaaggatctgtaccctgtacttgggttttcgagaagtcagtgatttcatcttcgtatgcctctgaagcaacatataccttcccattttcgaaggtacccaaaacaggggatgctgctatgtcttctccagtcatatcgtcaaccttggtaacaagtatgaaaagcccagttgcctgtacttctgggtcaattaatccccaacaacgcaacagtatcactaaaaactgtcagtttccaggatgtgttaaaggagccagaggggcatcggggcattgcatagcccatggcggtggtaggagatgccaaaaacctggttgtcagaagggtgctgaaggaaggaccatatattgcaaggcccatggtggaggaaggagatgccaatttcttggatgcacaaagagtgccgaagggcgcacagaccactgtatagctcatggtggtggtcgccgctgcagtcatgatggttgttcccgggctgcacgtggcaaatctggcttgtgcatcaggcatggaggtggcaaaagatgtcagaaggagaactgtatcaggagcgccgaaggtcattcaggcttctgcatctctcatgggggtgggaggcgttgccaatttccagaatgcacgaagggtgcacagggaagcacaaagttctgcaaggcgcatggtggaggaaagcgatgcacattctcgggttgcaacaaaggagctgaaggcagcactctcttttgcaagggccacggtggaggcaagcgatgcttatttcagggtggtggtgtgtgcccgaagagcgtgcatggcggaactcaatactgtgttgctcatggtggtgggaagaggtgtgctatttctggttgcaccaagagtgctagagggcgtacagagtactgcgtgcgccatggaggtggcaagaggtgcaagtttgagggctgcgcgaagagtgcgcaggggagcaccgatttctgcaaggctcatggtggaggtaagcgctgctcatggggccaggttgacttgaacttcggtgtcggcgcaccacagtgtgataagtttgctcggagcaagactggtctctgttcagctcactgtgctttagtccaggaccattgtgtccgtggtggtacattaggcgctgcaaccttccagttcgcaactgatgccaaattcgacgagatggaagtcaccccagtgaagggagatcctcacgcgcaggcaagcagcgacgaccagtctcatctcggtggtgctcatcctcctgctgtaccggcgatcacctcggatcgattttctgaaggaagagtgcatggtggtgggctactggccttactttcacggggtggaaaccatgcgaatgcaggtaactcaaagaatggcgcccttctaccatgatgacatgggagtgagattctcttcaagaaattggtggctcgcagttttgatctgtttccaagagtttgtgctgtgacggacgggaaaaactagtgttttcacatttcaccagatgttcttgtgatgcttggatttgttgttatggccctctcccgtgtgctatatataaataaggagctcgtagagcgtggagtaccgggctttctgtcttccgtgctattgtagttgatgtcgttgaactgcccttctgtcagaattcatgtaatcttggtacttcgtgtttatttgtattgtcagtgatttgccttgctgctttgctgttggaaaattgtcgtgtatttttgttgatagattatatatattgccttttcgttgcaagcctagctgttaatacgctcgtttcttgttttacaattattgcagctgatcgttctgttctttcttgccgaagaggctttctcatagatacagcaaggccataatacaattattttttctttgcaatttagcacggacagttgagtggaatctcccgttattgagttgataatcttcggtccagagaatgacaagaaaaagtatgcgagatcaacacaaggtccggcgcaaagccaaatctacagaatctaggattgcaactcgatgtcctggatgatcacacccatcaaatgggcaaatttacaaagcctcgaacatcagcggggcaggacaaaactggacaaaaacaatcacacccatcaggttgcgaccggttaggacattagtcgaggcaaagaatgaacaaaatttcctgctgaaagaatcatcgccctaagtatgtggttaagtgctaccgatctaccgtcctagtatcattcaagctaccagcgtcttctggcggtggctttatatacctccctaaagttttttgtcgagctctcttcttgattctctggatcttgtctttgctctgctgcttcctccgctccttctcctgctgcctcatgttccgctcccgctcgtacacgccttgccagaacacttcgccggttttcggccagagccacctccggtcaggatgatcctcgtcgaactcttctgccaggtcctcgtccatgctcttcagagtggcgagggagaaccattggattgacatctgacctctcctgccgttgagcagatgttgctcctgcatcgcaccagtctcggggtctacataaaccatcctccttgaactgtggaatgcccaaacgtttacgatcaactcaagaacacgggagtaacagtgttggtcctgtgcaaatcaacagagcaacgagacagaattagagaaggccataaagaaaactaatggaagtataatagtatccattcgaactctcactatgttttgaaattttcagatctatacatgacactacgtgtgagcatatttcattgaattcagctgaactgcgctgcaactgaaagaacattaaaatgaaatttgtttcatctaaataaagtaagagatggacgcaccctgtgaagactcaatatgcaatgccctgtttcatgatgtttgtcgtacatttgtgcatccagagcatctacaaacattctggaaaattgcagcatatcagtagtggcaaccaagtagctaaaactgtactacctccggtcacttttatttgtcgtttcagacaaaagttttggcttattttctttgtaaattccttgtctcaaacgtcaactaattatgaccggagggagtagattataagacaatcacattgggtggggtataaaagacgagcaatgcagctatataacaaatcaattgaagaaaaggctatttagatgcctaccatgatgctactatagcaagaattactttgaccacatgccaattgaaattgaaagagtttactttagaccgcccaatatctgcccaggtaatcacaggctacgctgtaacatttgaaagtattcatgttaacattcattgccaccacaccaattctgcgtactttaatgttatacgtttcagcatattgttaatctctaatttcagtctctacagcaagcttatcactgtgatacaaattctaattttacaagtttttaaaaggcaacagtagttggtggcagtgaatcctattacactttagtctttctaaatattgctaatttcatatttccatccctaaaactcaagtttatcaaggaaaggtccatgattacaaaatcatcacatatacatatcacagaaatggtaatttgcaattagaacaatgtaaaaagaagttaagtgctccctataataacaaaagtaacaataatgtgaagtgtgttcactgaaaaaactctttgtttcaaacaatattatcacatgtacgattcatttttctctagtagaaagataacaggcatttagctattttgagcaaatattagtagcagtgttggtgtacttgtgctttgaaatgtatacaccaacagttagctagtgacatcttccacttaatactgctatgttgactattgaattccaaaagagataatgtgcaccttg

SEQ ID NO: 57900 - DNA, 4388 bp, Oryza sativa
ataatagtagaataaacttatgagttatgtccaatccaaacaaaatcattttaaactggagcatttgtaatactggaattgcagtctatgcagcatgtataaatggttaacctgcaattcccagcattgatcgcatcacagaaggaccagaaatcttggcttgctaggttcctttcatcttggtccatccgaacccaaaaatagaaggcatctccatgcttttgagtttgaatagcttccaaaagtgcagtttcagcctttttcgacaagtttgcctgttcagtataaattgttggcttaatcattatgcaagacctctctgctttgcattcttaaaaggatcaaagcatatgaataacatggttaaccaatgattcattcatcaagtaaattcatgatttaccaatcatacacgtcgattaaaattaagggggcttaaatgcaaataaaatttgatcttctacctttcttgctgtcactctccacgactgaaatcctatccaagaatttttatgaattcgatcaatcctgttggctagagcaaagaaagctccaaattcaccaagaatatctctgtagtacccattgttcagcagtggaagacgagaagaagcatcaatgtcatctgcgccaggccttcgaccttttgaagactaatcaaaaaaataaacttcattgatcaatgtaagtcattggaatatttggaaacagtcaattatatttggctagccatatatatgtttcatcaattacccttttatgatacatcattcttctcagactttaggataaagtttagatggattagatatacagaagcttgagagctaaatggatttataattctggaataatcccctcaaagattgagaaatcatgaggatctctccctcctgaagtggctcttcaagccacatgcgacagtttgcaagttatctccaagttaacatttagaaatactgttaggttttcatcaaaagttggaaattcccactccatattaggtgaacatatgtaacaagtcatgaaatcaggtatataccagtttagaaaggagtggtccaaaattttggaatctacaactactgctctttttttcgtttataacatcagaaatggtttcaatgaactcctagttcgaccattcaggtaaagcgcaaagagacaacaaaaacttaccagaccaattccacgataaagggagcttctatgcagaaagggccaagtcccctccccaaagaaaggttcgtatatagaaagtggctgacctgtccgctccagctccttatcatctctttcatgcaagtcattcttcatcctctctactcttttgacatttctatacacttcctcccatgttccatggagctgttcactcctctctttcagctgcataatatcaatccatccacttacttgcaagtgttctttccaaaactgtaaactgcatgtcaaatttaaaagcaattgcatttgtagtttgtacttacctcctcttcttccaatctctttttaatgtttgctatctcatctgctctctcttcctcccatgccataagagagaacgtatcatcaatctttgatgcattactgtgatgatcttccatttggttgctgcgccacttctcctctagtttctggagtatattgtagccagccaaagtcccattcatatggtacaagtgcttcacatcctcaaaaagatgccatttccactcttgtttcaaagcaacaggaatctccccagcagttaatggggttagtacttcagcaggaaacttgataacgttttccaatagcacagcatacccttcaatggtttctgaagccataagattcttggcatggacctttccagctgatgcaattttttgccccagaacagatatcttcccatttgatactgcttgcaatagaacttgtgttaacttgccaatgttcttacttggaaaaagaagtgcattcatcccatcatcaatctaagacatcaagataaatgtgtcagttagcatcttaaaatctacaataactggtatttgagctgacaagtacaatcctgatagaatatgatatgtatccgtgaacatacatattttctgataatttcaaggtctggagctataaccagcttctcaagacacatagcttggactagcacactcgggaaggattgctcgttaaggcaagaaccatatataacaaggtcagatataccaaggaggttgtccttatcttcagaagcaacatgttccactgcaccccttggaaagccaacatttaaagaaacagcctataataatcaaacagcacaagcaattagaccaaattttaaagctttaaaacttctgaaaagcaaatttagtgaagaaaggcagaaggagcgctaaataataacctcaagggccatcctatgcttctcagttacgttttctgccaagattctcactttgagttcaagttgtgtgctattctcagaaggatactgttgtaacagagaccctactgcttgtaagacaagtgcttcttccatcaaaaaaccaccatatgaaattgactaccaacaatagaaattacaaaatcactcggacttaaacccatactgactctcacatcttggtcataacttttggctgaaattctatcttgaaatggtactgcaggggaacctggaatcacgaaatagttaccagaatcaaatgcagcatacatcacctgcaggatgcaaatacagttaaacagtctatttttaggtcgtacgactatattcatgacaataagttatatgatccaaaagtaaataccggcaatacatagttggggaaaacaataacattcgccctactgaaggcctctttccaaccatctaagatctggatcattccactagaattatattcactaatacgatgagcaagagaactttcttgaacattccaaatgacgggtatggatttgaaaggctcctgcagaagactgtagatagtctaaatcaaacaatagattttgtgtaaactttaaggtatatcataatgctaaacaaatcaacaaacagctatagaacctgttgtttcatacctaccttgaaaataccggtcttgcttcaatagaatttacaagtatgccatcatagctgcagaaataatgcaaataaacctgatgaggaaatgattacgaagtgaggctgaggccacatgttatgcaattgtacaaagcgagaaaaaatgtattgcaggatacaacaaaatgagatatatacttcagaaacttactctagccaatctacagatatatgtaagtctgtgtcctcaggtaaaaggtcaactgtgaccccgatagttctccaaatattagtacaaggaccatccttaaatgtgaaaacctgcaacaataatttgtaaagggggtcaagggcaaaatcacaaaactattttttggcgaaattatagatcaaataacaaatgttaggtcagattctagcacccaacatgctacggatgctaccagtgtcagaaactcatgcataatgttctcattcagcacacttctcttcattccaacttttttttctttttgcaagccagaagcccagaactgacatattagcatatgcaacttttacattactggatactatcacaattcacacatgatggaacctgaacttattgcaaagtatagaatgcgataacaaaagcaaaagcaacaatatacccaacttctacgataataaaaaaactaacggaaaacataacaagagacacaggttgcactcatttcgttcgaccggtaagttcactacgcagtaatgaattcagagcgaaccagttcagcacgcaccttcatttcgtagcccatcgcctctagcaccgaggcaacgctaaccatctgaagctgcattgcaccgggagagagatccccaaacacctacaagggagtccaaacacaaacagcgaacgaatcaaaaaccccacgtcgcgagaagaaacttggcccaaatcctccacccacaacaccacacaacccagctcaactcctcaccatggcaagtcgcggcttccggaccccgaacctcctcacgggattcccgagcttcgccaagccgtcggcctcctccctccgctccctcgcccacctctccctcagcctcgtcggctcgaacgccacgccctcgcctgtctccaccaccccgaggccgcggggcagcagcgcctcagctccccctcccctcccgccgccagctctccgcgagggtagcagcatcgtcgggcgctcgaagacggccgatccggggaggaaggcgacgacgaggatggtgacgaagaagaaggccgcggcggtgccgatccactggaggtagtccaccttctcgaacagcaggaaccgcgcca

SEQ ID NO: 57901 - DNA, 7781 bp, Oryza sativa
  unsure (1)..(7781): unsure at all n locations
cagcgctgtggtggaactggaaggtgatggaaatggaataaataattaatccgggcttagtaagataattccgtgtcattatcgtttcttggcacgcaatggaaaagtgttactaccacgaactaaatcttgagaggaaaggattctgcaggtggtggcggcagctttgattggtccgcccgtaaagtttttcagcggggtggggtacacgggggtttagatctttatttttcggggaaaatgaggctgtgactgtgaaagctcagcacagccacagcagaagcgtttctgtgaccgaaaggcggaaagatcgcaaccgtggccgtgccaaagtgtggatgtgcaggcggccggccgatgcagagcgcaatggcggctggagaatgtgtagaaagcatcgcctttgtagtttggcctccctgggaaccgaggaatttagcggaaatttcaaaagaaacaaactaatttctgttaaaagaaagttatacaaaattcttgtgttctaaaggagactttttttttagaattacacagtacaatgcagacactcacaacgcacgcgcattcatccctatgaaaatatgcacgcaaattctacccctacaagcatcttcgaagactgccggcaaatcctgaagagattgacgaagtcaccacagacgcctcgctgtcgacggatacgtcgcctaccactgaaagcacaagtcagcaagaatatactaacatggattcaaacttaaagagaatccgctggaaatttataatcctgcagctgtaagtgggcattttagattacgcagttcattgtctttgggaattaagaggattcgctcattagactaaactaagtgggacggtacggtttgggcgttggatgcttagttcttaatgacgttagcgactaacggagtagcgtgttaacacgtgcaaacaaaatcttcatgggtttcctagctactaatggccaatatgagctggagaatataagcatgcaaattgcgcggtcatgtgcgtgttgaatgccaaagcgtgcaaagaggaggacctatctgcacggcagctgacattgatttgctcatttgcatagtggtagactggtagtggagtgagattttggacaaaaggggctccatcacaagtaggctagagattgtcaccatctcttaggcagcgttctagagggtgagagagtgagtttgtttgtttcgtttttcgcgtacacgtttcccaaactactaaacggtgtgtcttttgtaaaaattttcaacggtgtgtcttttgtaaaaattttctacagaaaagttgctttaaaaaatcatattaatccatttttaaaatttaaaatagttaatactcaattaatcatgaactaatagctcacctcgttttgcgtatcttctcagtctcctcaatcccttcttctcaaacacacccttagatctgctcgcactaaaaccactcatcgtcgagactgatgtatccgatcagtaatcagtttgctttacaatcaagtaaacagtcagtttaatcatggcaatccaagcacaataattaagcattcaacaatgcgctctcccatcatgaacgtgtactgtagatcacaacagtctattcaccgccccagtcgtgtgctgcagttctagaccaacggcagctcagatgacagtttgcaacagaatgcaatacattctcagtttctcacaggactggtcggaataaggtctcctttcaagcggatgaattttggagaattttttttatgaattgaactaattcatgcaaattcttgtaaaattcatgcttggttatttacgacccacatgtactaatcatgcaaagttgaaaatgtttgtggtaaactaaccagtaatatcaaccagaccaccaggacgctaggaaaaagcaaatggagcaggtagggcaataccccacaggaatcaaaatcatatggtccattctccgttgtgctgttctgaaaaggcaatcatatttgatttatcgagacaaagacaccaaggcgattgacccacccctcttaaaagttgccgacacttgtagttcctgctcagcggcagaaccacaaatcgcggacaccggtggcaaatatcagtatatctcagctccgagcttatcctgcactgtagcaaaattagcttgtggataactctgtatatccagtgattctatttcagccagtcctggtcagcattccacgagaatccaagctcatgtgctgggaacagatgctatcaaacatcaatgaacatggcaattttagtatgggactcaaatatgagaccaaatgctatcaacgagattataatttttcttaaagaaaaaaacatatgttagttgcaaaaagggcatcagtcttacaaagttacctcatccattccaaattatagggcgttctctttttaaagtaaatcaaacttgataacttttaactatttatcatactaaccatatacatgctaagtattatgcatgttatattactagatatatattttaaagtactttcatgtgatgctaatttcatatttattaggaacataagttggaataaattaatggtcaaattatatcattgaagaccgtataaaaaatatagagcttataatttcaaatggagggagtataatctaacaaagaagcccagtatcaaacagttattaggcacaatgagataacaggaacttagaggaaaaacaaactcaagctaatgcatcaaagatgtataacaatgcacgactgaaagtgacgtgaacttggtacaaaggcagtaaacattttcttttgtttagttgttgcatcatccttaatgtccaaacaaatggccaaaacgaaagaacggtgatattttatacttggacggcatgtcaacacatgggcatctgacactggaacaaatagtttcacaggtgatctggtactaatctaattaatgttaggtaggttaaaatataataccagcgaagaagatatgctacaaatagcagtaactgcagcatattcatcctagttccaaacttgaataaagacagatgcaacgtactcaagaaagacaaatggacaaaacaccttgaacctactctggcttttcttgtaaaaccaggtggcatgcctttttgtttttgttttgtggatggatgaaggaatacagctattaagagtaatgaataaaattgaattgacctggtcacgaatcgtgatattcctacaaagacatggccaacaaaaggagcaacatagcttgcagacaaaactacgatggtacaccatggatcagctgattaaaaaaaatatctgacaattggccattgttaagcaacaggctccaaaacttcagtaacacaaccttggaaaagtgtgtcatatctcaagctcctcgtgacatcaaagaaatgagctacagcttcttctggtgtttttacaagaacaccatggcccaagtttagtatatgaccttttggaccagctgatttgacaaccctgcagagcagaagattgggtgaagaaccattagcagcctccagtgctggttccagaaatgtatttggaatgtaatgaatgagtagaaggttcagtccatcaacagatacaactcctactagaccacaaacaaatatcaagggcttancagtgagcatagctgtatttatacatgtttcacatttataccacagtataaaaaagcatgagatttgaaattgtgaaataactatatggttggtacacctaatccatccaaaatatttaatcataactgagatctgtaactatatggttggaactatatggctgctatttaatcatatatctgagatctgtggttggatccttaccaccaaatccatcctaaatatttaatttgtacattaattctctttcttgattaagtcatactatccagcacaccttgacaccacccacctgacacccagtgatgccacccacacactgagcgaaaccaacctcaacacctcctcacccctcctggtgcccatatccacatcctacacctccccctctagtgtattttcgttttgctttattttcttggctgtgcgttccgtgcgcaagctgactagtaataataaaaatgcatggtgttcatctattacttgttctataatcaagagtttaagacattcaagggtaaatgctgcaaaaaaaaaatcattcgtaaaccacaaaacacagatcataaacgaattcacttgcgcaaactgtacatatatgaaccaagttaatcaaagatggcagcactagaagatgaatgatatgagtgccataatcacatgatacaaaaacacagtgtggacaatttggagacctcactgatgaagcattctcaaatgtaagtattagaaacttaaatgaacagaaaatgaaaatgcacaatgaagttttaactaacctatgaatttcatcggtcagtactggtaatggagaaaatagaaatgctgggtcaacattcccctgtacactaattttgttaccaaggcgtctccttccatctgccatatccactgtccagtcaagaccaataacatcgactcctgtgtccgtcattcgctcaagcaagcctccatttccatttatatagagaacaagtggtacattggggcattcaatcttaatcttattcacaatctgccaatgaaatggttccatgaaattcaaagaacagaatgaacaacaaaattcaaactcacacaaactttacaaactggaatgttttggagggcaagatgccaagatcaatgggaaactaagtcaatatgcagtcttgcagatcagctaaactatagtgaaacattgcattcaaatgcatgtatatgacaacgtgaagctagcattagcattttacatttgtttctgattgcttacaacggattggttctttatgcactccttgtttatttatgtgtttcttcacaggttatgtagtaacttgcaaccataaccataccaagctcgaatgcgctgccagaagttgtgtggaatccaatcaattgataagtatttgtttaaatacatagaggcatatttctcaacattttaaagaacttcagaaattttagggggtatgctcattgatgcagtactatacattgtagatccaacctgattaaccttagagcagccacccatcatgaaattagtcataaggattaaggaagcaaacaggaccgagaaaagtaaaagtaagctacctgcttgatatatggttttgaccactgctcccacacatgaggtggaagttgtccaccccatgaatcaaatatttgtatacattgagccccagagtttacttggtaaataatgtattcagatatggcgtctgcaaggtgagacaaaagtccccttaacacatttggtgctgtgtggcacatgctctttatatttgtgtaagtgttggtcatccccccttcaacaacataagttgcaattgtccatggggcccccacaaatcctagcaaagcagcttgtccatcaatctagagggtagaggagaaagtgagatgtatcggtaccaaaataatactggatcaaattgcataggaaaactgaatttaatccaatacactctcacagaatgatacttatacattgttgatgttcccaaacagttatgaaattggagaaaaatatacaagtagagcagacaccagtaaccaaattaccaatgtttggtcacaacctggtctaacctggtctgcaactcactggttgctggaaggatttaagtgaatcacacaatatcatgaatcccaaaaatttaaaacaactattatcacaaacattcaaatcaagcatagtaaaggagcagactctggaaataagcatgtgatcgatgtttagaagagacggtgcagcaatgataggtccacaaaaatgtcaagacttccttaacttgcttagtgtttatgaaagccaaattttcctgatatttaattttagtcagttgtcaggaacggcagaagaattactcgactctactaatgaacaccgggtaattccactaccgttttgttttgcagatgctacacagcgggcttgataataattatgcactattgattccaaatcaccttagtctataaacatgacacgctgccagcaaatacgcatactatatttcagcaccacttgcaccaacattaacaaaattgtatttatataagtaggtgagtttagtggcgacaatacaacgccactagcctaacgaagtagctttcgtgaatcagctaactacgccagcatagaactagaatgtaaaaaaacctctatcccctattagcattttcataaaaataatgctgaaccaaattttacttgaatcctgtaaaggccaacacagcttgtcgttttactttcacaataactgccagctcatataactagatttacattgtaccaattcatcatgagcccccaaaccgagtttcatacaacaaattttaacagaaagggggttttccataccacaaaaatggctgcgcattacctcagtgcgtagaatcttgagcgactcaccgacgaaccggagcttctcgaagtcaatgggggtgagctccctcacctgctcctcggacctcacgggagactggatcacaggccccttggagtcggagatatcgaatggcaccccaatggccggcagcggcgtgagtatgtccgagaacaggatgacgccgtcgggcgcgaaggcgcgccacggttgcagcgtgatctcgacgatgagttcggtcgtctcggaccgctcccggaacgaggggtggcgcttggcgagcgcctggtactccgccatgtaccgcccggcctgccgcatcatccacgccggcggccgcggcagcccgtcctcgcccctcgccgcccgcaccagcagcggctcctctggacatgcgggaggcccagatgcaggtcagattagggcgaaaatggaggaaaactggaggagagagagagtagtaacagcagggcggttggttttaccagtggaggaggcggttgcgagggacgcggagatggcgggaaggccgctgcgccggcggtgggtggtgcaggaggaggaggaggccggcgccgcggcgaggaaggcggcggtggccgtcgcggagatcatggcggtggcggcgacttcgcggcgtgggcttaggtggctgttttgcttatctaatcctgcttggggtcgggagtttgggtttgggtggagaaggagcaactgctggtgcggattccgcctccgcgccctcgtggcctcgtgggccaacggggaaggacctggcatgccaccgtggctagtacgaagagaaaaaaaaactcatttcaagcctttatttattttgtattacaaacatttcgaataaggtccctttttacattggccctaatccattttgttgccaaaatttgacccttttttggacttttattacgtggcattggacacccacaactctagcaacatactccatgtgttgctcttatatgtggaaactttttgtaaactagtacttcatccatcacaatttattcatcacataagattttagagatattctcaaaaaaattattattttaacaaaataccttatgtttatttataaatgtgcatcgtggaataccatgcatgcgtgcaactatatgcgtgtagccaatcaatattaacttgaattggttcaactcatgcaacatgtagcgcccgttccgtcatggcgcctagcgggaaannnnnnnnnnnnnnnnnnnnnnnnnnnnnnnnnnnnnnn

SEQ ID NO: 57902 - DNA, 3919 bp, Oryza sativa
gtcatcctccctccgccctgtcgccgattggccgctagccggagcgccagctcgctggcttgaccgtccaaagtcggttcccctctcccaaaccgacattgccatcctataaagcccaggcgccctccctctcttctcctctcgttgtcccatcgcctccactccattgtcgccgcctcccgtgctctgttcgccgtcaccgtttgtcgtcgcgcgtgtcggaggagccgacacgagcgaggacgcggaaggggactccgggcgcgccctcttcttcctcttccttggcccgaggccgaaacgatcacgtttcgcgccgtcggctctcgtcactgcgcccgcccgcacggtagtgcatccctccgttctccctcctcgttccatctcctccccttagactcgggtagtagcacgagtagcctcttcgtagctagccagcgccgccccgacctttgccgtcgctcgccgtgtgctcgccgctgtcgccgcccgagctcggaaacgcctctcgtcgccggccttcctcgatgcgtttcctcctaatccggcgcaagggacggattcccgtagccgcgtagatgctctcgccgccgggaatcggcccctcgtgacctcgtcgccgttttccccttttctctccgctggtggccgccgccgcaatccgccgccgtcgagctccctccagcgaatccgagccgttggctcgactcccctcgtcccgcgcaacttcccggtgtgctctctttcgcctagatcgccgtgtttcgctccgccgctcgccaccgccgtccgccgtccgttccggccggcgtcttcttcaacctcccgccggcccgcgttgctgccacgtaggcgccagctcggccaagaccgggtcgagccgaccccggtcagccgctccctccggccccgctcgcgggcgcggtccaccgcgagccgtgaggctgcgcgtgggcccgccgcatccgcgtccaccgcgaaccacgcgcatgcaccgcgccccgctccacaccctagcgccgcgccacgtgctccctccgcacggtgagccgagccgctggcaagcgggtcccacccgggaccacgcgagatggactcggtccaccggcgccctctctctcccctccccgcgccctattgggccgtgtcctcttgggccggccggcccatttagctcggccgagccgccccttttctctcgggccgcgccctagccgcccgagggaagtctacttcccctccatcttccttttcttttccaaaagggtttaattaaatcctttttcctttagaccaaaaatctaataatcttagaaattcaatatcttcccaaccgtaagtccgtttgactctgttcaacttccaaaattcctcgaatctcgagatctatctaatggcacgctgagaggtcattaatagggccttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctataattgaacttaattatgttgcttgaaaaatattatgcattgataggatcacacttaatctgcttgtcccgtctgcaaggcagattggcggacctacctattttgttgcattgatccttcctctgttaattgctatatcatgttcccttgtaaccacatagtcgtgcctcggtaatcgtgcactctgcacgagtatcgacggtcgccttcaaacttaaaatctgaaaaacatattgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggatcgtttccttggaatttcatccgaacataagacaagtacgaccacatgggtggaatgggacacccctggctgagtaactagcttatcaggggagccttgatgccgagagacatgtggattcaccggggtggtgtcggggaggacccccgggcttcctggcacagtatggtctgggacctaacctgttgttggtctgggacccctctcgtcggcatatggtaaacctgtgtcggctttcgaaaatgccttgtcatgaaagcttggaggtctcccgacgtggctgatccccacgggctgggtgatccaggttagtaatgtcgtgtgggtaaagtgtacccccctctgcagaggttaacaaactattcgaatagccgtacccacggtcatgggcggatgtgaggtgattcctagcgtagttttgttttactactgcttgtgaaattgctgttgtggaaaggggatcgatgtttggaaaatctgcagctgatgggatcagctaggctcgggtggccgtttgaaagttgtaggcccgggtggccgtttgaaagttgttggccgggtgccaatcttgaacaattcaaaagactgatacattgcacatactccgaccggacgagacgcactgtctcatccgtgtcgtttgagaagcactcacttagttgatttcagaaaagagttcaaataaaatcaattgcaaaaacaacagcctttccttgaagcctgcattaaacacttatttctcatggcttgctgagtactcccgtactcacccttgctctatataaataatcccccccagttgctggagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagtctcgctcggggctagttcagggcgtgacacaacatttaaagtgtaagttattttttattggaacgaaacaatagagaaccgccttaaatcaatttcaaaatgatgaatgtttggtgtcctttcgttgctctttgtttatggaatgatcaaaatgggatggatgggactatttgagatggccaaaaaaatatataaaaggtttttttatagacaatatggctcaccaaaaaaaccttcaaaatgattattttcttgttttagttcaattcaattcttccatgaacaaaagaaagaggaatccaaattactcatgaagcatcaaggttaactaagctctggggagctttggtgctttagattttttttcccaagagaaaaactactgtcaaacatttgacatgctcaaaagtttcaaggatgggattaaacttgtgttagtggaaattactaaacacatgtaattggaaggtgaaaaacaagaaactgttcaattattgaagatttgtgaaacttgtccgattttttttaataaaacgaatgaccgaacatatgtcaaaaatgttaactgtcttatataaaaaaatatagtttatataaaaaaatgaagacagtataaaggagtataacacagataatgtttcggatgaaatcggttatattaaaacctactgggaattggcgagctgagagcgattcggagcggcgtgttcgtacgcagaggcatccacgtcgcccgcgagcgctgggaggcgggcggaatccgcgccctctcgtgcgtccgcgccgtgcagctcccagccgttcgattcgtcgcagcgacggctaagatcgatcatcgtcaagagtgtggtggcaatttttcaaaaaaaaaaccctccgttgcat

SEQ ID NO: 57903 - DNA, 3952 bp, Oryza sativa
catatgtcaaaaatgttaactgtcttatataaaaaaatatagtttatataaaaaaatgaagacagtataaaggagtataacacagataatgtttcggatgaaatcggttatattaaaacctactgggaattggcgagctgagagcgattcggagcggcgtgttcgtacgcagaggcatccacgtcgcccgcgagcgctgggaggcgggcggaatccgcgccctctcgtgcgtccgcgccgtgcagctcccagccgttcgattcgtcgcagcgacggctaagatcgatcatcgtcaagagtgtggtggcaatttttcaaaaaaaaaaccctccgttgcattgttaatgtgtttagaacccaagaaatacggtgcgacgttgtggtcttttacgtataagccctccataaccaagaaaatcttacatgaagaagagagaaatctaaaaataggaccgcgctctgaaaaacgagcatcaaagggcttttttgaaaaacaatatatacctataccccttcccccaaaaccctagaatcattgctttccttcccctctccgccccattgacgccccgcgccgccgcttcattctccagcaccaatcctcgcccctgtcggcatcgaaaacggagggaagtgcgcgtgctgatgtttaatcatgcgatgccaatgatgtaagcgcccgacactgccgcgccctgctgcccgtcctccattacctctctctctctctccttgccgttggttcctctgagctcaagctcgatggtgagaggccgtctccgtccgtcggcgacgagtcagtctatctggctttcaatcgggttaggtcttcgtcctctgcatcacctcgtcgtcgatttacctgtctccacaatccaagcccattctgccttcagatctggtgacggctgccttgcagtagccggatttggcgagctcggggggagggggaggagcccacgacgatggtggagctgaagcggatgacagccaccgtggtggtgtagactgattggcccaggaggcggacgcctcgagcttgcgagaagatggcgtcggcacggtgttctccaaggtgggggtccccctcgcgcctttctctcgcctgctttagacaatcacgagccgcctcgcatcgcctaccgccgccgctgcatcctccgtcctcccctcgctgcttcatctggtgccgcctcccataatccagaggagggctccatatggtggtgcagcgcttgatccggagcagctctgatgttggacacgatggcaagccaagggattttaccaccagcatctcctggccaccctcatcacccccctgctgcctcctctaccatctcctgctttgaatcaggtttgtccaaatcttttgcttgctccttatattccatcgatctgtttctctattcttaattggactatatccattaggaaaaaaagttgtattagcttattgctaatcttctacaagtagaataatataggttggtttcccttgctctagaatgatctagcatctgctgttatgcatgcttggggtactgcattttaatagttggctgaaagcctttatctagctttgcagtgtaatgtttacattttcctttgatcaatttcagattttttttaaaggaaacaatacacggtgtactcaatctctgaatgatgaggtcagtgacaaggtaccatgtctattgataaatttgtgccacagtttcagatttcataccgaactgtgtcgataaacctgtaaactcctcaccatcaaaaaatattgtaaagataggggactaaaacatatgcaaaatagttaatatggacttatatttttcagccgcctaagattttctgagtacaccaatcatccaactgaattttgaatttactctaagtaccagatgtgcagggtgttcattacacttaagattgacacttaccatttattttgtatgcatgcatgttttatttttggtcatgagctcagagaatcgatcattccttttctgcatggtcaacaaggcctttaattgctagcttgctgatgatagtctagcaatttggtccagcacaaaaatgttaagtttatgaggaatctgtttatttggaaaggaaaaattgttgttagtcatagatggaggctatagcccaaactaatgtttttttctaaagaaaagatttctttaatttagtaatatactagaaaatagacgtggctttgccgcataatggaccaaccagtataaaataatccatctgtttcatattgatcaacgtttaacacaaattaaaattttcaaattgatcatcacccccttcgttagacatgtaatattattgcatttaagcatcaaaattgagtttgcgcatgaatgtaggaatttgaggtagtaaagctatcatttcttatatatggggctcagaaggagttaaagtgtgcgtgtttcttgatttttccctatcacatacttacattaaaatgaaatataggaaagttaatactttttgttggtctaggtgaaaaaagttatataataatcaatatggaatgtagggagtctgatacgtacacctaatttctttatttatttaatgcctcaaatgatgaaactttacccttttattcatatattaatttaaagcagcaagacattgaattcatggacataagttggaagtcgaatatatgcgcaaaaattccaaattcctatgaaccaaagtaatgaaacggcttattcccattttatctctcctcacagtggcggagctagaaagatttttaaccctaagcaaacttcacttctagtaattgttgtataaatttcatcatcaattcattcaataacatataaatttagtggagtttttgtcggtgagcatgcgcggccacctgggctagccaggcggtggctccgcccttgcctctgtatgtctataaaaatcgagaaaatctattattttaataacacaattcgaatgcatctgtctataaatgttatgcaattcaaatgttttctcaaaggatttttttcttctgtaagaaaatactgcattaagttttaatgcagatatataagtttttggtagtagcatttttttatggtgagaaataatgcattacattttgaatgcacgtgtatactactgtgcattcaaaatttgcacgtgtatattactgtgcattcaaattttaagttattattaagaacattttttccttgtgcaaaatgtacatagaacacaatgcatctatatatgatgctgtaaagataaatgtattctgtgttttctggcaatgtcgtacatatatttgccttttgagcaattcataagtgttgcaatttaaatctaaatttaaacccaagcaactagtactcatggtacaacaattttcaaaaagcgggagaactctgaaacaaaagatacattaagagcatattttgaaacgaagtacaccattttttttgttgaagaaatcattactacgcaatactctgcaatttgaatgtactttgggagatcatattttttattacatttctgaatgtttgtatgcactactatgttaaaatgattttttttgtgatataaatgtatctgagagttcatttggtatcagcataatatatactgttcatggaaatgtatttcacttccacattatcattttttaacttctgtgaaaagggcgtatggaaaatgtatatatgtgcaccttggctctaccaattgggtcattgagcatttgttttttaacattattttaaatcatgcatcatgcacaaatacttgtactccatttttgcacagtggtttgtatacgcatgcaccgtggtgcagtttaaatttgaaatggccccgtcccaaagacatgggtcccaagcctaacaattgaatctaatcgcacagtttctggaattacatgccactctacaacactttaactgctcat

SEQ ID NO: 57904 - DNA, 3992 bp, Oryza sativa
  unsure (1)..(3992): unsure at all n locations
cacctttctttttttggcttccaaatcttctatggtctttgctctccatcctgatttgttgtatgcttcttctgtgcaatgaagctaacaaaaagtccaaagcagagctttgcttcagagattctaaattcagttattttagctattgtaacatgtaatagtcatttgtttattgtgttcttggctcaacgtgcagctctccaattatgttccctttttcgttacaacaattcagtttaatgtggacccaggttctagaatgttttatgtataatgtttttagttgaataaatatccataatccatatatgactatgcataatttccagtgaagaaagtactattgattgctactacaaattaatagtagtgtcatgctgtaggtttaggattcaaggaataattggattgcccctttgtaaggtaaccagagttagatagtagttatcttctttctgaaaatgatggcagtgccaacatccattatttctaaacacacatttctattctttcagttcactcccatgatactgaaggatctgattctgattgcaaactagacaattcaagggtataccctttgttttctcctttagagaaggaaactctgaaagattttattcactatcggaataataatagttgttattctttgttacaatccttacaaaaataacatggtagttcttactttatacactcaacctatttgtaggtatgtttagcttgaggatttttcattttccaaaaaaattactatgcattttatattgtgttgttgtaggtttgtagaggtaaagtcgatgttctttacagagtttgccctacttgcaaggtgtggcacatctttctggccgatctcttacaagttatagttatgtggcataagaaagatgtatcagtttttatgtatttggtcattggattacgaatgatgtctgggagattttataatgatacaacatatggagtgcaggttttattttttagattcatctccaaagagacctgcaagatctcccttttgaggtcatgaagctcccctttcttgcctccctaggcttggggcctcgactccctctccatcgatggaaagctactgaggcagccagccgacagaagacatagagttgatcaagaaacaacagcacatgcataacaagtgatgattgttcttaaaaaaaaagacaagtgatgatagaaatctaaggatgtttgggcatatgctatgctgtatatgtattatgttatcgtttcattggtttttacctgtttttcttttaactgaaggtggttggtatgtcaactccgctgctaccacaaaagataatcttagcatgactataaaaccccgatagagcgcgcatcgcgtcgtaatgtctagttttgtaaatggtaagggagattttacccttagccgtcgctggcggcagcgtccaaccggaccacaccacaatacacttgtccgtggcacacggattcgctgtccaagaaaatatccacgccgagtcgctagtcgtcaccacccgccgcggcccgcgagcagaggaacagcgaatctccatcgacaaccgcgaccgcacccacccaccaactccccactgactccgcaaccccaccaccaactccccactgactccacgaccccaccataccctggaggccgggaccacccacgcgtttccaccccacccccacccccaagccagatccgaacgccacacgcgatcccccgccggcgtcgccgtcgcactccgtccgcacccgatccccactgtcacaactcgcaagtcgcaacgcgcgcctcgtcacgcgataaccgcagcggcgggtcgcggtcgcccctcggtcgtctccgcggagcgcgtatactactcgtgcgcttctgcttcctgttcaaacccaacgctccaccacatcgcctgcgttccccaccccgactgacccagcctccagtagccatgggcaaccgcacgttgcgccaccaccgcgccgctcccgagcagccgccgccccagcccaagccgaagcctcagccgcagcagcagcagcagcagtggccgaggccgcagcagccgaccccgccgccggcggcggcgccggacgcggcgatggggagggtgctggggcggccgatggaggacgttcgcgcgaactacaccttcgggcgcgagctcgggcggggccagtccggggtcacctacctcgtcacccacaaggccacggggaagcgcttcgcctgcaagtccatcgccacgcgggagctcgcccaccgcgacgacatcgaggacgtgcgccgggaggtgcagatcatgcaccacctcacgggccaccgcaacatcgtcgagctccggggcgcctacgaggaccgccactcggtcaacctcatcatggagctctgcgaggccggggagctcttcgaccgcatcatcgccagggggcactactccgagcgcgccgccgccgcgctctgccgcgagatcgtcgccgtcgtgcacagctgccactccatgggggtcttccaccgggatctcaagccggagaactttttgttcctcagtaaaagcgaggactcgccgctcaaggccactgacttcggtctttccgttttcttcaagcttggtgcgtgctcgaggcttcactatctcattacagaggaatggatcgcgagatatttcattgttccagtgtttgacttcatgaggattttgggtttacttagatcgagttgttgggtttgacaggtctgaaagtttcaccgttactagaattaggggctagatgcaacgctgcaagtgccattatgtttatacttatagatgttccagatgcagtgttctagttagcattggatccatccaccttactccactatagcttgggcaatctctgtgtttgcgtttaccgagatggcattgtacatttgcatgatttgcactttaggcactggatattttccccactggtagctaaatgctggcggcatagcatgcaagatcttcaaaaatgcactcagcaatatcagaaatgccatctgaacttagtgggtgaagcttgactcttcattatgcagaaatgttggtgacggtggaggattttgttgttttagtgtttttcttttacaatgatggtgggggattcttcattctgaacttggctttatttttcttacacttggcatgtgcaaactgagtgctatatgtcccgtagggcctcgttgctaagtgctacaagatctattgcactggaactcgtggttatggacccgaattctttagtatggaacaatgtctttccaagtaaaaacccccagtatatgaaagaatggaaaggtgttttcgttcttttcttgtggaataagaagcctcataccttagtggaaggaaaataagattttttttttcaattaggtatttgaccaaataggatcgtctggttcctatagaacctatcactaaaatactcaatagactaagtggaacgaaaaggattttccttgagatggtaaatgaaaatgcctattgtggatgttgcaggggagcattttaaggaccttgttggagtgcgtattatgttgcacctgaggtgctgaaacgaaactatggagcagaggctgacatatggagtgctggcgttattctttacatccttctttctggtgttccacctttttgggcaggtgaggtgacgtttgccgcttcttatttcagtcaactttttttgcttctgttgctaacatagatgttctaccttcattttttcagagagtgaagatggtatatttgatgccgtattacgtggtcacattgatttctcgtctgaaccttggccttcgatatccaatggtgcaaaagatttggttaagaagatgttgcggcaagacccaaaagagcgccttacttctgctgaaattttgagtaagtnnnnnnnnnnnnnnnnnnnnnnnnnnnnnnnnnnnnnnnnnnnnnnnnnnnnnnnnnnnnnnnnnnnnn

SEQ ID NO: 57905 - DNA, 9273 bp, Oryza sativa
ctgtagctagtagttactgtagtatctcagagcgaagacgctcacttttactgtcccatttttttttaaagagtattcgggtctttttaatagataatttctgctcttgtttctatataaaccgagttatcatttttactgtttgcaaatatagttaatgcacctaatactttaaatatacagaccacccatggattagagaggatggagaagccccagacaagccacttgacattacagttatcagcagatgaagcagttcagggcaatgaacaagcttaagaaagttgcattgaaggtgtcttctgagtatttattttcgctgctaccaactagtattgcatcattagataattctgacccttttgtttataaaactaggttgttgcagagaacttgtcagatgaagagattacaggcttaaaagaaatgttcagatccttggatactgataacagtgggacaataactcttgaggagctaagatctggtttaccaaaacttggcaccaaaatttctgaatcagaaattagacagctgatggaggcggtatgtttttgctctgcaggcagacacttgagctttcaattgattttttttttagataatggaatattaatatcccagtcactgcacccatagatgcacaaaactataatcacttattacaagttttccacagaaagcgaaataaattaaacataaagcagcatcctgccgaagtgtttggcctttacttcggagcgcccgctcatggcttggtttcctatcgctcctatgtagtggtcggccttaaaagtatctttggactctggcaatcatgtgtgactgcggagcgcctattgcgtgcacgtgcgcgtgcacggcgagagagaatactagttatgctttgcccaaagggaccggaacagtctagtctctagctacctagcttcggctatttcaagtgcctgctgagcttcttccggatcaatgttagcagctgatcctacttagaatgaagccacattaagcttaatgtagactgagacagtaacaacatgctcatttgaaaggaatggttatatggaagaatttgagtatttggcagtagcatgtatacacaactgttctggtggttccagcacatgccatcatatcattatttccttgttttcccaaacaggctgatgttgatggaaatggaaccattgactatgctgagttcatatcagcgacaatgcacatgaacagattggagaaggaagaccacatacttaaagcatttgagtattttgataaggaccacagcgggtaacttcaaatcgattttttttgggtcttgttctatctgttgtttgttagttctcattaatttgctaattttaaatctctctgagcagatacataacagtagatgagttggaagaagctctgaagaagtatgatatgggggacgataaaacgattaaggaaatcatcgctgaagtagatactgatcatgtaagtatattccgtaacacatcttaaagcaagctctttgataacaaaatgtgcatgtcccaaccatcctacaaggagaatgccaaagatttccaatcctaaagtacctttcttaagtagaatttgagctcaaacacaggctgcgaggcccatttattacagtgctaatttttccattttttgttttcacaggatggaagaattaactaccaggagtttgtcgccatgatgaggaacaacaaccctgagattgctcccaaccggcggcgcatgttctaacttcctttacaattgttgaaagaatactgtttggacatctttcctcattatattccaagaacaccccttaagaggcttgatcatctgagatccatacacctgttgccagggcttggacccatttgtactcaaatggagttgcgcgatatatcatttgtagatgcctggaccatcatggatttctgagtgctgctttgttattcgttgcctcatcattcaatttggagtgtaacctcaacgggatgatcagttcaactgctcttccgagcgtgttgcgacttgtgactatatgccacttgatcgtttgtattagatcaggtgttgtaaaacagattttagtgataagatcaggcaaggttatattattctggagaaacagtttaatcttgcttctgaatttcccggccgtatgagaacgtgctattcgagctgaaaccgttcgatctgtccagcagtattgctctcgctgttcttgtcaggacaaaccttgcgcttgcgcgtttactggagtttcgctttgcaccatactctcacctcacactgcgcaaagaacaatttggtcatctacagtatttaactatttatctaagcacgcgtcataaagcaaccaatagatccctcatttccgagcatgcttcaaggaggcaaaaattcagtagtctgcttttcttttttggctttttttttcttctgtacaaacacatcatacaatctacatgaatgaaaatgatggttgacatactccttttacatccacttatactgaaaactgttattctatacccatatattaaacatttaagtcatcagaaagatgacattaacattaagatataaaaactttatccaaaagattcatctctagagcactaatatacaagacacagacatattgtagatgtaatctgaattccgtggttgtacttcgttgtgacagggctggacaaactggaggcttgaaattgatcaacgaacagaaacgtttttcatctttcccgacttgtgcttgacaaagaaagcagctagcatacttttggtacggaggggagccttttggatttgacgccctcttgggttgtcaaaagaactaaatgacgatagatgcctgacaccaggttgatcctgcaaatacagaacatgtgatttcacattagtgggaaatgataatttgaacctggaaaattaagaattcctagagaatgtaatgctcatttgcaagttttacagcataaaaatagtcaggtcttaaaccactcatcaagttgtttaccttcatgccaacattatgcatagcaaaatcagagctggccaagtttgtctgcagatgcttgggcaatggagatgttgatggttccttacctgaaacaaaagcaattccaaatgaggtgttagccacctgtacaaatattataaactatccagaagtctgcctaagatacactcagtgccaatcatgaaagtaaatcacactactggggtgtactaagcaataaaagcaattaaatagaatggtggaaaacctctcgatgcaggttttgtagcctttgtttcttctaggctgaaaaaaatagagacaacagaattacacaggaagaatcatagagtaagcgaccaacttcacaataggcaaaatagagctggcatgcttacacaaattcagattggcgtgctccattggttttggagtttttctctgaagccaaatgccagaaaagggtttttgctgaagagaaaaaaccattttagtgcaggtactttatatcaagatttaattgtgtgctgagtgccaagaaattgcacctgagggataaggtctaggccttgagtcaatatcagcatcagtttgcatctcagagaaagcctgcattcttttgttcgccaaagctgagctcatagagaaaaaatagcaagttaaattaggtgctaatagtttcttcagtagagaattacatctttttttacacgtccttactcggtacaatgtaatgtttgtgatgtcttgtggcggttccggtcatctgctgctgcctaatgccttctttatccgtgtaagtttggcaggtgaggacttgctagatattgagcaataagaatgtcagtttaactcctggtctgcatcaacacaaattcctgagttaaacagcagtacctggttcaagcatgctactttcagctcaagagtggaaacttctgaagcctgttgttcatacaggtctgtcagtttgtaggcaactgtgccaaggtggtcaaccgcattcaccaaagccctcacagcataatccttcaagttgtctagaaccctgacataaataagcatatgaaatcagatcagactcccaatgattgtcacattttcgtgtactcaaatcctagcagccagatgcagaaaatgaacacaaccatttgacagcaagtgatatgcagtgaggatatcagaacttagtacaaagtagactgaaataaacaacggatggattattgcaagtaaactcaacatttccagaccctatgctgcaccaagattaattatctaccagtgtctcggtaagggatcgttatgaatgcaggaatttcgcatgcaaaaaaaaaaattcagatttcgcaagaattatttaaggtccctgtgttccaactcgcaaatgtggcccaagtttctagttcacaagtaatttcctcatccatttctgctatttgtatatgctcagctaactctgaactgattcaccatttaaacctactacacaccaaccgcaacctttctagcaccaaacgagaaactatgtggatagagcaatcataaacaagttcatggtcccatagtagcatcaagcaaccaataatttgcccacacgcacaaattcttgccacaaattttgcctgctagagctgggattcgaatcgcagtagaaacgaaaacgaaaacaaaaaaaaaaactcacatctgcttctgctcgctgtggaggtacgacttctcgcagtactccgacgccgagtagagctgcggccgcaggttcttgagctcctgcgcgacatcagttcaaccaaaagaatcaagaactgcaattcatttcagagaaagaaaaaaaaaacgagcctcgcggcgccgcgggatctctcccggatccgggtccccggccggccggcaggcctacctggagcgccttgacgaagctcttgctccgctccatggacgcctcgtcgacggtggtgggagcgggacctcccccgccgccctcctccccgaccccggcgaccgcgaggccgccaagccccgccgcccacgcctgctgctgctgcatatcccctcgccttcctcctcccgagtcgctcgctgcagttcttgttcggtaggaagccggctacttagcggcgggggcaaggcacgtgaggaggaagcaaggaagcgatgctcctcctcctctcctctccctgccggcgcgcggcagcagcagcaggcaggcaggcaggagaagcgtatcggtgggggtggtggccgcgtgcgcgagtgggagcggaggcaggtgggggcgcgcgcggatggcgacggcggccgcggcgtggtggtggtggttactggtcactttaagccgctcgtagtaggagtaggagtcaatgcttcgcttcgcttcgcttggcggatggcggtagcgagattagggaatcgattgcctccttttccgcctgtcgatggatggatcgatcgaccagctagcttgcgtggttcggttctctgccggtggatggatcttgattcttgcggccactagaaaaaggcgcgtgtttgtctctcctcgtcatctcgacgacgacgacgacttggagtgaggagcgcatgatttcgctatggccacccaggctatgagagcaagtttcacggtagaagtgatggtcatatggcctggcctgtttggtagagctccaaatcctaaatttagttacaggagttgggtctagagtagagttgtggagctacctaaatccagccccacctctctagtttattttgtgagagagctgaaactgtttggctagttatagctctaggagaagtagagctggagctggagctagagctgtgctaaacatgcttctaattttataaaaaaaatatgactattagggaaagacctaatatcaaataaatagagctaaccagaaaaccctataggcgtttctcctaattttacacacaccatcttcttattaattaggagatagtttatacgaaataaggaattttatggtccttcagaaatctcttttaaatatgtgattcgaattttgggcctacaatatattcggattagtttcctaatagaagttgactattaggattagtttcctagtatgactctaagtctttccccactaggactcctagatttctcctatatatagggcctgtttggttgggtatttcaacttaccacacctcaagttagcacatgccaaaagtgtggcgaacgaaatccttgccatagctttggctcaaaaatgtgtggcaaagcagctagaagctgcctaactttctttggcaggctaaactatggaagcaaaacaaacaagggctaagcggttgtggctgactaacatgaggtgcggcattctgtggcatggatccaaacagccccatactcttgtaagccgcacggggagggtgcgacagtccaatgtaccccatgcgtttgtatccaactcctctgtagtgatcattgccggtcggcgcccgtggttttttcctgcaaaggttttccacataaaattcgtgtctccgttgtgtatctattttattaacaacctcgaggtaactaaattttactctaaatttttttggtactttaaggtactcagtgcctagaggcaccaaatattacactagaaaatatggtacctctaggtacattattaaggatgataaaattacccatacaacatattgcctctaatgcacttgtcccaatatactactcataccttattttttttaattcaatccattgatttttttcccttatctatctaggagtttgtatagagactaccctttacataaggggtggcaactcctctctttctttctttttttctcttttctatctcattatgtaattttagagcctcatcggtatgcctaataagccaaagcaaaagggcaaaatatgaactttcaaacttgattttgaagcattttcaatgtaatttctttttagtattggtttttaagccgttacgaacaagtgtataaaaatttacctataaattaattttattccctaataagtctaaacgatttattaagtaatattggcaacccatgaggctcttacatggtactcccttcgtttcatattataaaactttctagcattgcccatatttatatatatgttgtctagattcatatatgtgattcattagtgtgtgtgtgtgtatatatatatatatatatatatatatatatatatatatatatatatatatatatatatatatatatatatatatatatatatatatatatatatatatatatgaacggataatgttagaaagtcttctaatataaaacggaggaagtactatatcaaacaagaggtatgaggtccatagtacttgttctgaggagggaggagcaatgtgtcctgggcgtttgggccacttggctgtagcagtgcagtggtagtactagttcttgggttggagtaaactacaagctgcagggtacaagcacggcgagggagagctgtcaaggggctgctggagattagtccatgacagtacttatacctcgtaacagaggttttaactatgttagcacagtgagtgtaaaagagtacggggcctcctttcaaacgttgatttaaaaatgtatgtgatctggtaccaaacctcttaatgttaattcgtattttgaggaaaaatataaactctaaaacaatggcttttctaggtagtgctggtcgtggctactgcatattacaagaagaaaaagagtattgttcaccattttatttctgaaatgaactggtttagagcagcagctaccacagcgaaaagaaacctaaaagaaacaactgaaataacataaacaacattttgttcaatttctacgcatttcaatgtttatatacactgaacaacacaacagatgactagagcaacgaacagttaaatgaaagactagattgtcccatccttggtttcatcttttctcccttttagctatgatgcccttctagctcccatttcatctcttttccaccatcagcctagcctcttgatgtcatgtaactatgatgcggcgcacctaaccacgttcaagaaatagcgtagatgggtatgcacgagatcatggtgtttgctcgtacaatctttatttgctttggtatttgccttaacttgcatgattagttaagatttctataaaaatcctccattttaaaggacactcggctctatatattgtgtattctacgtactaatagaaaagtcaggtatttggtaaaaagcccaggcaacaaacaactagcactacaacccatgttttcacggcagttaatttccgacgatgaaacatggttagagcccggtcagccgttcatctagcctaagaaacggatccaccagtgagcgcatgttgcattattgaattggagtcctaccaaaaagtccaacgggacagtcggacacatatattcaactaattcaaagtccatgacttaccgcttaaaaaaaaattaagaaagcacatgggttcagagcaaagaaattttagcctggacagtgagatgatgccggaccctatgtacctgcagaaatagccaataggaaacaggttttaatttagatcggttgctgaaaaagcaaggaggggagtcctgtcccatgtttgttgcaagtacaaagtttccatggggcaaacccggtggttgccaggtagagtagttcatgaatgctcttggttttggctgcttgatggattgactagatgcatttaggtgcacctaatcccgcaatgacatttaagaactcatcaagtgcagctttcattgtcaaaacaaaaggggcatacactattagtatccgttactgttcatgataaatacatttcaattcatggagtaaaacagacacgtccaaaccctatagaagttgttccaaaccctatacaaaatctgggttgtgtttagttcctgaaaaaagttgaaagtttgagaaaaaattgaaagtttgaaaaaaagttagaagtttatgtgtgtaggaaagttttggatttgatggaaagttggaagttcggggtagttaggggtgaactaaacacggccacacggccctgatgatgtggaattccctagctcaaacgcatattagatctaagtggattttgaatggacaaaagtagttacacaaaacgccacaacttagttgagaaaacgaacaatatgccactctataagatgggtgggataaaatgccactcaatacaatgcaccggataaaatgccactcaat

SEQ ID NO: 57906 - DNA, 4440 bp, Oryza sativa
ttacagggataagtccattttacacccccaaactcttatgtttgcctaaaatataccccgaactacaaaatcaggtataatatacccctaactatcaataccaatcattttacgccctcgagcaattttaagactggttttgattcatttgaacgccacatcagcatagtcccaccagtcaaaccatctcaccggtcacgtgtggagaggggcaaggaagaggggctgtgatgaggaaaatgaggaatagaaggttggaggcagccaatgagctccctccctccactccccgctagcccatccatgacaaggcacatgcaacggaggggggaaaagctacgtcaagcggcagcgcggtatctgacaaggcatcatcgcctggtcaaggacaaggtccagctcaagctccgcatccgcttcttccttgtttagctcgaactcctcatctcaaagcctagtcgccttcgctgaactcggcatccccaagtagctcgagctcgtgtttgtgctccagctcaaggaagtgaggcaggatgttggatctttagcttgtgctcgccaacgctcggcccagaatggggcagtgacaagggggcggcgacgggggagggtgatctagagctcaccggctctcagaagggtagttgggagggagagatcaagctcaccagcgctcaggggtgcggcaacaaagggggagtagagagaaggggaaaaaagcgctcatcgtcagccgctcttgaagcctcactagccgcactgtgtggggtaagagagacggaggagagggagaaaggaggaagaagatgaagtgggtgagccctctattgtttagatgatgtggatttattgaacagttggcatcctatgagatatccacgtgtagcaaaactatagtaaaacaactcgagggggtaaaatattcagtattgatagttaggtgatgcattatacctaactagcatggtggcccgcgcagattacgcggctagcatcattatattttctctcatataatagcatatatgttttcttaatgtattattcaaatatattaaaatgacaacataattttaaattttgtactaactttacgaaactactaatgtgtaatattcatattgtattttatatgcgtgttagttattaattatttttaatatcaaattttagttatttgtaaattatattcctatatggactctagactcgtctttcaatatttttttaattccgaatcttcgttatctgtaaattgtatttctatatatagattctagtatcttcttccaatattatttatttttaattcttattttttttattatttctaattatatttctatgtggactctaaactcatctttcaatattttttaatttttaatttcaaatttcagctacttctaaattgtatttctatattgactttagactcttcttcccatgttttgtttaaattccgaattttagttatttgtaaattatatttttgtacgaactctaaactctacttttaattttattatgtttattccgaattttaattagttttaaattcctatatggactctatactctacttctaatattccttatttttaattccgaatttatattatttcttaattgtatttttatatggactctatactctacttctaatattccttatttttcaattccgaatttcagttatttataaattgtatttctatatgactctagtctcctcttccaatattccttatttttaattccgaatttcagctgtttctaaattgtatttctatatggactctagtctcctcttcctatatttcttattttttaattccgaatttcaactctttctaaattgtatttctatatggactctagtctcctcttccaatatttcttatttcttaattctgaatttcaactatttctaaattgtacttctatatcaactctgtttttctttttcttcgattaatatgggaattttaggccgtgagagcgaacgtggaggctcatttttctatttctttaataagttaatagattttgtagctaggaggtgtatttagataaacaaaaagcttagggatgtaaaatgaacttattccttttttacctggttcatttgggcaatgaaccaaacatgcccataataaccgtagtcataatttaaccatgatggcttgccatgtacgaataatattgagcatgaagatacacatgtatggtcagtgtgagcacatcgtcattgaatgtgcccaagcaaggcctacacatggcatatgctatgctccacatgcttgcgctctcgtacacctacgcgtgcccacttaacccagtgtgtcagttttttttttaaaaaaaatacccagtgggtccaaggctccaagcctaatgaaaattaaaacgtttcaaaaaaaaataaataagagtaaatttcacgaaactacaggtattttggtcaaattatcagaaaactacagatttaacatgatgtattacaaaactacagatttaacactaattttatcacggaactacagatttaagataaaatatctcaaaactataaattttagtaacaaagatatcacaaaactatatgtttaatatcaattaatcataaaacttgaacattttcaactcaaacataatattagtgcaacgaatttaacccccaaaatatgtagttttgtgataattttattattaaatatgtagttttgtgataattagtcttaaacatgtagttttgtgataaatttgttgctaaatttgtagttttgtgataatttggtcaaagtatatgtagttttgtgaaatttactcaataaataattttcaccggttttctagaagaaattagcaaaagtatattattaccgctgaagagaggggagggggcgagttttatatcaggacttagcgcgatgagtgctcggctttgcacgaaggaaatcggacggatgcgaactcacagcactacagaacgaacttgcacgattaaataattaattaccatcataagcaattactccctccgttctaaaatataagcatttctagcaatgagtctggacatatatatgtctagatttatagatagaagttgttatatttgagaacggaggtagtaatcaattagccattattttttcatcacgtcgtaagcatttaattaatagctaatttatcctaagacgatttcgggccttgtggctgacgtggcgtctacatagcaggtttgacttggttctcgtcctaatataaaaattaaaaagtcagtcagtcggtgacaatggagctcgaggatggccgggaggaagagggaagaaggaggcgctgacgtgctatcgatcatggagatagagatgagggtgggacccactgacatgtgggtccaacttttttttttatcttttgtcttacatactatttaatctttataatttgcttccggtgccatttcaccgtcacgtaagacaagaactaagtcaaattagtcatgtaagtgccacgttagccgaaaccgtcatccaaaccacattggaatcttatttgcactggttttgactgttgatgtatatggtaatttggttcaggaacgaaaatcgaactcgctgtcaagttaaggaccaaaaatgaacttactccaatccacatcgttataccgcggatgggccaccatgggcctaatataaacgggtcagacattaactgcaaaagacaggcgacagaagcaaaccagaacgacaggacagatcgaacgttccctttatttcctgacgaaacaacaaacaacacctcaatcagcaagaacactgtacaattcctcctgatcaaaatttccctacgccctaatttacaccatggaccttggtcaggtccatgcgtgcagcccacgctggcaggcacgcttcaaccaacacaaggcagaacgttacaacctcgcaaggtgcagcgacacgagaacgccgacgaaaacgtgccaactcccgacacaaacgcccgcgccgacgccgacgctgggagcagcagccgccgccgccggctagccgccggtgttcctcaggcggcctcccaggtgctgcgtcgtgcggctcctgacgctgtcgcagtcggctgacgccggccagcgcgacgacgccctcaaggccctgctgcttggcgtcgtagcagagcccctcgttgccgccgacgcggagcttcttgcctagccgccacatcatctgcttcccgaacgggatcggccccaccagccggttgccgtccacgcggagctcgctcgcccgctccagccgccggaagctcgccgggatcaccccggtgaactcgttgttgtccagccgcagcacccggaggtggcccagctccccgatcgactccggcaacgacccttccagccccatgccggagaggaccagcgtcgtcagcgcc

SEQ ID NO: 57907 - DNA, 3490 bp, Oryza sativa
  unsure (1)..(3490): unsure at all n locations
cgccctgcagcgcgttgtggctgaggtccaggatgcttaggtgctggaacttgaagggtggcacctcgccggcgagctggttgtagctcaggtcgagaagctgaaggtgcgcgagggactgnacggtggctgggatggcgaatgtgaggttgttgccatgaaggtcgagcacccgcagcgccgtcaggttcccgagctccggcgggatcgccccgacgtggccgttctcccggagcaccagcgaacggaacgccgggccgaggcggccgaggaacgccgggacgggctgcgggttggccgtgaagcatcggtagaagaagagcgacctgaggtgcggcagcgcgagcacggccggcgacagcgtggcccgcgccgcgtcgcacgccgggaaggcggtgtcgtcggagagcgcgccgaaggagagcgacacgacgtggtacacctccccgcggtcgggcacgcactcgatgccgtgccaccgcccgcggcacacgtcggcgatgcccgacgcccacccgttccccgtcgccgccatcacctcctgcaccgcgcgctgctccgccggatcggtgcgcgcccggtccgacagccccgtctgcggcgcgttcaccagcgccgccgacgacgacgagtccggcaccaccaccgtgaactcccccctgcacaccgcaaccagcaccgccacgacggccaccaccaccgtcgccgccgccgtcgcggagagcgcagaggccaccatatcaccttgcacgctcgtgcgacgcgatgcgctcggaagggtcacgaccgttgggaatttggagggaagagggtggcagaaggcgcaggttttatagtgtcagaggcgcgcgcgccgaggccgccgactcgcggaggccgcagtgttcgtggcgggtgaatgcggcgagagacgagtaaatggtggtcacgggatatgggggagaaatggagtaaatgaactgaggatttgcctgcattcaattggtttcacgggaaatcggaactgaacaatattgcgcgacatcctggtggcatggagcagtgagagcatgcctctgctagcaattttgatctggtaattgtattgtttcgctacaggcgacctgcggttcagcggttcagtggcagtgtaaacagttgctgtttgttcgatcaagacgttcgtgcgttcgcgaaaagatcaagacgttcgtaatctggagcctgaagttagcgttgtggatgaaaaatcacaagtaggcagtagttgagatgcagaggaaaggttaatgctgttcttgcagactgcagagtactaccatccctggctcactggtctacctgactgcatttcgttttactcccagctcgcattttcatgagaaaattgcaatattcggactacaaacatgggggcttcgctgttttgagactccgagtggatgataaatgggcccatctatgtctatgaaatgtgggtccagtgtcattatagcaaaggctaatgtttgcagtgtcataaccctattgatgaactgaaatgcagatggttatttcaagattactattacagcaagactgagaaataaatgatcaaatatttgatctttcaagccatactgacgaagacatgggcaaaaagaaaaaaaaaacctctgataagttattcttcctcgttgtcctatccaaatgtagaaattcactagttccttcctcttcacaggtcatcctgacgtttcagtctttcaggtttgcttgctgcactttctcagaccccaggtcttcagaattcagcaacgaggaaaacaaacgaaaatcaacgaagagaaatgagaagcaagaaagccaggtagcccaataagaggcccaaaggcctccagatcatatagctggctcaatgggctcagctatggatcaagaaacaatagttctccgttaccttacagctatatccatcctgaatccttgatttctgaacatacaatgatacaattaatatcttgtcccctacactgtattcagtacttcaagacgacactatgtgttcagtatctttcaagaggactattttcgttgcaaattttctcgaagcaattttgttttgtccccgtttttttcgattccacctggtaatctggtgtgccgcaaatgtgtagcctctgactggatacgcacctaactttgtgaaggggctctgaacctgagctaatcactaatggaccgatttgcgcgatctcatgcttcatgccttagccatgctgcccagtgcccatacagaattgtgactgtcacccacagggactgccagactagacaaagaaaactcatcctttggttgattactatcccgctggacaacactacctgaaagtacagaacaatcagcattaggtaaactttggagtgcagattaatcagccttgacagtacagtcgcacgtgatgacatcaattcttttatccttatttaaaggcctccttgcccagtcagacagctcgccgaaaatatgccaggagaaatgcacacatccaagggtccaaccgatgccaaacgtacactgcagagaaatgcagtcaaattaaggctgcgtgttctagaattgggaaaacgttcagggaattcatcattcagtcattcagtacggaggataaccatgcatgcagaaagtgtttttataaagcttgtttagcgtgttgcgacacacaacacattctccatctgaagccggcgactttgtcagttactacagatcagaccatcatcagcatctgctagatttccacaagaatttggtcgttcactgttcagagagatcggttgctgcagtgcatgtcaacagcatgtagtagtgcactactcgggaacgcactcaatgcgtgctaaatgcttcgtgctatccggctgtgctcagtccactttctgatttctgaaccaggaaacatcgtctttttttgtatgtatgaatcgattcaactaaaagaggtcgcaaacttgaggtccaagttatttactccctctgtttcaggttacaaaacgttttaactttgattaaagtcaaattacttcaagtttgactaagtttgtagaaaaaataatatcattttcaacccaagacaaatttattatgaaaatatattcaattattgatttaatgaaactaatttgatattaaaatattactatatttgtctataaacgtagtcaaacttaaaatagtttaactttgaccaaagtcaaaacatcttataacctgaaacgaagggagtagttgccaacttcttgtccccgcgtcgctctcgcgcgggcagctcgggggcgaaaccctagcctcccacgccgccacctcccaccaatcctcgacaccttgccacccctggagctcgccgctagaaaaccgggcggcaagccaggaaggcggcgacgtggacaaggcggcccacgaaactcgtcctcggcgcgggaggacggagcgtccccacgaccgctagagatggcaagggagcgacggatc

SEQ ID NO: 57908 - DNA, 3924 bp, Oryza sativa
ctgacgacggtcattgactgggtttgggtgctaaagggttggtgtggtggtccgacgatggtcgttgtacacgatggttgtgtggacctttgaataggaatcaccggtgaaagccttgccaggccatgggccggcatgacgacgacgccattaggtgtcgttccccttcttggaggcgtcgttttggcgttgacatctcctagcatcaagaacctttcgcgcacaatggtagccatcgatggactcctgcaatgtctccaaagccctacaagtctagctgtttgacgaggccttcgctgccttgcttccgttccttgctctaccgtgggtgttcagcattcttatttggttgctgctgggtagagtcagagctacttcattgtaagggtgcgacaaagcttggcaacgatgacacagtactgcaatctctttataggattgttgatgctagttgcgtgcaggaaatggttctttggtagtttggactgatgtccttcatgagtatcgtttctgtttgctctttttggcgttggagtagcattgcagtgaagtcgaagctgttgtgtcgcttgggtggcaagcttggcaacgataacatatgtgggctattgtgtcgtctctatgacaaacttggcagatgccttgtgtcggttccgtcgtggtagcttaggttagattagctgttggtgaggcgttgtaattatggtttgctcatttttcccaaattaactgggcactgtaaggtttggtctcgtttactccttaaaataggacaccttattcttaatataaatcgtcggtaatggcctgtccgttaaaaagaagaagcttgaggtccaaaattgagatgcacttgatagtgtagtggcaaaagatgtgtggtttcaaccctaaggtctcgtgttcaatatctaaattgctcacaattgttttataaaaaatgttcggagggatgtctctccctaggtctaagattgatattataaggtcgtaggaaaaaatgatcaaaattaattctcttattaataatataattcacatagctcacacatccgtagatttacaaactgcccgttcgacctctatatcctcatcatcacgaacttgctccaaggatattatactatatgtgatcgtattatattatattactaactactcgtaatgtccaaccatattaaggcgatgatctttgtcccaagacatcataatttaaagaatttatgtacagctaacgacgagatagctatacttggggtcgatttagggctccgccttgactctggtcaccgacggatcggtcacggtggtggccttggacgacaccgacgagtcggagtcggagctgggcggcttggagatggagagcacatactccttcatgtcggagctggatgagcggaagtgcgcgaggatcttgctgaacttgggcttcttgcgggtgatggcgatggagacgtcgttggggaagaggtccttgagcacgaaggcgtggaacatggtggtgaccagcaggccggcgacggtgacggtggcgatgccggagaggccgatggagagcgccctcgtcagcacgttggtcacctccgtcgcgtacgtgatcgtcgcgatcgccgcgccggtcatcgggaacgtgtacgcccaccacgccagcgagaatcggaatcccctgaagaagttgatcctcacagcctggtcacaggattaagacattgttaagtacgcatgcagagcttagtaatactaattaattacgtactgtagtagctagtgtgctcgttgcacgtaagtgttacgtaccagtgacatgtagaggaagagggcgatgaagtaggcgatgcgggcgccgtagtcgaactcgccgaggatcttggcccaggccatggaggcgacgctgggggcggcgacgaagaggaagaagacggggtggagctccttggggagggtgacattggtggggaggcgctggtagagcgtgacgaagaggaccatgtagtgggcgaggccgacggcgaagtaaaagatggggccctcgcggagccccatcttggcgccgagcagcgcgccgacgaagtttccgacgatggagaggtggttggacgggttcgccaccttggacagccgccgctggccgccggacatccactgcccgtagatcttgagctccaggcagaagatgggcgccatgagcgcgtaccagacgccgtggtgcacctccgtcaccggccgcggcacgccctggacgaggaagaggcaggcgatccacggcgcgaagaagaagttggcgcggatcgggtggtagaactcccgccgcaccgcctcgaagtagaaaacgaccttgagcaggtagatgaaggagacgaaccccatcagcgccagcgagatccaccacagcacgtggttcaccaccgggctgacgtgcaggaacgacgtcggcggcgccgacgccagcgtcttccacagcatcgcctggctgctcaccccgaggcacatcccgaacgcgctgatcgggaaccgcagcaggaacggccacttctcgtccttgggcagcaccgtcgtctccgtcgccctcagcgtctccagctcggggccctccagggcgtcgaagtagcggtcggcgccggggacctgctccgtctcctcctcggcgatgttcggctcgggggcgccctcgccgttggtcatgtgctcctgcgccggccggccgcgcagggtggagagctgccgctcgaggcggccggagaaggtcttgaactggtcgaaccgcttgtcgcgcgtgctgtcgcaccgccgcgtcgtctcgtcgttcttggacaggtgcaggatgggctgcgagtggaaccgcgtctgattcagcagcagccgcggggagtgcgcctgcactcgccccaccgccggcgggtgcgcgtcgtcgaacctggtctccgccggcgccacgcgggcctcgtcgcggtggacggccttcgccttcgccgccgccatcccgaactgcgagaagtggaaccccgatggcgacgccggcatgctcagcgacacggagtacggtatctgcgcgccctcgtgttcgtacgccgccgacaccgacacggatcgtggagcgtacaccggcgccgggatgctaatcacgacgtccttctcctcgcccagcatttcgagttccttgctctgctcgctgagcgtggccgtggccgtggcgtcgccaccgccgccgacgcagtcgaagccgtcgatgacctgcgaggggacctcgatcagcagccgcgggagagcggcttccccggacgattgctcgctctccccgtacacaccaccgtccattctgatccggacgtcgttgccgaactccataccgttcacgaaacctgcacaccatacaacgacagattgactcgtttagcgatcaatctcccaagtaaagcaacaaaaaaaaaagcaaagttttaataatttctcaagaacgtaatcatcaagtaccgcagtaccagatcacacgccaattcggccgaagcacgggtgggcattcccgtatggcgatcctggccatatcaacctatcctacctacagttaatcttacctggatttctctctacttctctacacgcgttcagcatgcaccatcaaaacagttcacagctcgctaaacgcaaacaacaagtttttctcccgtacgcttccggagtttcgggctcgattttggctcagctcggcacggcgcgaccggtgctcgatttatagagacgcgcgcgagtaaggggaagcacgaggccggaatgcacgttggctacgatattctcctttcccgcatgcgcgccggggtgtgctactgtgggtgcatgccagtggagcggcagagcacgccgccgcccggatgacggcgacgggacggtgacggccgcctttcgtctccactgttcgtgaaggtt

SEQ ID NO: 57909 - DNA, 10174 bp, Oryza sativa
tgcttggtttgacattatgacatatcgctaattccaaaaggtttttcgttacagatatgagcccggagaccaagatgagaatgtgtggtcctagacggactcgtgtggaaaccgaacatgtacgaccggctataggcggaccggccagtacgtcctacacgattgtgacacacggacacatcaatctcagagatcgatcacgctgagaatatgtagatcaccagtacgacttttttgcggtcgatctccctgactccctgagccgccagattaccggaaaactagctgctgttactatgtgacgcaataaactagccatggaagaaaacaacatgcgaattaacgtcgcagtctaagctacggggcagcattggaccgaccgaaagtgttgaaccgggaccctcccccagatgtgaccgagagtcccccggacaccaccaaacatcttgcctggatgctgggggtaggttggcaagctatccatcgcgtacacgtcgttcttgcacagccatatctgagctagacatgcccatgcaacaacgaacagagaactgactctacaggacatgaggacatggacacccgtgctagaattagagcagcttctaaaaccaaattagacctctcaaagctagcgcaggcaaagataaacttcatcttctctaccgacagggatgacaccgaaacacgggaaaacgccgctgcagagttcctaaaatcatactatactacatactcctctgcatactttaccttgggcctaagaatctgttcgtcagtgcgacactccacggcaggatctcttacgatgtatgaagctggaactggaagaggatgaacacagatgaaagagctcgcaaaggaagcagagcctctagcccagcactcagcagaggaagctgcttgctatgtgctgctgaggaaggtgatagccgcaaccgcagctcaccgagtatatatagaagtagtcaagcagggcacccagggtgtcctcaccattcttaataaaagacggaaaaaaaagaatgggagaaaaaaaaatgagtgacctacagaatgaaaagagagaaaagaataagagggcgcagagacagcgtggaaatacaaaaggtggcgagtcaaagcgcgagcgagagcgcacgcacggacgaacaacaacccgcgtactcctcgggggggggggcccacgcacagtcgggcacagtctccctccccgtgcccccgccttgaccaatcgcgagcgaccgttcgcaccgcgcgacgaaaccaccaccacgtgctccctacgctttcctacgattcctccgccgccgtagcagcgtccccgtctcccgtgcatccgcgagcgcgcgagagaatgagagagatcgcggcgtagcctctgattgcccgtgtaccgggcaccggccaagggggtactagaggcgaccgcgagccggttcgtttccgagatgtcactggggcgttgcgtcgaggaggaggggagagagagagagagagagagagagagaaaggaaaataaaaactgagggccgaggcgcgcgcgcgtccacgacggccgaggcaaacgtaactgtactcatcgtaccctctcccgagaattttgggaggagaatgcactggtgtcccatcgccgcccccgaagaaaaatgggtgagactgctacagtaacaggggcagtggaaagtagaaactgaagctctaagcgatgatgttttcagttggatcgttggaaaaatatgtagtgcaaaccacatatacagtgaacttccaaggtgacgtggatgaattttggacatcaatttctcgatccaacgatagtttccaagttttcactgtatatatggtttgcactgtatattttctctcgatcgtttacatcgtcctaggttcccacgacagctttcctcgcatctcgctgcttctgactcttctattatcagggattcaggggtgttcggagcaagttatctttttgttaaaagaaataatcaaactttgaaagaaaatatcactttcgattatgatcgatacgcagctgaaccagccggagccgtagtgttttgggttattactttaggggtgattgctttttggactgatctggaatattgtacatggttgatagttatttcgtcttaatttgaaaaaaaatagcaaaacttttcagtcgaggaaatttgtgcctgggaacaagggttcacgttggctccagaaaaataagaataatgttttcttcgtgcctgcggcaaacgacggtccacgtacatcattttagccggacaggctgcgtggtttcattagtctttggctacatggtcccttatgtcatttcaagcttgaaaataagtgaaagtacgattagtgcgtctgttgtgaactcattctgccattatgtcaaaattgtgattaattgtccattcaaggacagttcggaaaacgtgggacaaatctattctgatagcatatagttgttgtactctgtcctacacaatttttttaaaaaatcttgttaattaagtcctgataggagcttttttacttggtcttaaggtggagtacattttctacctgttttttttccggaggggagggggtgtatttaaaagtgttggtattttcaagaacagatttggggtaaactcgatattatctgcatatactgtagcagtttttttttcctcggtttgtcctgaatgagctttcactcagacccgaccttaatagtctatagttgtgtgttccatgatgcagtggacaggtctgtaatcttcctccactaaatacttgtggaaatagagaaaaaaaatgttgcaagctctagaaggaaatcaacagtctaacaaggaattccaaatccatcatgaaccaatcctttcaatctgtaccttgttcctaaatgaccctccaaacattcacgtcgcagtttttgtgtgaccaatatttaaatatgctgaaggaattccagcatgcattctttgaaaaacaagtggcacacatgaactccaatgcataggacctggagtactactaagttaattagaaaaatatacatgccgatttattttctttacggtactaactgcaaatgcataaaaatcagcgaagagtatgtataccctggagtactaattaagttagaaaaatatacataccaatgtctctcctttatggtactactgcaaatacataaaaatcagcgaggagtatataccgtccaaaacttagtacaaaatttatatacaacatcaaaaagagatggtttagtgtagtaagctagtatactagctactccctccgtttcataatgtaagtcattctagcatttatcacatttatattgatgttaatgaatctagatatatatatctatatagattcattaacaataatatgaaatgtggaaaatactaaaatgacttacattgtgaaacggaggaagtagtatggatctactatggagtatatgtcatacgttaccgtcatagacgtcgaccaacacaagaaggggacttattaattattatagcttgtatacttgctaaactcatatgaactgattaagcaacttaaaatctgctggcacttgtcaggcccatatatattttttaatgctggaacataaacagatctggatcaatttaaatatgaaagaaggacccttgagtcgatccatctttgaattcagcggatataaaaatacgtagctctccgaccaaccatacgcaaacaaactatttgaccacaacgtgaagctactatctctaattaatttattctatgtatttcggtaagactagtagtactatacgtagagacaaggtgaatgctactactacagtatcagagtcagactccgaagtctccaaggagcttacaatataattacttaagtattttattagtcgaaaattgaaaatgtgcgttctcattaaatattgttgccgaggttattttaggcggcaaaagccagcatgggaccaattaggcttctaatttagaagttacttagtagtttgctagtgctttggctttttagttacaaataagtatatggagtattttatttacgctgattccggatatccaaaacattttcagccaatcaagtgcttaaaagagaaaaatcatgtaattttaaatttagcctatagttctcttttaactttgaattttactaaataacctagaaatactatatttatctttaagaacggagggctagcttttttctttttccttagctgacaatgggagcaaggtcagcagctgaatagatccaaccaagcaaatatatactccggatcgacctagctacatcatctgaaacatgactagtagcaacaaaaaaatcacctacccgtacactatataaacatcagtggtagccgtagcttctatactagctaagctagcgtacgcagctagttgtggacagctatgacacgggattaacttaagagcaattgccgtacgatacacttaactaggctccagagcctggaagtaaacccagcacgatcgagcaaacagacaacaagccgaccaaatccttttgtgaaaacggactaataaatcgagaactcggcaagcgacaagcgggggccgtcctcatctagccatgcatgtatggtacaatacataccacagataaattagaggttcacgtccatgtcttatcgcgtaagcaaacggcagataaattagctagctatagctagcttagcggcagaggagttagaaaaactggggaatgaatgaagtcagtaagtaatatacttcggcgtatatccgtacgtacctggctagtcgccgcccggccgctagcctccaagcgtagccgccgctgctctgcggttaacgttgacgacggcgcggtgccctgcccgcgcgccagatgcgcgaaaacgacgcgacctcgacgacaaatcagcgacgggctgccccgctagtggtagctggctgcgtgtgcagttcttggctgctgctgctgctgctagctgctgccggcgccgccgcgagatcgctagagagatgccggattatggatgggattatttcgcggtgaatgcggaaagatttaagcgaagcaaaaggcagctagctagtccgagctaggcagtggtcgtagtgcttctcgcactctgggagctcgagacaggccgccgtttttatagggtagcttggaaaaaaaaggtgaactaattaaagtagttaattaacttaaaacgacgaggagaaattgaattaccacaactggtctcgacgtgtatggtggtgtgtatctgatgtgtgtttgggatggagggatggtttaattaggtcgtgcacgatggcagccatatgcttgccgatccttcgatctactcctacctcacgcacaaaaggaggatggggggccctctgctacgggagatatgcgtcagccagtcggcaaagatagtggccaccatcttcgtcagcggccattggtcagtgactttgtgatctgagctagtgccatgtaggaacggtcaggatctagccccggcccctatactaccacgcctgtagcctgtgctcgcgacgaggcttctactcgggcaggtgaattccgatcggcgatcgctcttcgatcggttggacacggacatagggccaaggaaaggttatcatcatcagtgattctttttgatgaagaggaatcatcggtgatcctgacatgatcaccgccaagtagtactcaagtgcgtcgtggagcgatgtgtaaaaggtggtgttcgtactgcgtgctgtactgcagagtgtgcaccgcaactgttgcaagtggggaggctagctacgatcgattgatttcgatcatgggcatgggtccggctcatgggttttcccggaggagaggaggctagcttgcaattagcatgcgccagaaccggtccaaaaggcgccactctgcagcctagctttggctttgtatgttgcatggtggtcaatataatgctgaaaatttgcctgggaaacacccgttttcagcccaagttggatcccatccgacccggcatggttagccctagcttgggagctagggatgaagattaagtgcgcacgtgaaacgagacaagttattagcatataattaataaagttttaattattaaaaaaaaataaaaatggatttatttgttttttatagcaacttctatatagaaaattttcacataaaatacaccgtttagtagtttgaaaaacgtgctaacgaaaaccgaggaaaaatcaggatgttgttgaagtttagaacaggaatatcgaaccatatgtgctagtgcggcgtacgtaacagccacggggagtacgtacttcagcgcatataacacgtcagaatggaaccaaattccaaggaacagattggacacatgtggtcgttaaaaaacagtacgactgtgcatttgatatgatcctgtgaaaattcaccgaaatgttttctccttttccttattctccccggccgaccgatgcatatggtgtgtgtgaaaatgcatgagaaaatgtatatctgcttttctttttttttcttgagatgagaaatcgtgtctgctttccgatggtaattaaccacactagctagctagtgcaccggcacctttccaacataccggcgcggccagcacggcggaagaggcggccggccgtcgcagttggaccgagacggccggaaagcacacgacattgtaaaagccacattgccattgatcgcatgccgcgcccgacgcgcctgactcaagacccgaccgaaagagagtcaccgaaaaccacttcgtgcgattcatcagtcgatctgtcgatcgggtcacaaggcggctcgctcacggaacggcgccagggacgccgtgtcgatcgcccacctgaccgggcgtccgcctgatggcccccgaacccggcagtggtcaggcgctgcagacctggccaaaagttggaaggccgcgcctggtgcgcgttgcacaaagatggcacgtacgtacagctagctggggagtagggttgatggattttttggcgtggaaaattgaccacatcgaaatatttgataagtttgtgttgcattagtatggttcaatggttgaaagctttttcggttgccttttatctgtttcatattacaagtcgttttaatttttttctaattaaacttttttaagtttgactaaattcataaaaatatttagtagcatttgaaacaccaaattagtacccttgaatgtaacattgattttttttattatatgtatattttgtgttggatatactactatgtttttttataaacttagtcaaagataaaaaaaattaactattaaaaaaatcaaaccgacttataatataaatcggagtgagtaactttttctctatttctcgttgaataaataatttatattttttatttatagaattaagagactataattgatttcaccagtatcagaataagtaaaacaatgactttatatgtttatatgcgagattgtttactagcagtctttagatgtgaagaacatacagcatgcatgttttttttttcgtgtgtgtgttagatgcagccatgcaggagtctccataaaatcaatgagttttctccttattttctatgttggcaatgtgaaagagctttcattacgtagtagacaaattccttagtttttactggttcagggttcacaaagtcattacttggatccaaaaccactacttagtggtttcatcagaattcatgaaaaccggtgaaaattcagatattcttctttaaaaaaattgaactttactttagtttgattttttttagttgaccggcttatatagcgcgcggtttataccatgatcttgtgaactctgctagtgtctcgctcccattctgctagctacgatacgaccggggcccggccagaacaggtaaagcaatcgatctgacccaacaacgccaacaagaagtgggcgacccaattaacctggccactggccagacataccgaaacagacccaggatcaaagcagcctagacgcttacttaatccctactatatatgaagctggtagtttaattaatcaaccatcttattctttctctgaaatatcatcgtatatgtctgcatgggatcccatgtagaccactagttccgtgcatgtggatgcacacctcaactagttaggtgattattaggccctggtttgcttgcccctgctttttgcacactttaaactaccaatatatattcacatttgtggtgaccagccggtgctttaacaaatcaataaagggcaattttagattaggactgggtaaatcgtaatggaatcacacgtaaacttcaatttgggtggtgcaaacccatgatgcaaagtaagaatgaaggggtgatcaaagtgccatgtggtattggacaagctggctatagcctacaggtgtacagtgtgtgttagggctaccacaatgttaaacaaaagaaggtaagatgcattgtgggtagagacaataactgctactgggctattgtgctactgccggtaacaaaataaagaacaatatttttttagatatgtgaatctttttgtgctagcatggttagaagagatagtttaacaatgattctttttaagatggaccccaccttaacttgcataagagcaagtttaatagtataataacccactactatctccaattcatctatagccaatctaatagccaataattgcttactacactattagtatatggttccacctgtcatacacacattgtgtcttggagtccatgctgcagctggctacagatctgtagcccgctgctcttctctctcatcttttatctcattaaaatatatttgtagccagctaataatttgctattgtacctgctctaataggcatagcacattgtgagctttgtaataactgttaccacctaaacccttggcccacattattatctagtttagtaggatacattacggttgcttgagaggtactaccaagaagtattaatatctgtagtgcaaattttggtattttttaataccaaagataataagagatactaaattttacgctataaaatgtggtatcttttggtaccttctaaaaactgtaaaaatcattcattagtaatacgtttgtctataataatatttcgccaaatcagatctcagtgacttgcaccctagctgttggattgatatctaacggttagggactcatcttcaacctcccgcacaagacatggaaaagtggagctggtggatgagaatactcactatcaatggtgactccctcgaccgcgcgagctgttggagatgcgtgggtggtgaggtagcccaagacaacctgccaatactattagagggtgaaggtggcgccacggaataggaggaagaggaagtatatgaaagatagtagaatggggtggcgatgaagtcttgttggcaccgatacatgcttgcaaggcgaagtgagtcaacgtgaatgacgtgcacatctacgatgagtagcggtggggtctaggtcaggagcaacgggtggaggaaatggattgagatagggttacaaagtgagatagggatcttgatacaatttaaaccattcaacataaataatggaataagattaatcatgcaactcatgaattaagaaatccaaaaacaggtggcgttaaccatatgtacaaatactccatttagtcttaaataaatagatgatatagttgcctttttacacatatatttgatcatttgtcttattaaaaatattgcatatcattttttttacttgtttttcatcgaaggtaccttaagaatgatttatatttttcatatttacgtaacatttttaaatgaaaagaataatcaaataaaaatcaaccatatcatttattaaaacctaatgggagtataataaagcgatcaaaacatgacgacgccgtatgcatatccgatggatatgatctacttccagcctactttccatcccgtgtaacggccggtacgtgtaagtgcaccatggaggatgagtatatattatagatctgatcgatcagtaaacaagttaagatgcatgtgccacaaaactcaattaattaattaatcgaacgtcatatatatcgatgcatgggtagcaagatgcatgtgaccgcacaaacataataata

SEQ ID NO: 57910 - DNA, 3473 bp, Oryza sativa
cctcgatcgtgatgcgttacaggtgcaaaagtgtacgtggttttgactggttttccacgggggaaaaagagcaggcgcgcgtcgagcggtggctggccgggtttgcgcgtggccgccgctgccctcgtcgcggccggagggtttcagggacgacgacggccgcgtgtatatgccatatagatatattatcttgatcatcgagagagattgcgagtcggggatagcaccgacaggcgagtcttggagtgcacacactgtgtgtacacatactcctacaggcgatggtgaagcacatgtttcatccaatctatctcgtagaatggcgtgtattcacgtgatacctgtggtcgccgtatgtacggtaggtcccctctgcgtacgatcgaacctgcccgttgggcccgggccgcgtcttctaacgacgagtttctgacacagccgtgttgaactggaaccacacagccgcgtcgaactgggctaggagtgggaccactccttcagatatgattgcaattcagtggtgtgtacacccgtacttagcaacaacggtagatataggctgtgtttagatctaaaagtttgtatccaaacttcagtttttttccatcatatcaacctatcatacacataactttttagtcacatcatctccaatttcaactaaaatctaaactttggatccaactaaacacaaccaacccaaactttcaatccaaacttccaactttttccatcacatcaacatgtcatacacacacaactttttagtcacattgtaacaatttcaatccaaacttccaacttcgaaagaaactaaacacagccatggcagatcaagcacccatatttactcgtgcttggcagatcaagcactcattccttgtgcgcggcgcgttccggtaaaacgacaagcgccgaagcgcgagctagaggcagacagccaccggcatttggcctggcgctttgcgtctcgtcgatgaatcccatgctcatccgcaggagatcgaagaactggtaccatgaatgctatccgctaatttcgccggaatgggacgcgcactcgagaatggatcgtgcgcagtagttgtacacggccgtcgtacgtacaacactacaccactagcgcgcggatggatgcatggatcggcaaaatactttccgtttcttttcgtgcccttttatcttcgctttttacgcttttgtctcacacgctttcgacgtcggatgcttgggagcaatgggggtgggagagacagagagatggatcgaatgttcagtgggtcgagcggacagcaacctctcatcctctagcgtttcggcgcgcggcgcccggcccggactctgcgcttttctccggtccggagaaagttccgtatcggaaatttccggcgcagatgtttttgcgtttcgcctttcttgttggtgtcttaagctagcgtttgattcggcaaatcaaagcatgcgaatgagaaaaggttactttcctattttagtaaattttagcacctaaagtttatacacctcaagtttacacatctaaagtttagagaccaaaagtttataagtcaaaagtttatatatccgattcaaatttgaatttgaattcaaatatttttttatatgtagtatttctatacatctaaagtttatacacctaaagtttatagacctaaattttatagacctaaagtttatatacttgtttcaaatttgaatttgaattatatatgattcaaatttgaatttgaatttaaatattttctatatatagtatttctatacatctaaagtttatacacctaaagtttatagatccaaagtttataagtcaaaagtttacatactggattcaaatttgaatttgaattatatctgattcaaatttgaatttgaattcaaatattatctatatatagtatttcaatacatctaaagtttatacacctaaagtttatagacccgaagtttataagtcaaaagtttacatacctgattcaaatttgaatttgaatttaaattgtttatatatagtatttctatacataaatttttctaactttttattttttaaaaaattttatggtgtagaaagagaagaaggggaggaggaaaggggagaagagggattatagggggaggagagcgccgggtgatcgcgcgcattagcagtttcgatggaatagtcggcaagtaaccacgatcgcttcgttggtccggccggtatgcttgcgtagggatcgtggtggtatatttgcaaccttttgactcggcaaatggacactattaataagctagctgggatttttttttcttttcttgcggggagctgggagttaacttagggtgtgtttagttcacgtcaaaattggaagttttgtcgaaattgaaatgatgtgacgaaaaagttgaaagtttatgtgtgtaggaaaattttgatgtgatagaaaagttggaagtttgaagaaaaagttgagaactaaacaaggccttacacagttacacgtgaatgggtgacctttgtcatcactcgtcagggcggacccagaaaattaaaattatactgggtgtgctcattctagcgatcacgctaccatatatctattaactaattaaagtaatgaaaaaaagagccccacgttcgctctcatagcctagaaaatagaaaaacctaagtatactaggattagaatatgaaacggacaagaataaacaaaaatccaaagatatataattataggattgtgtggaaacggacaaataatttttggaaaccgtgtgaaacaaaataaacacaaaccaatcgcactatagatttatatgggattaaaaaactctaatgaagcactatagattatggtcagtttagattaatggctgagatttaatcagttttgtaagcaggtttagctctcggtcatgtagaccagcctaacaatggtcatacacagcagtgtgaaaatcgagagggatcaatgaattgagatgaactaaattgatgcaccactgaaggggtgactagcgatcacatctaggccgcctgtcccgacagcatggagaggctaatggtctcgatggctttaagcaacacgactaatgcattttccggagtagtaaaaacaagttgattaagtttcacaaaactataattaccttcacaaaaataaagaataccaaaagagtctaagagtatatataagaatacaatttagaaataactaaaattaaaaatttaaaaataattaataactatcacgcatatacaatacaatataaatattacacattggccagtttggtcaagttagtacataatttaaaattatgttgtcatttttaatatattttaataataaaatgtgaaatatatatattttagtatgtgagaaaaaaagataacgatcctaggcacgcaatctgcgggccatcatgctagctttttttaaaagaaaacacccaattctgatagaagaatt

SEQ ID NO: 57911 - DNA, 725 bp, Oryza sativa
ttcttagctgcttctgtcggggcactaggtcggccgtctttgtccacctcagttatgatgtgctgaccctctatcttcttcgcggcacctcgttgtccgcgtgccctcttctgtccagcagagggatgacttccactagcctcctcctcatcgttcccctcctcgttcccctccgcatccctctccacgttcccctcctcgttcaagtactggtttggatcctcgttcccctctccttcgttccagtactggctgcttccctctacgattgtatcgtatagtatctgttcctcatcgcgatcagccatctgtgcatacaaaaaatatttgttaggtatataggatgtatttgcgtaccgtaatattaaaactctgctaatcttatattaaatctctaataatcttatattaaatggctactaatctcatattaaaattgtaataatcatatatatatgctaagtctaacaatcttatattaaatctctaacaaacttatatttaatctataataatcttatattaaaattgtaataataatatatgtatgctaagtataacaatcttatattaaatcgctactaatcttatattaaaattgtaataatcatatatatatatatatatatatatatatatatatatatatatatatatatatatgctaagtctaataatcttatattaaatggctactaatctcatattaaaattgtaataatcat

SEQ ID NO: 57912 - DNA, 3599 bp, Oryza sativa
agcgcgcaccaatgcggaagcggaaaatcaagcgactacactggcccagcacatcagagccgtcaacgcaatactgagggaaaccccctacgatcccattctgaacgacgatctcgcacgatggacagaacgactacgggaatcagtgaccaacctcagcaacgcgttcaaagaagccgctgctgcagtgcacccagaacagccaccaactggcgatgctaatggtgaagatcctgaacaccgggaattgcctcatcgagccaccccttcacctcgcggcaccggcgatctccgcgatcacctgaatggccgccgagaggcgcgacgcacaagtgacaacgagaaccgttctcaacatcgcatctcttcacgacgtcacgataacgaagatcgaggaggccgttcaagcgaagaccgaggccatgataaccgccacaaccgctgcgatcatgacgatcacgaacggcgggtgctgggcgatactggtcgaggacgtcgccataatgacgacgatgatggagatcggcgccgagacaacaacgggcgacgacaacaaggttctcgagaacccggccgacgtcctcgtaaccgcacgccggaaccgagcgacccatcgtcatcgtcatcatcttcctcatcttcatcatcagatagacatccacgaagggcgtatgatcgccgacaacccaccgcccccagcgctgggtgtagagctttcgatcgttcacttcgggatgtccgatagcctgaaagattccgacctggagcaatagagaaatacgatgggacaccaacccagaagagttccttctggtttactccacggtactctacgctgccggagcggacgacaatgcgttggtgaattacttgccaaccacattgaaaggctctgcacgttcatggctgatgcatctcccccctactcgatctcttcgtgggcagacttgtggcagcagttcgtagccaacttccaaggaacttacaagcgccacgcgatcgaagacgacctacatgcgttgacacagaacccgggtgaatccttgagggattatgttcggcgctttaacgagtgcagaaacacaatccccgagatcaccgacgcttctgtaattcgcgctttcaaatccagtgtcagagatcgctatactactcaagagttggcaacgaggcgcgtcacgactactcggagattattcgaaattgtcgatcgatgcgctcatgcggatgacgcactgagacgcaagaacgacaaaccgaagactggaggagagaagaaaccagccaaggatgcacctgagtcaagcaagaagaaaattcgcaagagtaggaaaaggaaagctcaatcggaagttctcgcaacagaatacgcggaccctcccaagcgcccagacccacaaggcagcgatacgaagaaagcatggtgccctatacacaagtcggacagacactctctagaagattgcctcgtcttcaaaaagtcgctcgcaaaacacatgacatcggaaaaaggcaagcgagtacacgtggttgagaaggatgctgaggcgcctactcaggaatcggactcagcatacccagattccgatcttcatgtctcacacatctttggaggttccacggcatactcctcaaagcgagaatacaagaaagtggaacgtgaagtctgttcgacgtggcagggggctgcgcccaagatgaagtggtccgagcagaagatagaattctcagaagaggaccaccccaagattgctgtcatcccagggcaatatctgatcgtagtcgaacccactattcataatatcaaggtcgcacgagtcctgatcgacggcggtagctcaatcaaccttctcttcgccagcgccttggacgcgatggggatcccacgaaacgagttgacacccaccgatcaacccttccatggaattactcctcagtcatcgtccaaaccattgggcaaaattacgttgcctgtgactttcggccaagcaaactacttccgaacggaacagatcacctttgatgtcgctgaatttgatacagcatacaatgccatcattgggagaacttcactcgcgaagttcatggccgcatctcactacgcgtatcaagtgctcaagatgccaggaccgaagggaacaatcactattcaagggaacgctaagctggcagtacaatgcgacaagtggagcctcgacatggtcgagcacacgcccagcctacccgccacagctgagccacccaagaaagtgagcaaaacaaacaagacgccgaagccggacggcgcaatcaagatcgttccactctccagtgccaaccccgacaagaccgtcaagatcggggcatcactaggcgagaaataggaactcgcgctcatcaccttcctccgcgacaatgctaacgtgttcgcttggcagccgtccgacatgccgggggtacccagggaggtgattgagcacaaactcatggtgcgacccgatgccaagccaataaagcaaaaactgcggagatttgcaccatatcgaaaacaagccatacgagaagagctcgacaagcttctcaaagccggtttcatcagagaggtactccatccagagtggctagccaacccagtcatggtacggaaggccaacgggaagtggagaatgtgtgtcgatttcaccacctcaacaaggcgtgtcccaaggatcactttcctcttcctcgaatagaccaactggtggactcaacagccggttgcgagttgttgagcttcctcgacgcttactccggttaccaccaaataagcatggcaaaagaggacgaggataagacagcattcatcacgccgttcggggtattctgctacgttaagatgccattcggactaataaccacaggaaacactttccagcgcacggtccaaggtgcacttagtgaccagctcggaaacaatgtcgaggcttacgtcgatgacattgcttgtcaagaccaagacaagcgactcattgattgacgatctgcgggaaacgttcgacaacctccgacgatatcgccttatgctcaatccagagaagtgcacgttcggagtaccatcgggcaagtgtcacaccttgaaaattcaaaatttataaattgttgtttaaaaggaatttttagaatttatttttaaaagtcttgaaaagaagatctaattttaaaaataaattccaatataaaatggggccagataaaatttcattaaatactttgcttaattctataattcctagatttttctgagatttatttgagctaaggaagtatttttaataaatggaattgcatttaaaaaataatttaaattgaaaaaggttttaaaaatcttcttttggctttgggccgaaagtcggctcaaaaacctctcttttctctctcctcggcccagccggcccagtccgcagccgcgcgcgcgcgttcggtcgctgacaggtgggtcccacctgtcaggtcgtcgtcttcctggcgtcggcctccgcccgaaaccctagccgccgccgccgccgccgttcctttccaaatccggccgcccctttccgtttccggccgaatcaatagaggggaaatgatctccgggatct

SEQ ID NO: 57913 - DNA, 1124 bp, Oryza sativa
atctttaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgttttcggagagttcgttttcgccggagaagagtttgaagagttccaaggccagcaaggtaatgtcacagctcctttccgaggtaccgtggtggtactaaggcacatggtgacatgatgtggggctgtgtcttgtgggtacagtggtacacctctgatcagagtaaaactattcgaatagccgtgcccgcggttatgggcgggtctaacaatgtttttcgtgattagtctcacatttctcaccatagtaaatgatgctttatttggttataatttgtttagctcctggtttggaatggttaattcctggtttggagattagatctgttcagccgggaatggttgttcagaatggttgggcctatacaacagggtatgttgtatagcgttggtttaatattgtttaatacttcactgttttattaaattctcaaatgtttactaaatgctgcttttgcaaaataaaaccctattatgccatcttttggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtccgcgccgtttattttattttccgctgcttagatctttattgattgagaggaactatctacctctgtaataatattttattcgtttaaattagagtattaattgtactctattatcaatttgttattgtgtgcctcggctgattcctggacgagggttcacacacatgtaagcgtttggaattttggatagaaattccgggcgtgacaagttggtatcagagcttccttgaccctaggttatgccaaatggttacccatagaagccctctaaaaatgttggaaaaatagaactgttctcctccctttctcttttaat

SEQ ID NO: 57914 - DNA, 1325 bp, Oryza sativa
cgtgtgaggccacctaccttttctagcactaccaacccagtggaagcaggtgattggttgcatgccatagagaagaagttggatttgcttcaatgcactgatcaggagaaggtctcatttgcatcgcatcagttgcatggccctgcctctgaatggtgggatcatttccgccttaacagaactactgctgaacctatcacttggcttgaatttaccgctgctttccggaagacgcatataccatcgggagtggtgtctctcaagaagaaggaattcaggtcgctcacccagggatcacgctctgttacggagtatctgcacgagttcaatcgtcttgctcgttatgctccggaagatgtgcgcaatgacgaagagcgtcaggagaagttcttagaaggacttaatgatgagctttcttattcactcatgattggagattatcctgatttccagaagctagtggataaggctattcgccaggagaacaagtacaattgcatggagcagaagaaagccggattgctcaattcaagacacaacaggggaataatcagaagccgcgtcttactttaggaccccagtccataccacatggaagttcttcgtccgttgttcgtccgcagcgtcagttcttcaacaacaatgctggcaacaacatacgtaatcaagttccgcgtcctgttgcagctccaacacagcaacaacctatcaagagggagcaaggcatctaagcccgcggtgtgtttcaactgtggagatccaggacattatgctgacaagtgtccgaagccccgacgcgtgaaggttgtccctctcagaacaactctactgtaccagtatcaaaggcccgtgcaatcatgttgctgctgcagaagctcaagatgctccagatgtgattttgggtacgttccttgttaacttagttcctgcaacagtgctttttgattctggtgctacacattcatttttatctatgagttttgctggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagacctagatgtcatcctagggatggactggttagccagacataaaggtgtgatagactgtgctaacaaaaaagtaactctcaccagcaatgatggtcgagttgtaactgttcatgcattgtcttctgaatctttaaggtcgagactgaaccaaataactttggaagaaattcctatagtccgggagt

SEQ ID NO: 57915 - DNA, 2219 bp, Oryza sativa
gaagaatgtgagcagagttttcaagagttgaagaatcgtttagtatcggctcctatcttgattttgcctgatccaaagaagggtttccaagtgtattgtgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaaaatttggcatcattaccttttcggtactcgaacggaggtatataccgatcacaagagtttaaagtatatctttacccagccggatctgaacatgagacaaaggagatggttggaattaattaaggactacgacatgggaattcattatcacccgggaaaggctaatgttgtagcagacgctcttagtaggaaaggctattgcaatgctacggaaggacaacggttgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaagaatatgagaagaggaaaagctatcggtttcttggaggatgagcaaggaactgtatggttgggtgagagaatttgtgtccccgacaacaaagatttaaaggatgcaattctgaaagaagctcatgatactttatattccattcaccctggtgtaccaaaatgtaccaggatctcaaggaaagattttggtgggcaagtatgaagcgtgaaatcgcagaatacgtagcagtatgtgatgtttgtcagcgaatcaaggcagaacatcagaaacctgccggtttgctgcaacctttgaagattcctgaatggaaatgggaagaaatcggtatggattttatcactggtttacccagaacgtcatcaggccatgactctatttgggtgatagtcgacagacttaccaaagtagctcatttcatcccggtaaagacaacctattctggaagtcggttggcggaattgtacatggcaaggattgtgtgtttgcatggcgtccctaagaaaatagtgtctgatcgaggcagtcagtttacttcaaatttttggaagaaacttcaggaagagatgggttctaagttgaactttagtactgcttatcatccgcagacagacggacagaccgaaagggtgaatcagattctggaagacatgttgagagcttgtgctttagatttcggtggaagttgggataagaatctaccctatgtagaattttcgtacaacaacagttatcaagctagtattcagatggctccttacgaagcactgtatggtcgaaagtgccgcactccgcttttgtgggatcaaacgggagaacgtcaggttttcgggacggatatcttaagggaagcagaagaaaaggtgaaaatcattcaagaaagattgcgtgtggctcagtctctacataagagttatgctgacaatcgccgcagagatttgagttttgaagaaggagattatgtgtatcttcgtgtcacgcctcttcgaggggttcatcgttttcacaccaaaggaaaattggcaccgcgttttgtgggaccttataagatagtcagcagaagaggagaggttgcttatcagttggagttacctcaatctttggcaggagtccataatgtgtttcatgtgtcgcaattgaaaaagtgtttaagggtacctaccgaagaagctaatcttgaacagatagaagtccaagaggatctgacctatgttgagaaaccaatccgtattttggaaactgatgagagaagaaccaggaatcgagttatccgtttttgcaaagtccaatggagtaatcactcggaagaagaatcaacttgggaacgagaagatgaattgaagtcagctcatccgtatctgttcgccagttcttccgaatctcgaggacgagattctgtttaagggggtaggtttgtcacaccctgaaaattcaaaatttataaattgttgtttaaaaggaatttttagaatttatttttaaaagtcttgaaaataagatctaattttaataataaattccaatataaaatggggccagataaaatttcattaaatactttgcttaattctataattcctagatttttctgggatttatttgagctaagg

SEQ ID NO: 57916 - DNA, 721 bp, Oryza sativa
ttagattccgtcgtttccggagagttcgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggatttaacctattctttgttatggcccttttgttcttgtttaccttattccttgataccttgggttattataatttgactagcatggaccttacatattggattggttcagctagatattagatgtaattgcttagccctgcttagaaacactagttcacttttgggttaactaatgactcactataatttaatgatggcttaatgatagttcacgatggttaatcgtgattagttaattaattaatgtgctaactaaaacctgataatggtgggttgtgagcacatggttttgttggtcgtgctcatgacaattaaggaccggttcacgagtttcggttgtgaaacattaaccgtgccaaccacaagctagcgtgggcaacggctttatcttttgtatagcatggttcattgcagagcaccaggttgagaagtggcggagataagcccacgggggtcgctggggagtccattacctctggttttgagggggagattatgatccaggaacggtgcactgtagtggattgtgttgtgcgagaggtaatgt

SEQ ID NO: 57917 - DNA, 1536 bp, Oryza sativa
ttgcaggcgctgcatgtaccacatagctgagtcagttcttcagtagatcagtgtaccattctagtttcatgcaccagatgttttggtagtattgttaatatagaactgtagatagtccatatagcggccaattgtgcagtctgtatgtaacatggatatagataggtttcttgtgtagtagtagtaaataagctggttattttgctgccatgaaactggaatgacttgtgaacgtcgaaatgctctcgtgtatgtcggatcttcttcacttagccgttctcaaggatgagagcaattaatcttgtgatataatcctatatgtatttccagggcagaaatggaaaagaaaagggaaacctgcctaccacaacttttaagcctttgatctattgattataatctgaagttaattttgattttttttaatttgattcgtaagaataatcttaggtatatttcgcatctcctttacttgcccttttgactttcttggaaaaaagatatagcaaccaaagtgaggaagaaaacccttggtatcagtttgaaatcaaattctaaaattcaaaatcaaaatcagctttcgacgaaactagtttaactcgtttcgtccagcaacagttaaactagtactcctagcagtctagcagattagcatccatggaaaaaaaaaacccatctttgagtcccatcatgcaagccaggtacatagaatggtaagaagccttaaactaatccttccaatccataatcaaattagtggctgttaccaaattgtcatgaaatttctacctctccatgaccacatcaaccagaaactaatcccatgcatcttttatcatataaactaattgccactcaaatactgcaaccatggaaaaaaaaatcctatcttttgtgtcacatcattcaaggcgggtagccaggtacacagaacggtaaaagaagcctttaactaatccttccaatccataatcaaattagtggctgttaaattgtacttccttcgtcccaaaatataaaaactcagattcgtaatactaaaaaatatctcattcggttctagattcttatattttgcgacgggggagtagtaggactcccttcattttttaatagacgatatcaataatttttaaatacatgtttgatcatttacctcattaaaaaaaatttatgtaaatatataagatacaaattatattttaaatacttttagtgataaaataactcacagcagaataattactattttttaaatacaatagatagtcaaacgtatatccaaaagttaacgacgtcatccattacaaaaccggaggcagtaataaatttctacctctcctctccatggccacgtcacccagaaactaatccaatgcatcatttaccttcaaactaattcccactcaaaaactgcaaatctatctccaaacctttcccaaaaggttgctttgcttctctctccctctctctctctctctctcttcccccaggttcagatgaacctgtccagcctctccaaaaagaaggtcaaga

SEQ ID NO: 57918 - DNA, 1442 bp, Oryza sativa
cagggttgtcaatggcaaggcccttcagaatgcaccttgcaaaggccggatccccaaggataatatcaggagacccctacaaacaccataagaagcaacccccattgcaaacacaaacacacacacacacacacacacacacacacacacacacactacccacgataccgcaagccgcacaagacctgaactggaacaaacatacgcacccgaagagatcgcgaacacctggacactgaagaactggagcagccaagtttctacgaacggtgttgatgtccgcgactaacaagaattaccggaaaagaagaacacgctttgacaatatttgagctccgaacacgacgcaatggaaaaaaaacagcatgatgtaatgactgtaatcaacaaggaccaaggttgggatagaggggcaggggtgccacgctaatggcagccgaaggctcaaggaacaggcactatcccaagaggatacctgcaaaaaacgagcactcggctaaaaatgccccccggaaaacaaccggctctaagacgaaggaagtccaccatgactcaaagacaggacccaagaaaccaactctgctgctgcgaagcttgactgaagtaggagtactaccgctacggtcgtatatttgcatctggagatggatgacccagcacctccagcaactagttgttgttcctctaagcaaggatgtcgcaccaccagagctgcttctccagcgatgcaatgttgtggttgccacatgaagttgaactggagattgaggccctccaacgatgcagacatgctgcctaagaaaggaacactcttctgggtaaccttcaaacaaccagaaagtgagaggacacgaagtttgagctgcctcgctgacgccaacactgcaacaccgtagtcgctgaccatgcagtttgagagatcaagttcggcgagatcggtacagccctcagaaatggcaaacaggcttgcatcagtgatcctgctgcaaccttcgagactgaggcgtgcaagcgaactaccatgtgccttcaccaaggcagaaacagtagcatctgtgagattctcgcagccgttcaagtcgacatggaccagcccactttcggaactcttgatcaatggaaggagcccgttgtctgtaactgcaccgagaccactcaagtcgacattctccaactgagggcagatcatgccgaccacggccaagctggcatcggtgaaacctgggcaatccttgatggtgagggatcggagagacttgcacaggggaagctgcgcgggagcagagcagatgtccttgatcccgttgcacttgaccagtgagagggccttaaacttcgggctgcagttgaggaggaaggccagaatgcccatgagagtaaccttgttgcattcctcaatctgcaaactctccaagacctttgccgattccgcgaaatccttg

SEQ ID NO: 57919 - DNA, 3519 bp, Oryza sativa
cataaaaatttggcacaacattggcactaatccaaacactcgtatttactgtgctaccataccaaaattttggtagtgccaaaacttaccaggttttggcactgccaaaattttggtagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactgatgactgatcgatccatcgatcgagctatatctctcgacgagacgagatccagtacgtactctttcgtcggatgggtacagtttaattatcgattggtctaggtgcaggcgcattcacgtactacgcgagcaggtgcatcgctgtcgacgatgccggcgacgtacgggacagcgaggtttcagggaagcgatggacacacgatgccgatgcctggcagtgcatgatcacgacttctcagtcaagaccatcaattatcgtccgactagctagaggccgggtccttgtggtgtttttgctggagccgtaaatagtagtgcactccctccgtacttgttgactgaataactttgaataccaagtctgtttagctttaactggttgggttctcttaggccatgtttagttcacatcaaacttttcttcaactcttaactttccatcacatcacatcacatccaaaactttcctacacacataaactcccaactttttttccaaactaccaactttccctaaacttctccccaatttaatgaactaaacacagcctaaggtgaaaccgatcgtttgggtttactggcttctaatttaactcaggtgctcgtatttacggctaagtagatttaggtgcactagcgttcacgtaaattattattttagtggttcgcaagataccaatcgataacgagatacttgagatttcgttaatcccaaaataaaatataccagccatgtctttaggaggtgatcatgtcctaacagaggtaaggtgtgcgcgcgcatttagaaagatacgtgagttagggtttttaggatttttctttttggaatttttatttatttattcaaaaattctttatttttcagtcgggtaaacgtgtcgtgtgtaaaaatcctattttcacgtgtggttgtgttacctgtctgggaaatccctatttctatatacacctgagggcatgcagttgctacatccatctgcagaaatgcattttagccgtttaggaatattgtttatattgtagtgtcttttgcaacgcatagacatattactagtaaagataaagtataagaattggacgagtcaagcattggatgatcgtagataagacgatgaagtcatgggtgcatatctccaatcaacagggtgtttaaatcaataatcacacatgtgtatgcacttttaatagaattttagcggaacgaatttgtgctaattttcgtttcttccaatgtgtggacttctcttatgtgctctctccgtctcaaaatataaacatttttaacaaagtgacaagtcaaatattttaaactttgactattaatagtaaaaaaaattaaaagatcaatcatgtaaaattgatattactagatttatcattaaacaaattatcataatatgcaaatctttttatttaaaacatcttacttttatagatattgttagtcaaagtaacatatcgaaaaccatgtcagagtcaaaaaaaaaaaaaaagcttgtattctgggatagatggagtaattaattaacaaaaaaatatgttttgattgataaattggtatgcataaagatgcttgcactagaattttaacactttggcccttcttacatttactttacaaatgtaaatccatgctgaaacttattttgaaaatgacatatgccaagacttgtttcacaaatgctagctaagcgtgtactcctaggacttttagcctgcaggccgatcggccgctctcgatgccggcgacgtacgagacagccaggttcatggaacgaaaatgagaggtgcccgggcggtatgacttttcagtcagactattattgtagtagtacgagccagtttcaatttctctacagtacgtaatttgtgcagactattattgtagtggtgctttttctgtagcagtaaaattgtgcagtactccctcacagccggaatgagttcatttttgggccgttttggtttgctataaaaactgggccataccaatattttagttatcagaacaataccactgtgagtttggattgtgaccaaatcactggtagtgcctaggtttaatttggtagcaaggcataggctggaattggcagccatccgtcgcccgccggaagtgcccagaagcaggccacacaacttggctaagcacaaactagttcacgcacttccgttaaaaaaaagaagctagggcttcatcttttctctacttcaataaatacccagccactactcccagccactactcgtctcctcggctggccgcctcaccgctctgtttatttgtgcttattctgcagcaaatagtaccaaaactattacaccaaaaaaaaatggtaatccttcattggtaccaatccaaatggaaattgacccataaaaatttggcacaacattggcactaatccaaacactcgtatttactgtgctaccataccaaaattttggtagtgccaaaacttaccaggttttggcactgccaaaattttggtagggtaccaaaccaaataagccctttattcttcctatatgttct

SEQ ID NO: 57920 - DNA, 741 bp, Oryza sativa
tggcaaatggcaatggcatagattttgtggccggcttcgcttggaaggaggtcgtcagacgcccccaagtccgagcatgccgtcgtcatcgtcgtcgacgaagtggtcggggcgccatttgcggtggctggcctcctccgcccgaatcttggactcctcctcctgtttcccctcatctgcaatgagcctcatcctgaaaacatccagaagatgcttctcgtgtttacccacgacgaggcgggtaccctgggaagcatacatcgcgactgtgaccaaatcctgcatgcacgcgacaaatcgaacaggtcggtcaggtataccaagggtgtgtttagctccgcatcaaaattaaaagattgattgaagttaaaacgatatgatgaaaaaattaaaaatttatatgtaataaaaatttgatgtgacattttttttttcgaaactaaactcggcccaagccaacacaaggaggtctagggtcggagaaaagtcatcgggttctgttctgttctgaccttggcccacgcctccttggggagcttgtcggccttgatgccgaaaatgttgaggtagtatggcagcgcgtagccatcggggccgcaagcgaaactgatgcagctgtgcaggaaactgaggagcccgtccgggaatccccttgtgactgggtcgccgtggtagcactgccaaaggtaccaatggtacctcagcagcgtgcacgtcgccgccaggggctccatcggcacc

SEQ ID NO: 57921 - DNA, 718 bp, Oryza sativa
ctcgggttcatggcggggccagggatcgaggaggttctcatcgagtgcatcaacaggggcaacgccgccgtcgccgccgccgccgccgccggcgacggccagccgaggctgctcgccgcgttcgggatcaagccggagagcctgccggcgaacccgacggagaggcgcttcgtggccggcatcctgtacgctgcgctggagatgaggaactgcgtgcggaggcgggtccggtggctgaggagggtggagaggttcaaccagcggcggcgggaggaagaggcggaggcggccatgaggagggaggaggaggaggcgaggaggaagctggaggtgcaaaaggttcttgaggggtatgaggaatttataaattttaaataaatatttggcttgtttagattcaaggaattaattttggaggtttttcacagtaattaattgttttgatccctatgaaattactactttccaaagtagcacttagccttacaaagtactgaaggatccaagcttcacagtgcacttcatactattgaagggagtagttgcattttcaattgttttcagtggcttcccgtgatagaaaccattatatatctttgggctgtattgggacttatatgttctacactcatccaatttgttttttggagccctttttgaaggaaattttatttatcttagacaactaataagacggtataattagtgcaagaccact

SEQ ID NO: 57922 - DNA, 707 bp, Oryza sativa
ccaatgaatcgaatatacaatttcacatattctagcaaacaatgtaacattaatgaatcgaataagtagccgacacaaacaatggcaacattcagttcaagggccacatttcctcggggagcaaagcatatagcacacaactccacggtaagatagtaatagcatacgcagccacaaacttattggacgatcttgaaaggcatggttattgcaaaaaggatcttcttggttctctcactggttgagatcaaaatcaataacacgcacaaactctatgcaagtcattcacttggaaaatcaggtatgtcacaggcaccgggcatgctcgcccaggggtcctcaaggtcatgttcatcgccttgacctgcagcagctagattggtctcatcagaaagacccccatgaccgaaagcgtcatctgcatctttggcaaactgctcatttgagggcggcaattcttcgttaaactggcaataaactggcaaattcggttctagtgatacatcgtgcctccagaaagtagggtccaccaagggtggaggttggctgtcaaggaataggctgcttgcattattgttgatgccaacaaaagcatgacaacctgaaaagactaacagtaagttttatgtgatattgttcatgttaaaataagagtgagtacacttactgttctcgaggagatcatcaccaatgattggaaaggaaga

SEQ ID NO: 57923 - DNA, 1057 bp, Oryza sativa
aacccgctgctgctcggcaactacgcgaggttcctcaaggaggtggagggcgacgcggcgagggcgcaggagtactgcgagcgcgccatcgtcgccaaccccggcgacggcgacgccctcgcgctctacgcgggcctcgtctgggagaccacccgcgacgccgaccgcgccgacgcctacttcacccgcgccgtccacgccgcccccgacgactggtgagcccacgcgccgccgccaccttctcaggcaattccttcttgatgatgtctcgcttctcctgcagctacgtcctcggctcctacgccggcttcctctgggacgccgaggaagacgatgacgaccacggcggcgagcagccgccgccgccgttcatgggggcagctcagcctccttccatcacagcggcgtcttgagtgaacagatgctcttgatctctcgccgcctgtaaagaagacgaagcaacgaacacccgaggaggaatcacggcggcctctctccggcgaggcaccggccgtcgtcgacgtcgccggctcgccggcccggcgaccctcgccgtggctcgcagctgaatccggccacctgtaaaaatgaatctggagaagagcaccacgcagctaaggtgtagtcgatcttgtaaaatgagcctgcaaagcctacatgatgatcttgtttacttcttgtacatgtgtatcactgtatcagcaacgcttgtgaaataaataagccacagccaagtatgttctagctagatcagcaactgcaaggctctcatctcccttccagaacagaaatcatttaagccaaagttccacaccaacttaacaagatagaatgcacaaagtttattgcttatttgctaaagagaaaaaggcagggtaattcatatggaaataataagttcttctagcctaggaaataggatatggtcatatgcaattgttaccaactacaaataacaacagtaggttcctcctctcttgtatcaagaacaaaaattgacaagataaacattacaggggctacttgcgttcttcgaaactcctggtgatgaggacta

SEQ ID NO: 57924 - DNA, 740 bp, Oryza sativa
catctcgaggcggcccaactagggtttgcttcgttactaaggtttatcatgtaatttttttataggaaaaaaatatcaaaccctcttgtttattttatccatggaagaattattatatatccattcagataggataatgttttaaaaaaaggatatatgtatttaatattaaattccatggatgaaacgtggaaaagatatcttagtatttaaaagaaacaaaggatatatattccgcgtgctgaaattaatgttaggtacgttctctcatattaaggttgttttgaattgaagccaacacgtgtcctactgaatttttggtaacttcaatagttaggaaaaagctagatgtgtcaacattttcttgctaaattcttaattattaatattgatgggtcatgctatgggtgtatttagatttttataacttacatcttgatgaaattattgtcaaagggggagaaatatacaaaatgcatacttcttgaaaaggggagaattgaagttctagactcagtgaggagttgaggtccagacggtcaaggataccgggtgacgaagttggatacgagatggcatacggtggatggataccgtgtgggtgaaatctttgcaacgggcttcacgaggtgtgcgtgcaagcgtcggtgttcgcgaaggaaattggaaagtaagagtatatggtgctacagtacacgtggtactgtagcatgcatatatgtgtgcctactatgaattgc

SEQ ID NO: 57925 - DNA, 3585 bp, Oryza sativa
tttgaataagacaaacggtcaaacatatttaaaaaagtcaacgacgtcaaatatttagggacgtagggagtaattaataaataatattcgatagatatcatacaattgatacgactctatatgagtaaatcagattttttttaataatgaaaatatatcacacaagcaaataaataaattagatctaaagatattctctccatcccaatttgatcatcacctaacgattttgaggtcttcctaaaataattatcatataataataagtgtctctttatttatttattatgcaaagggtaattgggcatcgctgaatggaatgcatgcatgaagccatatgcatgctacgactgttagtgcaattccatgcaacatttaaagtgtgatgcaatatccactggatatatggagcaccttgattggtgataattaatttaaaaacatgaaaattttattgtccttgtctttgcaccttttatttaggggatgatcaaattgggatgaaggatatactattaaactaataataaatagaaatattagttgtttcaacggaacatcgaaaacaaaatgcaacaattttagtttaagttatgaagttagcaagatggatcagcaggtgcctaactaatttaatcgagtaatcgatcggcagcaaaagaaattaaacaacaaattaatttagagaataatcaatatggattttctatattgtatttgtattgcatgatcgaaggaaagaattaagagatcatgatcgaagatgagatcgatcgatcacctcggtgaggtcgtcatcgttgacccatggggacgctacggacatgttggggaggacggacgatgcctccgctgtcagcctgcagtgcggcggccctcctgtggcggtgcacctcgggaggtggacgacgacggacggaagccgcgagggggcgcgcgcagccatggttgccggccgcacgactacggagccgccgctgatgaggaggccggaggggcgcatcatctctcgctgcccgcctggtcgatcggtgtagtttgttgcaggccggggcttagggtgtgtatatatatatatatcgatcgagttggagaaggaaattaaggtaaaaccctaagccctaggagattatatatatatagtatacctattattaattactagcaaaaatacccgaaattgctaattcgccgacgtccgcgcggatgaggagggcggcagaagccgcgccgcgcgtgggatttttttcggttttctttgtatcttttcggtatttcttcggttttttcttccgttttttttttggtttttttacgggatacaaagtttatatacgtgtaaaaaactttttatgtgtatacaaactttgtatacataatatattttctagtttttttattttttaatacatacttatataaaatttatatacgttatatacttatgtatatacgccatatttaacaagaaccccagcacccaaccttggaaacgaactcactacgagagggcgggctctaatccttaagagtattttaatagtatagccaactactgactctaaattatctataaataatctaatagcccatttatacaatagttaactataaaaatatactacaccattaatacccggtcccacatctcatacacacataacatattagagtccgtgttgcagctagctataaatttgtagcccgcttttttctctcttctctttttttctcgatatatgcagtggttatagctggtttatagtctactactattgtacctgctctaagcgaggagatgacacagggtgccaaaggttggggccatcgtcgcggccggtctttccccggcctccgagcgttgtaaccagtgctaggagaagctggatcgggaacaaagatctgattggcacggagcagggggaccggcgctaggagatgtagtaccaattggatcaggaataaagatcgaattagaaatggtaataaaattggtcgctagcatgcacacattctccgatgttgcattaattgtattccgatgaaatccgcgtccataaagttatatgatgatcaatttgagaaattttagatttcattatataatgatcaatttgggaaggagagagtacagtactctttagctagttggagccactttttaaataaatggttcaaagctaataagaacgtgaattacataatactttaaagaaattggaactgctagagaatttatagtccgggttgcaacccctttagtcctaggttgcaaaccaggaatacgaatctgggtttgtgaagggagctatctatttttgatttcctattttttttcagcgtcattatgtcaggtgagatgataaaaacactacaaatattttaaaagactataaaaagtgcccgtgcgttgcaagggaagaaaaaacgagaaaattgaggaacaattgagaaagatttacattttgtagttaattaaattataaatttcctgagatatctaggtatttttaaataggtagatgtataattaaattaatttataagtaaagtaagtgtgggaaataaaatagcatggctgaatttaattttttattaaattcttcatgattatttacactctttgattttttctcggaattttcaaagattaattgctattttctataatacaaatatcatttcagcatttatttaaaacaaaatctaaataaaaatcctcatttgtgtatgggccttttttagccaattttcttcctcaacccgtagctaagccggcccattttcctcctttctccttccctccgccttcccatatctgtccagattctctcagttgcccaacaccggctgaagccacctcttgtgaaatcaggtcatttccttatagataatctaaaattgatcgagggtttcgattcttatcttttcatttttccgttgtcccaaaaatcagagaaaatccattgtgtatcaaactcggaattaagccctattctaaacaagcaaactctaagtttagtccatttcaattgaaaaaaaatcgccgaaagctttacatattttctttaattaggtatatgatatagaccatttgctataagtatattggtatggatgcatgctttgatacgtccaaaagtgcgacggaaattaaaaggaaaaatataaagcataccatgggacccaccatatgctggatgcaccacaaaaatctcccatcaatggtcatgccctgtcctctatcccattccgtttctcctctctctttctctgcgatacgatcgctccttctcaggcttgtgacgtgcacctgcatcccgcagtcctggcaccttttgcatctttgagtctggtgttaatagagatggcaatggttaattcaccgtcggggtcatgcccgtgtccccgtcaccacggtgaaaatatgtcactgtccccgcccccgtcaactacaacggggctataatttctctagccccgatcaccacgcggtgaatttttctccatggtgaacacgtccccgcttaaacaacatattcacaatcacattatatcaaatatatccaaaaactccactcaaca

SEQ ID NO: 57926 - DNA, 1537 bp, Oryza sativa
ccacgtggggctcggccgtcagccgcccgcgccctcgggtgcggctgacgcctggggcccacggcgccggtcggcgtgagccgcgtgcacccggtccaccgtgggccgtgaggctgccgcgtgggccccgctcccgtggacccggtccgcgcgccctctcccctcggctgacgcaataaatccgattttaaattaaaatttaaatgaagaaattcgcaaatattcatttaaagagcatataaacttcaaatggctataacttggccatttgaactcagaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttctgaaattattttgatttaaattattgcattatcgctttatttaaattcccgcgttatcactgttttatttagccatgcctattacctttgttacgaccttattatttttattgctattattaccttgttcaccctagaataaacaaaacccccaactagtggacactctatttgtggtatcactagtatgattttaggtagatgcttcgctgattaattaggtaacattaggtggttttaaaaccctagactgtggtaatattcatatcacctggacactggaattgttggattattgtggaattggattcaccccgccccctctattcaaaactctcaaaatggttttaggctgggctcggggtgcatggttttgatagtcgcacctcggccatataaggaccggtcttcgggcctctgttgcaaagcaccaccgtacttccacatgtctaatgggtaaggcttagtttgtggctcagtctggttataaacaaaagtacacggatggagatggacgaagtcgggggattcgatggacatctctaggacaaatgaaggctacacgagctgcggcccggtagtcgagatgtcatggcacagggttggtgccctgctgctaggggctcagtcctgcctacctgtcccgggggttccggccgtaggtgggattgggtcggtactcttgtctatggctaggatgggttgggaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttg

SEQ ID NO: 57927 - DNA, 2866 bp, Oryza sativa
ttgttgagtacggtggttgtactcagtcttgctcaatttttcccaaacccagaagaggagcccctggaagatgaaggctttggtgtctagctcgtgcctgccgtcaagtgcctgtggtcgtcgccctagtcttccgctgttcttcgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacgcccgttgggtgatttccggtcgtgacaaccatcatccaatggatcatcacaataaacaaaatacacaaataggcatcatgcacacgttagcttagaaggcactgtcttcgactcttcatgtctcaaactagtgcaagtctctgcatgcaaaagacaagcaaaatacataggcattagtcaattatttgatagcaaggaaatgaagggagtacaatgcaatagtcaattatttttagtttgaaaagaatacctccatcttatcttggatctcttgaagacagctccaaaaatcttgcaggttcttcattatcagcatctacaaaattagttgtaatgattattatgcaaccatgacaatggaaaaatataaatgatcacactatgtttgaatggtacaacacatacacctttgtacttgtttcgtagccaattttgggaacacattaaggcctccaagatatctgaagtgagtcagctgcggtgctcactaagaaccctcccactagtgctgaatgcagcctctgatgcaactgggctaactggaatggcaaatatgtcccatgctacttttctcaatgtaggatattgtgtcccagccaccttacaccaatcaaaaatcttgaagttttccatattaattgagactaactcatcctccaagtacctatctagctcagatttaactcttattgctggtggcctccttcaagcaacacgtgcactaattgaagacaatacacctgaattagcaagtgaatgagctgaagattctgtgttatcttcatcctcttccatttcatactccttcatgaggtcatacaaattgtttttaacctcttcaagtttgtctgtacactcctcacttgattggctagtaatggactcaatgaacccaaggaggtagtctgttttaaacttaggatcaagtatggtggccaatcccattggtccttggatctccttccaatacttatcaaacttcgcaatcatctcagttgacatttcctctataatattattgccacatgcagcctgtcgacgggggatacccgtagacaggatatagagggtactggggtacgctggtacaaggatctacatagtacgacatcaagcaaataggaaacagagattatactggttcaggccccttggtaggtaatagccctaatccagttgatatgggattatatgatggaaaccacagattacaaagggaacagtggaactcgacgataccgacaagatcgtagtcgagttgatccgactagatctcccagcgacttggctccgataagctccggcttcgtaggctgtggtggagttggctctgagattcgatgctttaggtcctcccgggggtcccttttatatcgcaggtcacctgtctcccagttggactcggagaaaccggaccgaacacgacacaatgacgacccagttctgaccgagtaggactccttccatctgtgaaatccatgatgaatttccttaacgtatgccgaaaacatccgtatatgcgtgaacataccatatcgatatgtgacgtatatcgaagggtagagggtataccttactcgtaaccctgacagtagccccccgacttctgcttaaatgaactggtgaaactgatcgcgacttcacatgtcgaaattgtcgttgttctcggtgtgaggacggagagacaaggagtgatcgacaacatcgagtgaagttcaacggtcatgagtgaatttaaattgaagtccgaaaaactgccacgcgtaacggacccagaaattcgcaccggcggaggtgcgtctatttaagggagttttggggatccaatttgaggtctgcccgttgaaaaaactctccagcttccaagcgtccctcgtcttcttcgctcccgcaaaaaccctagccaactcatctcggtcctttctccggcgatctccggtggccatggatcttgacaagtctacctccaccagtgtgtcactgaagaaactgcaggaggatggcgcccttcccagtcgcgggaccgcggagagggaagtaggaggtactgaaccccagcctgtcctgggtcgcatggttgcggttgaggactttattctctgcggttttcttcctccgccttctgaatttctccttttggtcttaaatttctatggtctttccttgctccatttgaaccccaactccatcgccttcctgagtatttttcacctttgtgaggcctacattggggtagagccgtttcttgacctcttccgcttttactatgagttacgctggatggaatccaaaaaggtgtccgggtgtgttggtttccgacttcgggatggcctgaagtcacgatacatcccctttcagtgcccctcatctcgcagcaaatggcgggggaggtggttctatcttcaggtagaggattcggatcctgccttcgttgttcctgaggagcagccagacaaggttccatcttggaccaccaaacctgccttgaccccgtccctccaatctttcatcgatatcgttgacgacctccgagaacgggggttgtcggggtatgaagttgctgccgatttcattggtagg

SEQ ID NO: 57928 - DNA, 1711 bp, Oryza sativa
cttccacctcacatcatatcgattgtactccaggcctcggacgcgtctcccccgcctccgcgatggcagcggcttgtgacgctcagcgagaagtaagtgaatgaatttgaggtttcgtgatttcgtcgaactctgtctcaatcgcagcctttcgcagggcggcgcgggcgaaggcagcgcaagatgggtctgggggacctccaacgcgtctcctgccgtggcctcaacggatgtcgttgtcgtgcccaggagccatgaggcgacggatgtctgggggatcttgtggctgattgtggttcgccggctgccgtcctcacctgggaggagctccaggttgagatggggcgcctcctcgaggctggtgctcgcggtgttagccacgaaatcgcggaggcgagggcggcggctgcgtcgtcggcgaacaagcacgccgatcggctagcgcgcgacctggcggaggttcgcgaggacctccagaagatgagggaactggtggccggcaacgagcgacaacggcaggggctcgagcatcgcatgtcggagcttgagaacaacttgtcggaaatccatggctcattgcgggtcacctatactggtctgcaccagctcgccggggagtgcggtatcaagtccaccatcccggcgaatcccgatgagttctcgctgacgtcttctcttgcggagctggtgacggtgatggaggagatcccctccaagcatgcggccaggatcggagaggagacgtctaatgggatctacaccggggtgtgccacgtccttgcatgtgtgaggctggcgcaccctgaactcgatctgtggaagatcttggatcagggggcggttagcgacgcgcgcaaggatgtgatggaggaggtcggcgatctgggggagtccgtcctctcgctttttgaagagtagggtcttagctctcttgtactctttagtcatgctttgtaaaacttttattggtctcaaccgccctagtgtgtgcggtcattgccttagctttatttagcattttgatcttgagtactttgttgtcctttgttaccatttcctttgcccttccgtctggatcgacttgatttgttgtgttctcgggagagaagagcagcttgacttagtcgtttccatgctgagcagatctcgagagtgcgcttgctgaccaggatcgtcgcatccagtattggaggacgaagtttgaggtcgcggaactcgagaggactatgctggaggtgagaaaggaccaggccgtagagacactccggggtcgtgaggtgtggttcaactcgtatctgaagagttgctgcacatccatgtcgagagtctgtagagagctccgaataccccgtggggatcccgaggaatcggctgccggatacatctcatggctgaatggggcctatgcccagctcgaaggcatcggtcaacatatcgacgaggccttgaagcaggagtgtcgtcgctcaagccgatatgccggggggcacgtgttggcctgcatagagatcatcgttcgcagctgcatctcgagttcctccgcgaagggttttctcgttcccagagaactcctacggagatagatggcctggcaaagtcgatggcgccgctggcggagaaggttttccagtcgatggactagcgttgtccttcctggtagtctccgtatcctgtgacaaatgtctttggaaaaagtgtaatatagttttga

SEQ ID NO: 57929 - DNA, 1050 bp, Oryza sativa
ggccttttttttaaaaaaaaaagaaaaaaacttgagggtggtatactggggcactggctttgttaatttatctgggcttaggccccgtgttggggagtttctgggcactgtaagttgtcctaaaatccccttaaataaattagattctcattcagatttgattttgagttatagaatttagtaaaaactaaaagaagttataaaacttaactattatcagaagctgattaccaattaattatcctctaacagggcctagtcaccgttcgttcgagcagtgctaaacaaccgcacgtaaaacaagaaaactttttaggacatgattaattaagtattaattattataaactttaaaataaacttatttgatttttcagaatattaatttgtatatagaaagttttgcaaaacacataccatttaacacttcgggaaatattctcacaaaatacaagggagtagctaacccaaagtgctcaaaataactcagccttattcctttcaaattattcaccaaactttaaagcatattatttgctcaatgctttgaaaaatacattttctagaaaaaaatcttctaccacattgcgtagaccttgtgtttatattttaagctattttgttaagtgcatttatgaaaatattaattcatccaagtttaatctgcagtaacacttcacttaataatttatgaagttagtagcttttagttgaattcgctttaactggtagtatatatttgaaagtttggccattttatttataaaagttattatgctgcatagctttcgttcatcattgctttaaccttttaaaatttatcggtggttaaatgtaaactaataatagagagcattgataaatattgaaagcggttttgtaaaaggagagttgaaaaatgaaaggagtaaaaatcagatcgtgaactgcataaatgcaaacttgttcagtaatgaatatggtaatgtactagacagcttcctagtaaagccatgctaccactgtggtggtgctcttttcttttgaagatgaagattaagttttttacgt

SEQ ID NO: 57930 - DNA, 1884 bp, Oryza sativa
agacattggcgctgagttaaacataccaacgttagctatgttgacgttgagccccctatccacatggttccgaggacgatccccctcacttacgtgacagggactcatcagcaccaagacggttggcgctgacccaatggcatatttttttgttaaagtttttttttctgcacggttagtttcgaaataagtttggaaatgactaatttgtaaaataaccaaattattactagtatagtaaattaccacgttgatcataagaaataatatatactggactgtcttcataacagtgtggattatttatatattgtgttgtgaactaaccaacgttatacttttcgagacggagggaatatatagttgtattagaaaatacaacagaaaacctagacaacggtatcctgatagaacgaaatatgtctatcatgttgcaacgagattccgttttatagcagccctcaaaatacaaatatattcttgataatcccatacaatttggtggaaaattcgaccagtttatccgaaacagaaggcgtgaacacaagtcatcagcatcagcaaggcataaagcggacaacttgaaacactttattgaatcagctaaacttgcggctcgcttcttcttttcttttcttttttcttcccttcactttcttggacctgtgacttttagttggccgtccaggggatctgaatccatctactgtagaccatttgtacaatcaattgttacaaaatggaccacttaatctacccctaaatgctaaagcaatgactaattatgagctactcctagctgctatattcagctcagctcttgcaagttgccaggcaaaagggctactaaaaaccaatattaatttctagcaaattgctctagcaggctcttcatcttcttggaccatggcttggcgtttgtgtcccggtgagctgaaccatggataagaatgcggtttagtgcaacaacctgcaggggaacaatttgatgacattatcctaataaaatatatttttagtccatgctaataccttttaggacctggtgtctcttacctagccacacacatgtacaccgtttcaccgatttaattatgtttttaccgagtcatttgttccgtatgagaataatctatgggttggaatgatcatcaattacatacttcttcgtcattgcttcttacagaattaatcaaagggggaatatgctaacgagtataatatagtttgaggttgttgtgtttgaagtttccgatcgataaggtgttaatggtttattttcgaaactattggtgctggtaaaaaaaatgttctgctattcctctatcaaagcatgtcaatgtcaaacatttgctaaagttgtactccctctgtttctgaataaaagtttagctttgattttttttcttagtcaaactaataagattatataaaaattagtagcattttcaacccaaaacaaacatattatagatttaatgaatctaaaatttggtattttagatgttgataattttttctataaatttagtagtaaaatatcacaatgacttctaatataaaacggagagggagtatatacatatgccaaacaattttaccaaaatttgggtaatacccatatatacacatatattaattccacattggctcaattttccaaatggcacattaattcacacaattattttttgcacgatatcagaacaacttctcccatttatatctctactattataaaaactgaagatgtttttgccagaactttggtacgtcatccgtatatgagtcggtttttaagttcgttcgattttagaaataccaaaggagtcgcatagaaatctcttaaaaaaaactcgcatgctaacttgagacgattggact

SEQ ID NO: 57931 - DNA, 3028 bp, Oryza sativa
attttatattataagatattgcgattatttttaatctaacatcgaataattttgatttttttagaaaaaatgttactatgttattgtaaacttaattttgtatacggaaagaaatcaaaacatcttaaaaaattaaacggagctagtagttaccggttttaaggttttaagggttgtataattcataactaaggtttcgtaggtttgtcatactttttttcgagcttgtcaaaagtgaggcaatcaaaatcctgatcacacttgagccagtaaaataaaagatatatgccacattttataagtcactaacatatatatgggacctatattacagaaacgtaatattgtcatgtttgtggcaacaacgcaaacacgcatgtcaaaatatctaatcacagattgttataaaatacggtaatggccaaccagacagtttcttagtaattagcttcaccgcttattattgttatgaaataaatagatgatcacatctatataaaagatgggatcggtaaccgaaggttgcgcacaacagttgtgtcgtacccctcgccttctcggcgctccttgacaacgggcacgatggttcccaaccatcacgtctatggtggccacccattcctgtataatcgcattgattaataaagtacacaactattctctcgctcccacaatctcaattccctattcaacatattatcagaacttcactcttcgcgagaagaagaagagtagatggagaaaagaaggtatgcgtaccttcgattcctttctcggccttcctcgccgcgatcgtgttcgccgccttcgccatctcctcctattcaacaattttcatataatttgacgtgacttttaataagccttcaatcgtacatggaagctagtgacacgatcgacaaatcaatgccaattaaaagtccacaaatttagcaacttaaataaataagtatttaattaggtctatgtacacataacattagaaaaattggcacgtctaggaaaggtgactgatgaagataatgcattgttcttatcattgacacgtcaccctaatttggttgtcgtaacttcacacaagtacacaagtgatacatgcattagttcattactcccccgtcattttttttaaatttttagcttttagatgtctactccctctatcaaaaaaaccaacttaagagttagatgggacacaatctagattcgttgtactatattggtcacatccaactcctaagttggatttttttttttacgaagggagtatctttttaggttatagcgcctactagatctcttaataccatttcatcttttttttattttagccatcaaactattagtattctcttcttctcctaagtttctctcccttctcattttccctgtgaaaatggatggtgtgtacttcccctgtcttataatacatcaacataatatcagatagaacatatatactagtattatgaatctggataaatttgtagcactagaatgttttctatttgatacaaattgttatatttttaggatgtagatagttttattttaacatcttccttgtaaaaaattacatcacaaattctaaaaaatacatcacagattcccatcacacacaaatcaaatacatcacaggataaatcataaattgtaaaaaaaagaaaaaaaagaaaagccggccggccggccactgccgcctcccctccttccctccgcgccggccggtcgccgcagccgcacgggcccccgtgccgccgcgccggccgccgccgagcggcccttcgcctgccaccgggcgatcccccgcgccgccgcgcaggccgcctccgcgcggccccccgagcctccgcgctggccgcctccgcgcggacccccgcgccgcctcgtcggccgccgtctgcttcgctgtgacgaatggaaggaaaaaaaaaggaaagagaaggtaggagttagagataaggaagagataagaagttggagagggagaaagagatagagggatgagtttgttgtgtggacgggaaaagaggatcggtaatagggattatatagtgtgtttttaattttttttttcccggttagtaacatcaaccggaactaaaaataggtttttagtcccggttggtgttactaacactacaccatgccccaagtttgcttactacatatctgtcaggaaaggccctatatgctgccaaattatttgtcagcaaaacgtttcccgacagataaggtctgtcaggccaagtgctgccggcaaaagtctttcccgacagataaatctgtgccgacagatagaccgatagtgttgctacatatttaccgacagatagttttaccaacagacagacttttaccgacacttaagaagattcccaacagatagcatgtcactgtgttatagatttaccgacaattaatgtattgatggcaagcacaagaactaacaagcaatcagtcagtaatccacacaaaaaatatactaattaccaatcatccattttatgaaccatacctcaaattaaatttgcagcatatatatggatgaatatcactccaaattttgcaacacggattatcacctttcagtaagttacacacatgcataacacaatattcaactattcataactattgttcacaaatgcattctgacatatcatcatgtaactattgttcacccatcaagtagcagtattcctatatagcagttatccatcagctcaaatagctattacataagagttcaagtacatagcaataattacataatttagatgtaactaaggttcttgtaggtgtattgaggtcccaaaaacaaaacaaatcatctcttttatggttcttgtaggttcttgattttttttacagcacctctgctagccctttttatggttgcctgcaaaataatggacagagtaaatgaaatgaataatcatcagtagtgtacagagtaaacatatctagtgtacagagaaccacagaagaatatatatagtccatggcaattagaatagcataacag

SEQ ID NO: 57932 - DNA, 1900 bp, Oryza sativa
cacacaaggattttatcacggctgttcaagaacagccgatgggattcttcaacgaagaagtcctaatcccgacggtgaattctactacgacgaatcgacaattcataacgtcggtccttcctcttctgacatagcgccggcgtcgaagtcgtagctatatatagctaccgagcaaaagaattgtactatatacgcatgtatatatatttatatatgtacacatttacttttgtgttaatatatattttggtaacatatatatatgcacataaaatgttaagtgctttaaattatacatatgtgtatgtaatatatgatttacacacacacacacacatatatatatatatatatatgtatatatatatatatatatgtatatatatatatatatatatatatatatgtatatatatatatataaccaaccatgcagcaaacagggccatgcaaaaaaaaaatggtgcaccgatctttagtcccggttggtaatataaaccgggactaaagatggatctttagtcccagttatttcacccgggactaaagatagctatctttagtcctaaattcgtagtcctggttggataaccgggactaaagggggttaccaaccgggactacagacggtttctccaccagtggatcgtcgtccttgaggccctggcgatcgtagtccttggcgcaactcaagtcaaagacttcgcccctaatcaattaatcattgcactagaaaagagataagggacgaaattgaggactggtaaaggatttttggaggacactcagtttctttttgatttttttaggtcctttgattcatagaaaaagataaaagtttttgtataggattatattcctatggtcaattttataggaaaaataagtaagagattagatctcttcaaaactttcatttggttcatttttttcctttcgtgcagtcaaaggacatttcctcctgtttcctgtgttttcacttcatgtcggattgaataagcagttacttcaatttttacggttttttctatatccatatttttcctttcctgtggttcgaaggggctctaagactttgattatctctagttcttcatcacaaaatgtagaggggaaaaaaagacttttgaccttagtttcttgacgtgctacttctacgagaacctaaaacacacacaggatatacaaataattactccatctaatcattgttttttttaaaaaaaaagagaagaactttgcagtatttcattgatagtgaagatagagcaacatcaacatgatcagaaaggataaatcaccgtgtccgaaaaaagatcaagaataaacaccaacccaacacacaacacctcacaaagaccggaatatccctctagtaagtattcccaatgtcatatatctatgacaagtggaggtaatatttgataatattttttaattacacgagtatatgtgggaacacacatggaaacaaacaaaaatgcagaattattttgtaccaacatttttcattttgcccctgagggattttttccatcttggctttttaccactaaggtgaaaattagtcatggtttagcctcacatttgcatttgccctttggcaaaataaatagacatagtgaatgtttatattagagtgtcatatatatgctattttttatggataagacttctgatactaatttaacagcaagcgattttcgtccaatccagatcctcagtattgcagactcaatgtggggctgaatgtggggctgagggtctgtaaggcccatatgtcagtgagcacatgcagtactgcaggagccgcatccattttcatcaccttgactcttaagacgtcaaaagcaactctacaaacaaatttaatgagctttaagatgcatttgtgaaatgg

SEQ ID NO: 57933 - DNA, 2705 bp, Oryza sativa
ttttgttcttgccaatgatgtaacccaagttttttacgtcaaggacatgtctagcaaaggaaaaaagggcaaagggcctgacgagccgaagcgccacgtggttctcccaggaaaaagaaaaatcgtcggagtagaggacaagactgacgaggattacgatcagtttgatgggtaaccccctttcacggtgacgattgaccctagcatcctcctatcaaatgaagacaccccttactcatgtagcgatcacaaggaaggaacaatagtgaggagaaagtacgtgcggtcaaccgtcaccgccgatgtattgcagtaattgttctatacacgatgtaaactatgttggatgtactgaatatccatacaaatcaattgttgtatagcatatgttaaatatgtatgattattagaatttttatcaaattgaaatcatccatatgctagttatatatgattattagattttttgttaattatgtatgattattagaattttaatcaaattgaaatcatccatatgctagttatatatgattattagaatttttaaaggttttaaatcatgcacgtggtatttacatatgttaattataattttcaacaatttaatatcatgatatgctagttatatatgattattagattttttattaaaatcatgcatgtggtatttacatatgttaattagaattttcaacaatttaatatcatgatatgctaattatatatgattattagattttttttattaattttaaatcatgcatgtgctatttacatatgttaattagaatttttaacaatttaatatcatgatatgctaattatatatgatattagattttgtattaattttaaatcatgcatgtgctatttacatatgttaattagaatttttaacaatttaatatcatgcatatgctaattatatataattattagaatttttaataattttaaatcattcatgtgcttattatatccacgtattctactacatacaacaataatttttcgaaggttttatcattaattgttcgactttaaataattgtaatgcattatttactattttagaaacacatatgcaatgaaattcaagacacagctgctattatctttagtcccggttcctaactctaaccgggtttaaaaagaatttagaaatagcgagaaaagatctttagtcccggttggtgagaacaaccgggactaaagaatatctttactcccggttggtaacaacaaccgggactaaagatccgggggtatatatattcccggtgcgccctcgtcttctccaccaacacttagacattgttcgatctcggcttctcattcgccgccaccgtgcctagggcaaccccgcgccgacaccgccgtcgtctctcgccgtcgcttggcggtcctcgccgcctccgccgcagacgccgccgccgcatctcttgggtgagagccgtcgccgcctctttctctctatctcgatctcgatctctctctctctctccacggccgacgaccggcttcgacgcggcggccgctgccgacaacgccatcgccactgccacgaacgccgcccccgcctcgagctcgccacgccgccgcgccacgccgccgggccactacgccacgccgccgcgacgccacgccgtcgccactgcgactccgccgccaccgcctcgagctcgctatgccacgccgccgccgccgcgcgccgccgccgcgccccacgccgccgggccccgacgccgccgccgcgcccgcacgccgccgggccccacgccgccgcgcccccacaccgccgcgccagcacgccgccgggccggcccacggcgccccgacgccgccgccacaccgccacgccactgccgcgcgcgcccaacattgccgaacgtgattgaaacgtgaccgaacgtgaacgaacgtgaacgatacgtggacgacctttgaacgaacgctgaacgaacgtgaacgaaacgttaacgaacgcgaacgaacgtaacgaaacgttaacgaacgcgaatgaacgtggacgaaacgttaacgaacgcgaacgaacgtgaacgaaatgttaacgaacgcgaacgagcgtgaacgaaacgcttacgaacgtgaatgaaacgcttacgaatgcgaacgagagcgtgaacgaaatgattacgaaacgtgaacgaacgtgcacgaaacgcttacgaacgtgaatgcacttgtactaaaagtgtgagaatgaacgcgtttatactaatacgatttactggtaatacatatatgattatatatgtaacttggcccgtttagactaatacattttcctggtaatgttgcagagaagacgtcgtcgtcgtccctcaagccgaagtggtagctagccatcgaaggaattcgcgcaggcaagtgatgtaaagaagtgattgttagatatttaatattagattgttagacttagcatatatgattattacaattttaatataagattgttatcgatttaatataagattagtagcgatttaatataagattgttatacttagcatatatgactattacaattttaatataagattattagagattaaatataagattgttagatatttaatataagattgttagacttagcatatatatgtatgattattacaattttaatatgagattagtagccatttaatataagattattagacttagcatatatgact

SEQ ID NO: 57934 - DNA, 826 bp, Oryza sativa
ttctttaaggttcaattcccaggagggaggaaaaatatctgtggagaagtacacatttgatccacaaatagctaggagagagcttgctgccatgattgtactacatgagtatcctttatctattgttgatcatattggatttcaaaggtttgtgactgcacttcagccattatttaagatggtgactcgaaacactattaggtaataatgatatctattagtttcagttgtctattaaaaatatctgcaattaagaagaaaaaattaacatttatgcatttttaggaaggacattatggactattacatggaagaaaataagaaagccctagcctacatggctggaactaagtcaagagtggctattactacagacttgtggacatctgataaccaaaaaagagggtacatggctgtcacagcccatttcattgatgattcttggacacttagaagcattatcatgaggtacttgatgaacaattaatttcatttcctactgctacatatttaattcagcatgacattagatttcatttttgcatcaatctgaatttaatctaggtttaactttgattgtataggttcatatatgtgcctgctccacacacaactgaagttatatgtgaacaactttatgaagcattggtggaatggaatcttgatgagaagatctcaaccttgactcttgataattgtaccacgaatgacaaggtaatcactgaacttgggaagaagattggcaagtctaagttgatgttggagggaaaattgttgcatattgttaacgcccaaatttggttatttaggtatcggagatgaagat

SEQ ID NO: 57935 - DNA, 4128 bp, Oryza sativa
gccttctcgggccggccggcccgttaagtttggacgagccgcccttttctctcgggccgcgccccagccgcccgaggaaagtctaatttgcctccctccttcttttcttttcttttctttttcaaaaagcatttaaataaattctttttttttaccaaaaatccaataatcttagaaattcaatatcttcccaaccgtaagtccgtttgactccgttcaacttccaaaattcctcaaatctcgagatctatctaatggcatgcttagaggtcaataatagggctttattttcgccgtttgctgagttgtcccgtttcgcgtgtagttccggagcccgaagacccgcagtgcgaggatttcgaggatcaagctcaagatctcgagcaaggcaagccacccttgaacatcttgagcctatatttgaacttaattatgttgcttgaaaaatattatgcattgataggattgcacttaatctgtttgcccagtctgcaaggcagaccgatgggcctacctagctcattgcgtctgatccttcctttgttaattgttataccatgttcccttgtaaccacctagttgcgcctcggtaatcgtgcactctgcacgagtatcgacggtcgccttcaaccttaaaatctgagaaacatcttgggtaaaacttgggttttacaaaagacttggaaaacccgacacctgggtcggtgcttgcgaactaaatgaatttccaaaatcgcggaccggggaacgtaccgggtgtatggtttcccgctcttgcacttaaggaccgtttccttggaatttcatccgaacataagacaagtgcgaccacatgggtggaatgggacacccctggctgagtaactagctaaacgggggagccatgatgccaagagacatgtggattcaacggggtggtgtcggggagaacccccgggtttcctggcacagtatggtctgggacctaatctggtgttggtttgggacccctctcgttggcatatggtgaacctgtgtcggctttcgaaatgtcttgtcatgaaagccttaaggtctctagtcgtggctgttctgcacgggctggatgatccgggttagtaatgttgtgtgggtaaagtgtaccccctctgcagagattattaaactgttcgaacagccgtgcccacggtcatgggcggatgtgaggtgattcctagcgtagttttgtttgactactgctttgtgaaatttgctgatgtggtttgggattgatgtttggaaaatctgcggctgatgggatcagccaggcccgggtggccgtttgaaagctgttggccaggtgccaatcttgatcaattcaaaagactgatacattgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttattttccatggcttgctgagtactcctgtactcacccttgctctatataaataatccccccccagttgctgaagaagatgaagtggatcccgctgacgaggagttcttccaggagcaagtcggctacgatgagttttagggtttcggcctagttcccaagtcgcgcatgtgatgtgtgatccaagtcttggcttccgcttcccttttgtaatgcagttgtgagctcgggatctgtccgcagcccaacatgactgtactcctactctataataaggagacctctgttgctgtgatattctgtcttcctgtgataccagcactgtttcctgggactgatatcgattaacaggttaatttggagcgtcacgggctagtcccgctcggggctagttcggggcgtgacagtttttacttgcaatgtttgactactcgtcttattcaaaatttttttgcaaatataaaaaatgaaaagttgtgtttaaagtaccgtggataataaagtaagtcacaaataaaataaataataacttcaaaaatttttgaataagacgagtggtcaaacgttgcaagcaaaaacttaaaatccggggacagagggagtatatacaacacttctccctacggttgactaatgtgacttgcgataagattggctgacttagataatcacaaggtgaaaaggtcaaattttgcaatcaaagatgagctagctgccggccggtttaggcaaatctgggcagcaaagcccgttagattctgcgcaagattgcacgtgtctgcagtgagcatgtatccaaagccgctgatcgtgtcaagcttcactctcgatctactcctccaatccacaataaacaaatctaatacattcacgatataacacattgtaatgcaatatgattcgtagtactttccctaacgtcccatgttatgtatagttcattttgggatcgagtgagaattccattgaagtgatagtgtggtactagtactactataaaactatagaactatgtgtactgcactggaagcacatatgctcttgtgttgatctgaaggtaacacaagatagatggatcgatctaaagtatgagcaaatacgaaatcgcattgaattttatctgataggaaaaatcgcaatgaatcttgatccatgcaaaccagcacgacctccataactcaagtaaatggctcacaacaatctatgacctctataacttaagttcttgctagagggccgatcacagtggacacatggttctcttattcaattttagtactaactatgtactaactgtaaaccattaggcagcgacagtgaagttgaagttgctgcaggtggtctggagcccaaagaggaggccactgaagccgagctgctgcttctcctcgtcgaacaccaccaggttgtgctccatctggtgcccgccgatcaccaccgccgggccgtacccgaccttctccggcctcatctcgacgaacgcgaagcacgccgtggcgtcgtccacctgcaccagcgagttgccgccgaagatgtaccacgccgcgccgtcctcgaggttgatgttgatgtccggcacggcgtagccgagccggttcgagccgatcgtccggctctcgtagcacagctcgaacggcgccaccggcggcgccaccttcttcggccattgcaggatctcgtcccacgccttgacgaacgggccgtacacgtcggggcggagctcggtgtacggaaccatggagctcagctggacgacgagtggcgccccgtggttgggtagtggcacctggtggtggttcacctcgatgctcttggccgtgatgtagtacccgccgccattgccgccggcgagctccgggctgcggcggagcgcggtgtaggacagcttctgcatgatgtccggccgcgagtaggggaagatgaggacgaacgggccgccgccgaagacggcgacgctcgggaggcagagcgcgaacttcttggcgacgttctgcgtcgccgcgacctgcgcgtgcagcgcgaggtcggatcgcccgagaccggcgacgccgacggcgccggcggggagcgaggcgaggagggagcccggcgcgcaggaggcgacggccgggaaggtgaccgggtagagcgggttgctgccgttggtggcgtccgcggcgagcgcgtccgcgtcaggtcggccgtcgccgactcgccggagaaggggttgtacgggtgggcggtgcacttgcaccggaacgggtcctcgacgtcggcgcggccatagccattgtgggggcatcccggcgggtggtagctgtgcgcgtgcatgcagaagtggtggtggcactccagcgtcggtgcgcggcggcgcacgacatccagacgagcgcgccggcgaggtcgaggacgagcgggcggccgtccttgatggggacggtgtagagcgaggtcgccgcgtccttggtgatggccgcgacaagcggcttgccattgccattgccattggcactagctgctgcccatggcaacgacgaggccaaggcgacgcagagcgagacggcgaggaggaggtggagcgacattgctggttattagcctgggcaaactagctagcacgcactgtgaattggtgtgtccaagtgtgatggtttatat

SEQ ID NO: 57936 - DNA, 3165 bp, Oryza sativa
atgacttttaactttagcatctgatgcgatctaggccgcaagagagaagttgaagttgttgcagccccgttcttttactattaagattagattttaacttaattttcattagtatgtttttcaaacggttgaaacactgtgtcttatgcggaagctttttatgtaaaagttgttttgctttcaaatatattttgaaaaaaatcaattttaaatttataataataattaatactcaattaatcatgtgttgacgattttctcattttgtatgcctacacttaatcttacggccttatcttttcgcttgtgcttatgcttattcttatcagccaaattttgatttttcaatcttaaatttgaagttgattttggggttttttatcgaagtttattttcagcctttgattttatatcgctaagaacacatatatataaaagtttatttataattttttttttcgtttgtaaatacgtcgttttgcgatggggctgttaatcttcgtagtatacatttacgggtcaataaatttgataattcgtgtatgctgtagtgtgtcgtagcccgtaccacatccaacacttctcacaattgggctggaaatggaaaattctttttttttttgaagaggcgcggcccatcgttgcttcaaaacggcagggcaaagcccagcctaactaagtctgagttgtctctgttggatgtcaccttccggcccaaccggaagccctggcagtcgcttcgatttggggcactagactttttttagtaccgtattgcttaatcacattatggccgacctgtttaaatactcccgcacgtagcaattgcaacgaagcaatgacgaaaagcaccaacaccggcgggtccggtgtgtctacctgatttaaccattcgggacaagatgggtgtgccttccgagctttgacgattttttgttttccccttcggtttcaagctttcagcttttaccttctttttttttcctgttttccttttcggtttcaggctttcagcgatgcattgatcacatctcagaaatttctgagtcagtaacaaatctgtggcctttctccattattcattgaattgtacttgtaacaaaacacaactcataataataatgaaaaaaaaatggatgcacatctgatgcatatgtgtggaaaaaataaggatcactaacgtatacactatatagtcgatcgactataaccttcctctcttcctctgccctgaatgtcttagaccaccgagcagtggtgttatctgcacgggctacttatccaattcatggtcagatcgagtttctagttgaatgcagtgcataagagaaagctgaaggacataaagtttagaaaattagtaaatgatgtctaacagatctctccaacaagttgaatcctgacgacatgtctttcttatctgttgggtttcctgtttagccccatatgtgttgaacagaatcgtcttggcgaaaagcagttctcattcccaccgccggatcgatgtcctcacctagtctggaatttgaaggtctgatgcaaaatacagcagatgatgctaatgctaaattctcgcttcctcttggtgttttcaccagatatatggggtgctaaaaactggaaggtttttttaactgaaaggtcaatatgtcattcaggactttgtttccacaaaaaatgcaggacctgatggggttcatgtagcatgtgtaccagacgaacaccgctgtaaactgctgcatttcagcttgaattgcttgctatgtttgtgggactagttcaacaatccatggtttgacaggttgttagaattcatcagcagttacacttattttagaaccgagggagtaatcttgaacgtgatctttccctttctttaagggaaaaaaaacagtacagtgctagttcaaattaactaagcatgtgaatcacaaatctcaatcatctgcgaagtgtaccatcatttctgcctttccccccaagtggtagatactccttcaggtgtgcagggcaattccaccgcgttctgtcaattggactggaaaggaaggcccggcccatcgttgcctcagaacggcaggactaaaccaagcccaacatggcccataactgcctcgcaacgtcggagttaagtttagtaccgtactgctcaatcacattacgatcgaccattttaaatagttccgcacgtagcgattgcatcgtcaagcaatgacgaaaagcaccagcaccggcgggtccggcgctctacctgatattattcgggacagatgatgcaccttctgagcttaaaccccaatttttttccctgctttcccctttgcttttagcttcgacatttttttttcctgttttcctcttcgatttcaggctttcagtaacttcgctttaagctttgacattttttttcctgtattcctcttcgatttcaggctctcagtaacaaatctgtggtattctccattattcatcgaaatgtacttgttacaaatcacaactcataataataataatgccaaaaaaaaatgcatgcacatctccgatgcaaatgcaagctatgagctcgaggaatcgactcgatctaggcggcgagagtgaagttgaagttgctgcaggtggtctgcctcccccagagcaggccgctgaatccgagccgctgcttctcctcgtcgaacaccaccaggttgttctccatctggaaccctccgatgatcgccgccggcggcggcgggctgcccttctcccccttcaccttcaccaccgcgaggcacgccgtgttgtcgctcacctgcgccatcgagttgccgccgaacaccgtccagttcttgccgccctccagcaccaggtcgatctgcggcacggcgtagcccagccgcgtcgaccccagatcgcgcgagtcgtagcacagctcgaacggcgccgccggcggcggcggcggcgtgacgcgcttccggccggcggtggccctggcgaacgcgtcgaccaccgctcggtacacgtccggccggagcgccgtgtacgggatcctcgtgcacagctcgacgacgagcggctcttgggtgtagagctgcacctgctcctggttcacggcgatcttggtcgccgagatgaagtatccggggagatccttgttgcggtggaggggagtttcgccggcgagcgtcg

SEQ ID NO: 57937 - DNA, 5047 bp, Oryza sativa
aattgagtatcccaatgtcggtgatcacattttcgagcacgtagtacttccgaagtggtggtgctcatgactctgagcgcagagtgcaagcgaaggttgcttgagtgaccaaaaaacttgccaggtcgtgacagagttctacgcattgaaaacaacgagatctgcattgtttagttgatcccactagcatacaaatcggatcttggtcaatgcgcgctagctggaggcatcaaccatttccatcaagtcaaacgcgtacatgggttcgagaaattccaccccgttcgagatccatccaccggcgcgagcgccagatgccatccaagaaaatccccatgtttcgtgtaggattcgcgttgaaattgtagagatttttaggctctcgattgggcggagccctgtgaattccggtgcgcgcggccgcgtgttctcccgaggattttgaactcgatctgccaaactgggctcacgtggactctgctaggccaaaggcccaattgtacaaactgggccttttgtgcatcacgtcaggtagcgagcaggcctttgtgaggcccagatttcagggcccaaaacggccttcatttcacgttcaaattccatcctacggctaaattaatccaagaacatttcatcagcgtgtttaatccgatatcaatttcaaatgttatgaaatgataggcaaataaacgataaataacaatagattaatcacataaggcacgagatttaacgtgaaaaaccctcctataacataagagaaaaaaaccacaggcgtcagccagcaaaatatcttcactatatctgagcgaggttacaacgccgcacggcggcttacaagaggtatatatatatatgtggaaccttaaaagggacgatgatccgtatccccggcctaaccctaccggtgacgggacgatgatccgtacccccggcctaagcctaccggtgacgggcctccgctccactacgacataaattggcctctattaagtacaaataaatttggatcacaactcaacatcaaatattcgcatcacgtggaacatttttcaaatactgcatgtagatggtagatggactatatattaaaagcaaagttcttaaatgggtgacagatacgggcatatggcatgccggacaccgacattacagttacagttacatggccgcgaaacagtggtaagtaagtaaattatctactgagtcttggtgaaattgaagttactgcacgacgtgtagaacggcagcctcgcgaacccgagccgcttcttctccgagtcgaactgcagcaacatgttctccatctggaaccctccgaggatcaccgccggcgaactggcggcgtcgccggacttcatctccacgaaggccaggcacgccttgccccccttcacgtccaccatcgagttggtccccgtcatcgtgtagttcttcccgccggcgagcatcagcctcaccgccggcacaaagtagccgatccgcgtgttccccagcatcgacgccctgtagcagagcgggaacggcgccacggcggcgaccttcgcgtcgctccggttcaggcccttctcgaactcccggacgaacgggcggaacacgtccggccggagttggccgaacggcacggcggtgcgcagcgccacgccgccggcggcgagcgcgccgctcgggaggggtagccgcgcgtcatcgagggcgatggcgttggcggtgacgtagtagccggggttgtctctcttggcgacgagcggggtgtagtccagcgtcgtcgtgaagtccggcagcccttcgccgaggtatatcgggccgccgccgaagatggccacgccctggccgtacccgagcctcgggaggcagaggaggaacctgccggcgacgccctgcgacgacgcgacctgcgccgggagcgcgaggccggaggcggcgaggccggcgacgcccgtggcgccgcgcggcagccgcgccaggagcctcttgggcgcgcacgccgccacggccttgcggagacctggatcagagggttcttgccgtcggtggtgttggcgatgaacctcgtgtgggcaaggttcccggcggcgcactgcccggtcaccgggttgtacgggtacgccgtgcacacgttcttgctgcagtcgccgccgccgccggtgaccttgcaggtcggagcacggtacgcgttggcgaccacgcacgtcgggtcctggcaggacagcgacgccggcaggtggtcggcggcgcacgtcgaccagacgagcgggccggcgaggtcgacgacgaggttgtcgtagtacctgacggggatggtgtagagcgaggtggccgggtccctggtgacgggaaccaccacggggtcccgacgacgaggcgccgcggcggagcacgacggcggcgacgccagcagcacgagcagcgcggcggcgtcggcggcgaggacgaggttgccgtttcgtggcggcatcttgaacgatatgggtgatggatgatgaatgttgtacgtagctaagcttgtgtgtgtcttggtgcgacgcggccatttcttctttatttatagtacacgtgatgaagtgaagctgcaaatgccacacgttttgcaaccaggctggactccatgaagatgaagggagagttcggctttggtcacttggttaggagttaggacgcaaatctggaacttttgttgatgggaatgtggtacagtgggacgtttctttgtcacggacgttcccttctgttggattcaacgattgtttattcactgccgtttgtgtagggtaggaagttggtgtagcagcctgaatttgacactggggacacaggagatcggtttcagaattgcagaggcagcagcacacagattttgacactagtgagattgggtttgtttgccggttcaattcagtgtctgctttgaacttgaaggactgcaggttacaaatgtgcagtaagccgaaaaaataccttccaaacaggccggtcattcctgatctcaagaatttacaacgaaggttgtgtttagttcacgtcaaaattgaaattttggttgaaattggaacgatgtgatggaaaagttagaagtttatatgagtaggaaagttttgatgtgatgaaaaagttgaaagtttaaagaaaaactttaaaactaaacatggccaaagcagattgttccgatctcaacgaacgccataacgcaggcatctcgaacgcatctccccgatctctcaccacaacagcattgcaatctgcatcgactgcgaaaatctggattgattattgggggttcagacttcagagctgctaccatgtcggatcttgcgatggagtaccgagcaatacgcggcagagtcaacggcgcaaacacagcacaaacaacacaaagctcttaacgaaaactcatctcatcttctcgcgcaggaacagacagtgccgcgccgacacaagagtcttctccccaaacacgccacgggaccatcaaccttatcttctcactttgccaagacaaatcgaatcagatgcaatatggtttagtacttcaggacccctttcaatcgcaggattaagaaaacagagaaataggaataacgtaggaattgaatgccacacttattgaattcctatgggattttgaaacacgggtgtagtttgattagcacacagaaaaaacgcaggaaacttagacacatgaagaggaaaacatgaggtgagacctcatgcacctcatgcttatttttctccaaaattgctctagtaagattgctctagtaagtttcattcaataggaatttcaaaggaattgatagaaaacaatcctttgtttcaaaagactatagaattatttcccataggataaaatcctctagaatttctatggtttttccattaattcaaagggcccctttgaatcgtaggattaagaaaacatagaataggaaaaacgtaggattttaatagaaatgtaagagtaaaacagaggattgcaaaatgtaggaaaaacaaaggaatgaccgtttgattgaaccacagggaaaacacaggaattagatgagagatatagacttaaaggaaagttagcaagaggttgaagctcttgctaaatttcctctaaaatctctataggattgtccattccataggaatttcaaaggattagatatgattcaatcctttgtttcaaagggcttcataggaaattttcctataagattgaaatcctctaaaattcctatgtttttcctccaaatcaagagtcacagtttgactaccaaaagagaagaaaaaaagatactaatactatggtttacgtgttagagcaaaacgcattcacggccattcaagatatccacttggtcccaacactgcacaatcgtaatgcttgtatcttagttcaagcgaccaatgtctcaccaatacaagctcttattcaaagttacaaatggtcacgacaagttgacaacaaaaaaagcgagaattatatccttattttgaaatttgaattatagtggcaaacggtgagcccattttagtttcttgcgaagttgaagttgccacaggtagtcctgatgaagaagagggtgccactgaaccctagcctggaagcggcctcgtcgaacagcaaaaagttgttctccatctggaacgcgcccacggtcaccgcgctccgcgccgccctcccgccgtcgacgaacgccaagcacgccgtgtcgcccgccacctgcgccagcgagttcgacccgaacaccgtccagttccggccgccggacgtcacgaggtcgatcggcgccaccgcgtagccgaccctggtgaaccccagcgcgctgctgttgaagcagagctcgaacggggccacgctcggcatgcgcgttatcctcgccgtcgccttggcgaacgcggcgacgaacgggcggtacacgtcgcgccgcaggacggtgtacggcgcggccgtgtcgagcgtcacgccgccgccgcggctgagcgcgccgggagggaggtggaccgcctcttggttcatggcgatgccccggagcttgatgctgtacgccgaggggttcgt

SEQ ID NO: 57938 - DNA, 710 bp, Oryza sativa
attagacatcacctagtactatgaatctgaacagaccttaattcgtagtgctaggtggcaagtggtgtctaatcgagtattaagtcactatattatgggacgggtggagtacatttcttttgcaggcgccagcccattcaccacatggtttgcactgcagcaggccaatggtccatagatatgaacgctgaaatcctgatccctgcagctcacaagatctgaaaaacaaacaacaagaagaagaaaaaagaatcaaaaatcagaaatgtaatagtaacaaatataccaaaatctccagtctgattcctgttcttcagttagtgcctcatctgaacttatagtattccaacagccattgatatacaatctggtacaccagacagacaacacatgccttgcttcatcccaagttgccggagaggtttaaattacgggacactatgatcatagagtatactgctgaccacagctttgctgggacactggtatctgctgtctacatccatgtctgaacattgtatatgcatacgcctgtacctagtcagctgctggtcgtcgaaacttgagtgcatattgcgtctcagctggggcctgggagatcagcatgagattttgtgttgcagaggacagtacttggatctacaatgtacgagtacagtacgattgtatgatgggcagtacattggcctaactcagcagcatgaactggc

SEQ ID NO: 57939 - DNA, 14584 bp, Oryza sativa
cctctattctaggtactctcttaatttaataaagtattactttaatctgtactgatccttcaatttcgcagcattcagaactggatagaggacttgctatggaaacaacttgatcttgactaccctggtatgcctgaagcaatggtgagcaatgttagcttcagcattatgagttgcaacattggcagaccaaattcattttgtgctccacctcaccataggtacaccgaggattttattctgcttatcataacacaacaatgcgagatggagttgtcagcggtattcagaagactcgaaaattgtttggagatgttccgatcatggtaacagggcattcaatgggtggagctatggcttcgttttgtgcacttgatcttgttgtgagtactgcatcttaactgaattcaatagtgttcacttttagctcctatatcactttctgtttagaaaattacaccacatattgtttctctgcttagttttgtgcaataaattataaacattttattctccacatctgacttcacataaaagagagaagtgttttattttgttggaatttggaaacaccttcttccatgataatactttatattctggtcaaatggacaaatagtctgcgaagctgtcgagcctttttatcttcttggagccgatctttcatctttcctttgccagcctagtactaattttcagttatgtagtagcaatctacatctatggtcggtttgtaggtttccattccttacttacagtggcggagccaggatttctcgaagcctagggctcaaaactaaatactaagctatggtcatttccgatgttagaatgatatttttagcggtacgagaaacaagaaagcttattagtgtatgattgattaagtattgactattataaacttaaaatatatatttatttatatatttagagaaacttctatattgaaaacttttgtatgagaaacactatttagtaattcaaaaaacatgcacatgataaataagacattttttcagcccaaactcacttaagaactcagcctaaagctacccaaaattcctatataatatctctgttttcaaaatatagcaatttttagttacgaatctaacatagaattgtctggattcaacacttgtccagattcgtaactaaaaatttgttatattataaaatagagggagtacgttaggtgggctattatatattctcgacctcgtaggatagagcacgaggtgttcctacagataggcatatttagcaaatgtatcacctaatgctatcatagaatgaggttttgtttgtagaattgttgggatacatgcctcctttgccggtccaaagaagtatagtagtagtatggactagagagttcggcaattaaaataggcctccaagtaatggtagtgagggatagaatcgatctaagtcccaggctggagtatacgcgtagggctgagacatggaaggatcaaaatatctgttgaattttcaggtataagaccgttaaattttttcccacgcctggggctccagcccaagttgccccaggcgtggttccgcccctgcttacttacctccaggttttgcctctacagctaaacaggaattctgttttcttttaggtgaactatgggctagatggtgtgaagctaatgacatttgggcagcctcggattggcaatgctgcttttgcttcctttttcaagaaatacttgcctcacgcaatccgagttacccatggtcatgatatcgtgcctcacctgccaccatacttctcattcttcccacagaagacctaccatcatttcccaagagaggtacgatacactctacctgtctaatatgcttacctgaaactcaataccttgaaccatatatgcattttctgacgagatcaattgcttacagacagtacacatgcaatcttactcatcttgcatttccataatttcccaatgcatgatgcagtgctgagtgctccttttcaatatggttctatcaccttgacgtaatcgaccgagttcaataaaaatcctcttttttttatctaaaaaagatgctctttttcttcaggtatgggttcataacgtcggactaggaagcctagtgtactcggtagagcagatctgtgatgattctggtgaagacccatcgtgctgcaggtactacccctcttcttcttcttctccatatgcacaaacacaagcagatggggggtgaaccacacctcatcatctcctctccttttggtgaccctgaacctgatgagctcttcatgatctctctctttctttgacgccactttcacctttcaggtctgtgagtgggagcagcgtgcaagaccacatatactatctcggcgtcagcatgcacgccgaggcatggagctcctgcaggatcgtcatggactacagcaagctgcgttaccggatggacatcaatggcaacatcgtcttgtcaaagcatctgggtttgtcaggtgacctagaacacagtgaccaatgattcaaaatggaacagatttagtataatggtagcttagatgtgttatattattgtacagtactactacacgtgtgttcctctctctgatgctcatatgtgtcaaaattgttcatgcgtcagaagaggattgggagatgcttgctgtaaatgtggtttggtaatgtgaagcattgttcagttcacaagtacttgcgttgttgcattacagtactacctccgtttcatattatttatcagacgttttacttggtcaaacttgaagaaatttgaccaagaataaaatccaaacatcttataatatggaaaggagagagtagcagctaagcatcagatagcttctgcagatagcaacaatgcgaagagcactgccacaccaatcagatttggtttgatacagctcatttggctttgcaagatgaacacatgattgactactactgcaaaatattacatgtacaacacattggctctgaaatagcttgatacagataaaaacctcttgctgcatgtcgaacaacgttcacgctaagatacatgagaggtacagtaagctaatacaaataaataagtgctcaggcaactcaaaagaaaagaaaagaaaagaaaaaactgtacgaaacacaggtaatgtgtcctatctccaaacctgaattctcatcggaagtaacttcacgtcctcaggtagccaaacctgaaatgctgtaacattcgtaacacaggtggtgctgagcatgagcatggcgatcaggtaaccaagaaaaggcattcatcaggttcctctcttctgttgcctacctttccagctgaattttatcggctcccgaacggagccgaactctaaagacacatgacacaatcacattcacaaggaatggacgccgggagatctaagacatgtcaaatagcaatgacatagtgaccatggagtggcactgatggccggggaagaacaagggtcttattcacagataaagaaccgtgtggaaccaatgcaatgttacttgattggatccgtttcgtgtagatgagcagattcatcctccgtagactgatttctgaaacaaaaaccctccgatttactcatttgtactatcaaagctgccatgaccattcggatgcttccgttctcgagaattctccccccacgttttggcctctgcaatagcacgctgtctatcagcagtccttggagtctctctttttcttcctgtttgagctggactacccatctgcgaccctgtcatgtctaaatcatccaatcctgatctccggccagaatcaccggtagaactagtcctgctaacctctgctcttgatgacctggcagcttccctcctcagatctggagaatgatgatttggcgagcgcacactgcgtcgatcttcattccacccagctagatttctggccctaggagttgacgaattgctcctgctatgttgaacaggggcatttggatcatatgtctgagaagctagatatgagagtgcagtgacaacatctcctatatgagggcgagtggtagcttgctcttgtaaacacatggcagcaacagctaaagcctgatacagacccctcatagggaagcgaccttggagcattggatcagccattttagggaacttcctgcggtccttgaatagtggacgagcctgcaaacagatgaaatgtattgattatccaaaataaaaatgtccacgaagtttttttttcaattaagattgcattagaaactggtttcatttacaaattttgagcgagcaacagaacatcatttgtaagagaatggaacagctgaactataatgccccccaaactctcaaaattgctaaatgtttgcagccatcagcaaaattaccaaggtggatggcaaatatcggtatcaaaacaacaacttttcctggccacaaggaaacaatttggacacttggaagtaaaggccatccatgatcaaattgttcatgagctagcacaaacactacaattatttgttgtgtgattgtaaagaaacaggtgggtggcatcagtttgattggcgggattgtatttcactaacagtactaaaataaaatgctgagatacatgtaatgcttttattttcaaaagaagaatgcatacaatgggtgtcactggcatatatttattatgcatttatgatgcaagtatagtataaaaacatacccatgccactaggttttgctccccctgtggctttgtgttgtcaattgctttgcgccctgtaatcagttcgaggaaaacaacaccaaagctatagacatcggatttcactggagctgcccagtcattgcatattctggggcacagtagccataagttcccatcacacgtgttgaaacatgggtcttgtcaccaactggaccaagttttgcaagaccaaaatcagacagcttggggtgaaatccttcaccaagaagaatgtttgatgatttgaagtcacgataaataactggcgggctcgccttgtcatgtaggtattctaagcccttggctgcacctgcagctatcttcatccgtgtgttccagtcaagaggttccttatcaggtggcaaatctacaaaacagaaattggaaaaccttttatcttcatttgaagctgccattgaactttaaacataacaggatgccattaaacagctgtactaactaccaagtatagtacttcacaataatgcagtactactactttatgtacattgcttcaagcgcccatggactcttgcaagactagaaaggcaaggagaagatagacaaaccatgcaaatggtcttccagtgatcccaatggcataaactcatagacaagaaggcgctggtcaccatcagcacaatagccaattagattgaccaggttagtgtgatgtagaagactgagcatgaggacctcaaccaggaattctctatttccttgaagaccattgcgatcaagttgcttcacagcaacagcctgggaagtggtatatttcattagtgctccagggataaagcaaaacagcaattctgccaacattttactgaatattaactaaatcgctgaaaacctaaacttcaagtatttagtaaaatctcaatagatctagataggttaagaaagactgacctgcccagtctccaggcgtcctttatatacacggccaaaacctccctctcccaataggcaatcttgtctgaagttcttggtggcggcagcaagctcacgaaaagtgaacgtctgtgcagcaatattttggttgttcccatctctttggatgacaacgtccttcttagagtctaatccaccatgtgatctcgatttatctaagaagaaaatgttgtagagttagtaatcagttcttttttctttttgaggggcagagtaatggttgtgtgctatcctctgagcattaacactcttatcagcagaaacataaaactaaatcagtcatttaaagtactgtatttagtacactttactactcgatagaagccaacgaagcagatttcaccgatccatttgtgaagcaatactcaaagcataaacagaataacgtaaagacaaagcatgtacttccaataatccctcccccaatcagtttcatgaagaaaagatccacaatgaactgtcctaggtcactaaaatcaatccttattatatcatgtcaaccccaggtccttacagataatttgcaacatgccaaagatgaaccagctgccaaactggacaggtacgatggccaacatacccgcaattcgtatactcaaaaaaacaaaatgaaatgacacctacatatttgtatattcataaacagtatcgagttcaaggactagtaaacaacacatccatcactttctacccccattgttcccacacaaatatactatccagcctaagacaacttcaaaatgatcctgagcctttacccacacatctaaacaagacaaaccatcaaaatcaacactatatattcatgaatctcctaaaattgccaggacgatacagattttcttaataaaacctagccatcctagccacaaactatggcaaacaatgcattcccctatttttcctctctaaatgaagaagaaagcgtgcctgagcctaaatacagcctccaagcttactaacacgacagcaaccctgcacatttgtctaacttaaatcaccaaatcatcgttcgcgcacagcaaagcagtacaaacacaacatgaacaggaaaaccacagcgccacaaggcagcagaaggaaagaaaaaaaagaacatctgaaagccgcagcaaaacgccgcgaaaactaattccaagatccagttgtcctccacgcacctgatccgaccctggacaccccgcgatccgcggagccgtccttgcgcgcgtccttggagtcagccccgggcttcttggcctccccctcctgggccgatccgaagcacaggaagcagctcatccaagcagaaccttccccccaaaaaaaaaaaatccaaactttcgcttcaccaccctccccgccgcagcaagacgaaatggggtgttggaccccctccccgatctgagcgcacgaacctccccaaaatcggacttttaagcgggcggcgggggtgggagggagtggggtgggggtggaagctacaaggaggaggagaggaggaagaagaagaacatgaggctagggtgcaaagagaaagacaagtagtagtagtaggagtaagaagcaaaagtcagctctggggcagagtgaagaagagaggagaggggaggggatctttgggggcacatccactttcctctcctgcctgccacctcctcttttaaatggcaagagagagagagagagagagagagagagagagactctcctcttaattatggcccatgtttgcatcacccccactcactggcaggccctgaacaggtcaagctctctttttttctttttttcttttcaggcttcacaaatgtcatattgaccatgacctctccagtaaaaaatttcacatggatacaacgtttcagaactcagaaggcaaagtcatacaagaaacagagtttcatgggttgtccatattccctgataatttgccttcatggcttgtccatattccatgataatcaagacggtttattaaaaaataaaaattaatctttgagtaaaactcttatatatttttctagcgatttaaaagtcaatcgaaaaagaaattacgttgaaaatattttataatcaactacagtattaagttttaaattttaaattttgacttttgctttggcttatcaagccaacctatagggcttagattggtaggtagtttcagtaaacggctagtagaatttcgattttttaaaaaatacagttaagatgtgatagatgagctggtaaagtagtagaaaaataaatagaaaaaaaataatttagaaataattcatgaagcatttcgaaaagcaaattcatgggagaacaggactatgtaattcactaaataggcttggagttacggtggtaataacttatgcgttgagctacagctaataatagcagcaaaataaaaaggaaaaaaataatttataagcaaaatttttatatttgtattatattaaatgaaaaaaatcacttgctctggtgttaatgtacaatgtcgttaacttttatgatttttttttcttgtgattatatgttatttaagccggatttatattttacatatttatataatattttagtaaaatatatagttaaacgcacgttgaaaagttgatgggggctattcagtaatgctaacggttgtagcttgcgaaccagctgccagccacgtttcatattgttgcataagccagtgtttccgaacagcctcagtaacacacatacactaaaaaggaaactagagaaagcagattttaaatttggactttaattatgtttgataagttactacttcctccgatgttaatgatatttatctagattcattaacattaatattaatgtaaaaaatactaaaatgactcattgtgatacggagaaagtaccaagcagacatccagatcctacgataaacagctcgtggacggttggccacgtcgacgcctagtactagcgtagcgtctcttttgggttgggttgggttttggtggcgtcgttttcgtgggccgccgaggaagcaggaggggtgcaaagtggcgccacgccacggattttgctgttccgttctgtcacgacggaaacggcgcgctccacgcaccaaaacgttgctgacgtggcacgccccaccaccaccaccgctcgatcgggtcggtgtctcgaccgctcgatccatggtgtgtgtttagttagggcctgtttggtataactccaactcctaaatataactccaggagttgagtttagagtggagttatggagctgcctaaacccagctccacaactctagtacattttgtgagagagctccacccaactccactcccagttttagtggagctgaaactgtttggctgagctccagctccaggaggggtggagctggagctggagctgtgccaaacagggccttagtggtttagtttgactgcgtgcctgtctgtattagtagtacgtgtacgtaacacgagatttgatcgtgtcgtggcaggcgttcacaccgccccgagaattttctagaaattgatcacgccggcaaaccgtccaggacgacaggtcagcaactgctgcttctgctgcagtttggtacagtacgtgctgaaatttgaaaaaaagcaatcacaacgttaagttcatgcttcctccgtctcaaaataagtacaaccgtaaatatccatacccaacatttaaccgtctattttatttaaaaaatttataaaaaatttaaaaatatttagttacactattcatattttatcatctaatagcaataaaaatactaatcataatttttttttaataagacgaacggtcaaacgttgaacgtgaataatacaaaactgcacttattttgggatggagggagtaataatcattgtattgaaatttataaaagtgaaaataattatactatgaatagataaaataataaatggttacactgggattggataaagtattagtattcttatattttgtcttttcgtatctatattagtatatgatggataaaattaaattattttgagacagatgtagtagtttatattagtataggatggataaaattaaattattttggggcgtagtacgcggtctgtatcagagcgtcacagtattatgccgattgtgattggtcaggcggttaatgatgcctcacggggagagataataccgataagcttgtgcgtgccactgcactgggcctctttgggttggaccgtgcggtgcggcgtccgatctcggatggcccagtccatcgaaaatcttggcccatctacgtacgtgacagcccgagatgttctgggcctgataaaacgggcagggctctctcattctcacgtggccaccgaccggcgtctcggtgttgtcgtccatcagcaacccgacgacacaacgcaagagcatcgattaatcatgtgctatactccctctttccaatttccccatggttttatgtgcgcatgcttctctaattcttaaatgttttattttctaaaaaatttataggcaagttgctttaaaagttcatattagtttttttaagtattattagtgatacttaattattcatgtgttaatccgacgctccattttacgtatcggaagaaagggttctcaataatccttatcttcaaacacatcctggttggcatcatccatactctctccttttttaaaaaaaatgagtatatttacaaaactacagttattttagctaaattatcgtaaaactaaaattttaaggtgatgttttatgaaactatagatttaacactaaatttatcacacaattatatatttaagacgaagtatagcaaaactacatatttaataacaaagttatcacaaacctatagatttttgagtttaaattcttagcactagtgttatgtttgagttataaacatctaagttttgtgattaaattaacactaaatttatagttttgtgattactttgttactaaatttgaagttttacgatactctatcttaaatatgtagttatgtgcaaaatttaatattaaatatgtagttttgtgataatttggttaaagtatatatagttttatgaaatttactcaaaaattaattcatatatatgaatataggcatgcactgtagtacttattcatgtttatattttgctaagattcgaattttttgaaccgagggtgtacgtacgtgcagcacgcgggtatatatataaatacacacgtgcaacacgttacgccgagtgctaattggaatcgctacgaacaaagctagtaaattactatagtacactatataggattctatgtgtctgcaacaccaaggatcgagtcacacatcaacttgcatctactactgtgttggattccaagaatatatctctctcgtatctcgatctcgctatgtactccctccgtttcacaatgtaagtcattctagcatttctcacatttatattgatgctaataaatctagataggtatatatgtcttagattcattagcatcaatacgaatgtgaaaaatgctaaaatgacttacattatgaaacgaatgaagtatatcttttcaccaagtcgatgcgccacgatttgtgaataaaggattactctcacgaatatgttctacccctctagctgcatgtaaacgaaaagtgagaccggtatgtaatacaatactccctccgtttctaaatatttgacaccgttgacgttttagcacatgttttaccgttcgtcttattcaaaaacttttgtgaaatatgtaaaactatatgtatacaaataagtatatttaacaatgaatcgaatgataggaaaagaattaataattacttaaattttttgaataagacgaacggtcaaacatatttaaaaaagtcaacagcgttaaatatttagaaacggatgatatcttaaatttctcaaaaaaattacaaatttaatgtagagtatcataaaattgtagatttagtaacaagtcatagccttatattatagtgcactgtgacttgcgctatatatcatcaggtattcagcacttcaatattttttttaaaaaaaacgcacaaaaaccttacacacgttaatatattagacacctcaataattctcaaagatacactataaagtatgacaaaatagagagctaatttggcccaacttgactctgagaattacctagtagtaacttttttttgcaggtactataacatgtcgtgagaatttgtttcaaacgtctcagatcgactccgacaacaaatctaacaaaatttgacactgttgttttcaggactttgccttcgtaaatgcagggcaaaggatcactggatcagtatatatggtgcgcactgcgtaatttgcatcatggcttcatgggacacacattgagctactaaacccttcattaaatctagcggctacttttgaaaactgaaaggcattagccgacatatttgtacttttgcagctagcactgacatataggagtagtttaagttaaccctttctctggtcagactactttgaattaatggcacctaattaaagcctaaagcaaaggatcaaagctaatgccttcagctcttcatgataattaagtagtacactagctaattaattaactaatctgatctttctgaccagctgaacacatactcatcacttgcaaagcactatcttccatacatatgtacgtaggtagaggtacaactgaagatcatatgcatgtatgctaattaatctgacagatgatctccccaaaattagttaattgcctgcagtactgatgcattgtgcatacgaccatcagtgaagattgatgacatgcatattgcatgtagcagaattaacagtagtaagagctagttatcgccattaattaattgatcgatagttaattaattgattagctggtagtatataggagtacttcgtatctctgagccagagggcgccggcttcgcggaggagcgggacgagcttgccggcgaggtggagcgacatgacctggtcggtgggcccgacgagcttgccgccgatgaagacggccggcaccggcggcgtccggccgaccattccggcgagcgccctctcgacgtccttgccgttggggtccttgtccacctcgtgcaccgcccagctcaccccgagctccgagaagagcgtcttcaccacgtggcacatgaagcagttgctcgccccgaagatcaccaccgccctctgcgacgacagccgcgccaccctctccgccattgccaacctctagctctcacttcgcttcactctagctcgatcgagctagatctatggagactttcgaaaattctttgagtagttttggttgtgatggtgatgatgagagaaggcgcgatgcttatttataggtgacgggaaactgaaccaaggaagaagaagagataataactaattaagggctcgttggcacagctttaacttcagctccacctctccagctaaacagttttatctccatctaaaataagagtggagttggatggggctctctcacaaactgaactagagagttggagttgggtttaggccgctccacaactctactatagatctaactactgaagctaaatttagaagttgaaactctaataaacagcctctggcactgattgggaatgttgtgcgcttattagaggtttagtacttggatttttttctctagctttgcttttggccggaggggacagcattataaaagttgaattatttatttgattgaaatgggggtatgccatgcaaattgaggttttactatgatcaaaatatatatttatgtttttgtgatgaatagaatgaaatgctgaatagatggatgactttgtgataattattcgatggtacagataaataaattagctattataaaaagttaaaagtggatttaaaacaacattataatatgtttaaatataattttgtttttttaaaaattgtactgtttataaactcgggaaatgcacatgctaatgttattgcaaaattcacagcgctccattccattctcctaaaacaaaacacgaatattaggaaatgatttaatatcaaataattataaggataaggcttcgaacccagaccaactagcccatcttcttgtggaactagccggaagacttctaaacgtttctgaattttaaaatgaggataataaggcaaattgatctatatatagagtagcaaatataaaaaaaaaatgcacaactagctaagagcagatgcgcgaaccaaattaaacactaatatttgctggacaatctataaattattttacaacacatttgagcttaattaatcgactctatcggataattagttgcctgcaatttgagctgaactttatcataccgtacagtaatgtatactaaattaacctagagatgccgataaggtttggatccgccctaattgcttgtttttaccattttaacaggacgaataatgccctctgggggtagacatatcatgaagcacatttttcatttttggatgacattggaccaaaatccttttgtttaatatcccactttatattttctacgtgtccgcataacagaaccaggaatttccacgtcaatgccggaataaatcggcagggttagtgttaagcaatgaatttcaaacgccaagcatccactcaaagaataaacgaatcctctggtaccctttacatgtcgggagaatatataagcctactaaaggagtagtaattaattaattaagcaggttgtaaccgccctatctgcctttctaattatcttccactaattaatcaggtactgtgtgatgatcgtgttgaattgacccttgttaaatttatgcaggtaaacaaatgattgatattattcgatctctacttctaaatgaagaaattaaagagaagaattttggttattccatatttcagaag

SEQ ID NO: 57940 - DNA, 2142 bp, Oryza sativa
aaaaatctgttgcaagtgaaatagcaaaaccgtttaggatagctcatctttttcttgggcctgattatcatgggcctttggtccagttccatgtatgggctagtattcgtgctacctatatgggccaggcttatggctaccaatgcggcccatgtacgatgacgtgtaccctattgtcttctactagctctctccccctctactaccttccttactctgcccgtgaagagagagagagagagagagagagagaaggggggaagaatggcgtcgcgcctcctcgcccgatccaaagccctagcgctcgccctgtcccgcgccgacgcggcggcgccggggcccgccgccggagtgcagtggctccgcacgctgtcctccctcccccgcgatccggccgccgccgcctcccccgcccccgcgccgcgccaacccgccgtggggtcccctctcggcctctccaaggttgacctcttcttccctcgcttcgtctctctctaggcgtatggattttgcgagctgaactagctgtttggatcggatcagtgtgtgtggcttgtttggggtgatgggtttgtaagcgagatgccctagtccacgcgcgatctgtaatgttttttttttcttaattgcatttttattgtttggttctgttgtgttgtgcttagattgatagtctactagtagttctggtcatgcttttagttataatctaggtttgggggagataggatgtcgtgggaaaatggcgaagggaatcagttgggaacctgggactgtagcagcaagtaggccattctcctgcttcaccacccgctaagttcatagcaacatatggtaaaatggtatttaccttttgttctgattcatcgcgttaccaggctcgttgaattctgggatgaaaaattgggcaaactgttagtacgattatcgagtgagggaagggtggagtcatgtatctgctcacctcttgtgtattaacctaagtctttatttttaatctttgcatatcactccagttagttttggtagttttttcttggccttcatgattgttttgtttggcttcaattgctgttgatgagccaatgacttggaatgtagctaataaatctgaaaatagaatagttccttgacacaaaaaaatcccttggttaatctcatcactatctgcactagttgttgttggaaaatgttatgtcctctcactggtatctgaagatattgcaatttgataccatgcttaagtggttcattgtggtgggtagcacctgctgataatttagtactgatgattatgcaagatgatctttccttgtgggaatagctaattttatttggcgccatccattcagtgcttattgtcttcgataatgacatctttaagagaatcacattgtgaatttgtaatgaaaaattgctgttcgtatgtaacttgaatacttctgttctcattttcccctagttcaatgcatgagtttattgtgttcctaagaacttgtaagggacttttctaatgttatcatatgcaaacagattccaggatatgaacagacatctcgactcagtggtacacaagtattgcctcgttggttttctactggaacatcaaatggatcttctgctcagcaggtgcgtatctatccctagtgcatattatataggcttctgcatttattggattgttttcactccccaccagtcaatgctagatatttcttactatctcactgacatcacataagacaattactgggtgacacaatctgatgcgctgaatacacagagggaagccaccagaaaggtaatggcattcagcccattagaagcaagcatcgcctacccagaaaaggtccatgacatctgaaagttgaaaagtgaagcagacagagctattaacacgatctacgtattacatgatcccaactctgcttcttgtatcaaagaacagcatcagtacgtctcttctggtcgcatcagtattccatcaagtctacatgttctacaaggagatccttctggactatgtccatcacgatatcaccaggaagtgggttttcatatacttcaagattctcctgataatcatggccaaggaaacagttgtctacttcgatttattttaagttcatggtagtttcttga

SEQ ID NO: 57941 - DNA, 6975 bp, Oryza sativa
gatgcagtgcagtggtccaagtttaagcaatcataaccttatcaggtgcagggggcaaattgaaaattgaatttgaaacatcaaaaacatgggatagataaggactgcttggcttctactggacacagtacactcatgaaatgcagaaaagaacttgagctcatatgcacccaagttatagttcatccatctatgcactagcaactgcaccaaatttgtgaaaaaatatggtctcatatgcaatgtatatacaaatgacttttgtaacacccattttctttttgcaggtcaacatgtcattacatattgtcaatgtatatatattcttttttagaatcttttaaactgtagaaagtatgatgggtgcacatgaactcgaggtcataaaactgtactcgtaatgatcctagcttaccttcaaacagaggcctgaaccctcttcctcagaaatacacagatagtgaatcagtctcttcatttccttctgcacagtttcctggacctacaagataacacatataaacagtgttcagaaactacaaaggaagtaacactgcctcactacgtagttctattgaagtaggttaccttagcaaggtaatcttgcaaagggtattgcacaatccattcataacttttcctggagtagtacaagtatgtatcttgaataacagcacttttcagcttggttttgacttcagaacgacatatgccacgcataatacccatcaaaagatccatatcaacattgcatccatcacgctcttggcgaatctgggatgaattaattgttatgcacagaaggaatgcagttaaaagggtaataaaatgtataccatgtcagattaccagagtcagtagaacatctgatatttcattattgaagtaggaaaagacctggcagaaggacatgatcagttgtgtgtacagaaatagatacgtaagcagattattatcacaaatgcacatggaatattaactaaaagaattattgcgtgacactcactggagaaaagaaagaagtagcagcagcgtcttcaagcgaaggtagtttcttatgtgtaacaaagcagcggtccaaataggccaaaaagccagttgtgaatctaatcatggcacaatagtttgaccacattttcacaagctctctccaaaataagtcaccttgcttatgcatcagatggggtaaaacctaaatacataaaataagtgaaccaagggatagaacggccgaactctcttctccaactaaaggaacttgtaacacacaagatgcaaacagatacaatcatatgttaataagattttatatgtgagcatgcctgtttcacgtattaaattaataatatgtgaaatgataataagcatatcaaataataacacatattagtcaaatcaaacatgcctgtttcacaacagcagaaggaccgctaagttgctatcttttttccatgggtaccgatacaatcatatgtgcatgtgagcttcatttttatgggaggcatggtgtacaagacctaacttccctaggcctaacagcagtacatcaaacaatatgttaataagattttatatgtgagcgtcaagacagtgagctgtaacaacagattttacaacagatgatctatggaggtaaatgaagttgacatttcattagattcaaattgaggatttcaatcatcattatgcaacacaataaacttacttggctatgtctagaaatatgacattgtggatttaaaaactagcaacagtctagtactgtagtaccattgcacagacgcaactttcatgtgttgctttgtaagaattgtacatctcttgacaatactggtctttctgcacagccatccggtaagcgcaactggaaaacatagaggaatgtatgatgagcagcaagtttttaataccatgtggataaccgagaacatgcataatgtgcagtggtaagatagaagcatactcatagtaattcatgtactcattcacagttggccttccaccagggcaatcctccaaaagctttgagcatttcacaatcccctgttccaggatcttccagccatcctcaaagcggaggtgctcgttcatttttactgctttgctcctgcaatgaactgaagcgatggaaatatcaataagaggaatcgatttttatgtatccagcaatgtttgttatgcaaggggattcagagaacgtagaagttttatacaaataggcaaaataacacaaagtagtttcttattaaaaatttcaataatgttgcatgatgacatgaaaataatactcctgtttttcttaattcaatagacagtagcactcctgagtagtatccaactacaaatttcatccatgtgcagtatgcgacacataacaatcaacctgtcatgtaccacaaaccctatttccatccaaatcaaggagctataaaaatgatgtcatacagatagatacatataaaggacctaacaacaattcagcatccatgtcaatcgttacagtagacagaggacaacctaacgtaggggcatggggattaagccgatttccaaaaaacttccgaaatgaacaaaaccaccacgcatcaaacgaatcctcaacaaactggatgactggagagaaaaaatatttcgattagatagcccacaccaaaactcaagatgagaacccacgcaagacgaaaatattttgattagagttcaccaccaacaaacgtactaacctatccaaatccatcccctcagcgatggatcagtggtgcgcacggggaggcctactcgaaagcctttgccggtgagggatcggtcagactaacggggaagccgatagccgcgattcatccctacgtgttgagcaccgaagaaggcgaaggggcgagggctacttcctagaaaatctcgcataacctagggggcgggcgggcggcatccacctcgccggagaacgcccatcggattggatcagattgctcggaacacaacccgattcaaccagattaggggggaaagcgaaccaaccaaccatcaatccaatcaaccaggaactcgagggggaggaagaggaggaggaggagcttctaaccaggagaagtgcgccggtgaggatcgggtcctgatcgccgccgccgctgccgccgccgcgggctctcgtctcgcctgtcgctcgccggcgattggcgaggtcaagcgggtgaggagggttttgaggggtttctctctcttctcctccgtcgcaggtgggaacgcagataaaaaggtgggccccgggaggcagtgccttaacgtactatattatcatctccacaatccgtatttttcgggacaaaattattttctgaaaagatcgctttatgtgtagtgctctaccatttcctcctcatttgtttattactactagtagtagtatagataaattttgttaaaataattttatttctctttgagatgaaaaatattttcgctttagatggattattatctacgataaatcagaaatggattaatctcgtcgagaaatattagagataaactttagcaattactgtattgtactgacatgttcttaagaaaaaaatggctgaaaaatctctgaagcccataggtgagaaaaccttatgcggaccaaattcatctttaggcccatatatctttctgaggattcataggcccatatatcttggacacgctttcagcccaaattcatctcattttctccatgggctctgcttatctgccgaattcgtgggcttaaatctgaactgccatagcaatgttcagaggaattccatgttcagataacgagttgcagtagaaagttctgaagaagtctgaaactctgaaaacccatgtgtgttctactactgtttatactatggcacatgtattaaagttttaagcactgtgctaagcatgttttcttacatgctcccagaataaaacgtggcctcatcatgagctgcatgcattgcagggccgtacctacctactgtaccttacgtgtattattgccttggaattctcacattaatttcgccaaagctttttctctgaacctgttctgaacagtaactgtaaaccattacccgacgtctgctgctgctgctggcgagtgacgaaaacgtgctctgctgctgctgcctttgtccagcatcttcttcagcactgcaacagttgacagatttaaggccatcgaatcatcaaccttaattcatttgcagttgcagggatctctgtcacccacattaattctcacatcagtgcagtcttcactcgagaaatcaaaacctgagtgtataaaaacaacaaaactcgataagtttcttactatctctgaaactctctcttctttctctgcatcacaagggggatattctcttgaggtgaagagaaatgcagggagagaggaaaaacaaaaacaaaaaaaacaaaaaacatcattttgaatgttcagtaatgcagaattaacttctcttctggtgatgcataactgtcgattaaatggatcattcaaaggcgcaaaagtgacgtcgtcatcgtattccattgttgccagaggtgccacgaatgatggatcattcacctggtcaatgtttaaattactcctacatttactctgcctctgacgcctctgtcgttcttcgtcgtcgtcgcctgcagagcgctggccgcgcggtccctctcctccggcatttgcagagcagattcagcaaaagtttcagaaaccagctggtggacggccggagaaacgcatgccgacggcagctagcgaccaacttcatctgcgtcatctgtctttctctctctcggcgtcatggagtgtattagggggtgtttgggagagagtagcccctctctcaaaaccataacagcttgtttggtaacttgagggaagggaattgggagtttatacgagggaattgatggtgatattaaaatgggaatttgatttttaatcccagtatcttatttggtagaggtggtggaaattgaaagggagtttagttggagtttaggtcattaatgaaaatggatggctgagatttgtttaggcaaaataaaggagaaatttcctcctaattacctcccctacccatgtattgaaaaggagggagtttctccctcaattccccatccccatcccaccaaaattcccatgtatttcaaccaaacaaaacagttaatagcctcatccctctaaactctcaatccctcttaaaagctccctccaaccaaacagccgtaagtccctaggggagggacttatttttttgagtttagcccctctttcccaaacacccccttagggtgtgttcgcagtattagcttttttttttcaaaaatggattaatttgattttttttaaacaactttttttaaaaaaacgtaccttttagtagtttgaaaatcatacgcgcgaaaaatgagggagatgggttgggaaaaggggtgccgaacacacccttaggggtggagtaagtgattaacccacaaaactcatttataagctaaaataaaccacaaacccgcttattttgataaaaagtaggttcgcggctgacctacttacaccactaattacattgcatgcagatgcagtaatacagtacgtactcgctacatcctaaattataaacgctttttaaaaaattttcacgtaaaattaaatgagaaatggttaagataagatgacaggtgaagcactaatttcatgagtagtgaatgggtgcatgaggcatgcatttacattggacctggggtaggcatttacgtcgatccattgtacgtacagtacgtgcgtacctacgacggtaggatggtcgtaccccgtgcatcctaagagcagttacgatagcgaactattagccagctataaatatattttaataagataaacgatgagagagaaaagcaacgggctacagatctgtagccagctgcagcacggactctaagacatactatgtgtatgacaggtgggaccatatattaatagtatagtaaacaactattatatgaattggctattagatcggctataaatgaattggagctagcagtgggctatactattagacttgctcgaggactcaaggagaggcgttgaaaagttatcataaaatttgaaaaaaaaatatcaacgcagatcaatatatgcaatatatctttccacaaacataaaagttaaaaatcctacttatacaattcgaaacaaaaataacaaatttgactacggattacacattatattcatagttaaatttattatttttgtttctacttgtatagttgtataagttgaactagcatgttgtcccgcgcagattacccgctagcatcattatatttttttctcgtataataacatatatgttttctcaatttattaatatatataatatattaaaatgacgacataattttaaatttcatactaactttaccaaactaccaatgtgaatcaccaatcaacagtggcatatctaggattttttatatggatgatccaacttatataattcttttaaatactctaaatataacaaagttataactataaactgatctaatgtgcatcataacatattaataaagaagttatttttccttttctaaaagtttcttttcacatatgtatatatatgtattgggtcaggattttttcaggtggtcccgagtggaccggactacccctggattcgcctatgccaaccaacccagccatcagaatgtccgactcccacacagtcacactttatttcattgtggttaggggcttaaagtgaagtcttgtgattttcttatctccttatttgcatctatatatctatagtctaaaaattgggctgtgattttgttttttctcgtttgattaatttacatcgtaattttaggtgtttataatgtttatttgcatcatttttactgtatatgatttataaaaatatatattacaagtaaaattatatctagtcttga

SEQ ID NO: 57942 - DNA, 1511 bp, Oryza sativa
tgccgcggacggcccccaccgcctcccggcacgagccgccgaccgcgccagggtccccgccgccgcgctccagggccgagctcctccggctaagtgttgtgagagagaagtctgagaagaagataaggataagtgtgagagagaggaggaggaataggagatagaaattttttgaggatagcagcaatggattatatacggtgtacttgatttttagtcccggttgggaacaacaaccggggctaaagtcaggattttagtcccggttggtaacatcaaccggaactaaagatctttagggactggcagcctctgatacgacatgaaccgggactaaagatgatgtttattcccggttggtgttaccaaccgggactaaagatgatttttagtcccggttgataacacgaaccgggattaaagatgatatagtcccattacaattataaaccggactaaaaatgctttttagtcccggtttttaatggaaccgggactattgtgaatttggttggaccgaccaaatatggtttctccaccagtatgatcgatcaagacatgcaggagtactccttccctatcgatcatatcactcgccagctagctgttgttgtttgctctctgaagatacggccgatttgtatgtcacatcgtgtcgtcgcaataattaatcatctgaccagctatatatatcttgcatgcatataccatgcagagacggtcgaacagtacgttttcacaacgaaaacgtgcatgaaaatatgcagtgttacttcagtccaaacaggagaaagtacgtatgcatgcatgcacatgtgtgttcagtgttttgcatctccgcatgcatgcatgcatcacgcattcacgccaacacgccagaacagcaaatataattaatctcacatatatagcagtacgtgttttgcagcgattaacatccataattcagcacatatagtattttcggtttatatatactccctccttccctaaatatttgacaccgttgacttttttaaacatgtttgaccgtttgttttattcaaaaacttttgtgatatgtgtaaaactatatatatacataaaaatatatttaacaataaatcaaatgatagaaaaagaattaataattacttaaattttttgaataagacgaacggtcaaacatttttaaaaaagtcaacagtgtcaaacattttgggatggaggtagtagcatatatgctgaaacttatattacttacatatatagtaacctgaatttttataacccattggagataaacacaactcccatatcttcgtgtggaggcgatagcttttcgtgtcaacaggcggtagccgaggtgactgtggcccgacaatgggggtggctgtggtggggcgacaaggtggcgatgacgctaccttagtcgcgggagagagaccatatgttagcgataagagctagtaatttgttggtggaggcactaggaggcattgggagacggtggtggatctacagtgtgagct

SEQ ID NO: 57943 - DNA, 2314 bp, Oryza sativa
gtggccccatttgttgagatgtttagagttaatagcatggacgcatggatgaaaacagaggaataatcaaatcaacaaggaatctgtgcttccttgcatgttgtttgtaagtatatttaactgttgattcttggagcattcagttctgaccaaaaccaatatatatatgtcaggaatctccccgttgattggaccttctatctctgttttttcacttcaccagcatggaaattacatatatatcccgctctacattttgttattacatggaagacactccatacttgtacacacgctcagatatagagatggaggtcaacagtacatcctaacatctcaaaatatctattgaatcaaaaacaggacatatgaatttgagttctaaatggataaagccgtgcacccacaactttaccaccactaagccaatagtcccttctaccttattgtcaaaccattttatatttatgtgtattgtttgaaaacagtaatcaatttgaaacagtaatctacaacttaattttatgcaaagaaaaacaagctgcttaaacgaactacatctacatgtatagcttcctcgtcaacttaagcttatgttctagaatttgagtggtacatataactcaatgtgaattagtgcatagagtttttttaagctagaatctagatcagataatgcagatgattgaagctgacatttccttatgctctagtctagctttgcttgaaacaaagaggattaatctctacaagaaattaaggggcgcttttccactgtcaagcacatctgctgtagtactcttatgtgcataggaatccacaacaagagtggaccaacctcaaagatgtctgagaggcatcatcccaaactttatgtatagtaggtccttttccctttcccctttggcatgaagcatatatatgcaaagtgctaactccatatgccacttgttgcacttcctatggtccatgaatggatagaaaagcagccacagcaacgaaagctagactcccctgctcctcctgtaagtcactggagccagtaagattagtcactgtcactggctagaaaagaagaaaggcatatgcctagctatctggagttctgtacctatagtgccattatcagtatcaatcacaaaaaaacacattccaaattaacacatcatcgttattagcagaatgcacgggacgactgccaaacacacatgtcggtgatatggtcccgggggtatcaggctgccccccgatgccacgtggccctcccccgaggggagtaggcccgaggtaggacggcggccactccttcccagagattggatggaggaggctgccctccaatgccacgtggccctccccgaggggggtcgggcctgaggtagggcggcggccactccctggcctaggctagagggagaaggccgccccaggcgccacgtggctcccccccgaggggggatcgggcccgaggtcaggcggcggctgcccctcccgtgactaggggtcgggctcccccgaccccctctctaggtcaccacgtacggtgagttaggtgtctgcctccaggtgcccacctacccgcatttatggcgtcccgagtggtcgcgccacgctgcatttaatgcggcgtgcagagcactcaaccggtctgtgaccggtcgaatgaccgatgggactggctagtgcgcctgtgcgttgctcgtgtgtcaggcggcatgcagcctaacatgtcccatcaaatagtgatggtgagaggttctcatcctcttatcccagccggagtcggtcctccagctctgttcaaagcaaggctccttcccggtgtaataggagcccagaagtcttcacccattaaatggtgactgacaggggcaccctccgtgtcaggcgacaagatttgacaggccccatcatcaagacgacgtgtgcttggcttcccaagtcaagagacaagacatgcatttaatgcaaagattataatacttctccatcggagctaggttaggttgttgggcccatgtggtaaccccttgaggtataaaaggaggtccaggcctagtggtggaggaggggggacttccgagcgaactggcgcttgggtctcgcaaccctaaacacttgtgttctacattcaatcaatcatgcataggagtagggtattacgattctcagcggcccgaacctgtataaacctcttttgtctcatcgtcttggaggggcctaaccccctcaagatcacacagctccgctcaccaagcccttgaatctcacccgctgcccccggccgaactcacaaagggggtctcacggttcc

SEQ ID NO: 57944 - DNA, 5079 bp, Oryza sativa
cgagcatctgaattgttagaaagagccagagattacaaaggaagctgcatttgaccaaaagcttccaaaacatatactccctccgtcctagaatatagcaacgtaggactggattagatgtatcctaggactatgaatctgaacatgcttcctgtccagattcgtagtactaggatgcgtctaattcagtaggttgctatattctggacggagggagtagccttaatcccatggtgctaagggcctgtttagttcgcgaaaaaaaaatttttaggtgtcacatcgaatgtttgaccggatgtcggaaggactttttggacacgaatgaaaaaactaatttcataactcgcctggaaaccgcgagacgaatcttttgagcctaattaatccgtcattagcacatgtgggttactgtagcacttatggctaattatggtctaattagactcaaaaagattcatctcgcaatttcctccataactgtacaattagtttatttatttatttatatttaatgctttatgcatgtatctaaagattcgatgtgatatttttaggaaaaaaatttgggaaataaacggggcctaactagaggatgaaattttgttagggacaattataatctgacaaataatctcgatctatttgggcaaataggaaggctgcagcagtgagcgcgtgtcgcacacgctgtcagcagcaccaggtaaggcatgcagggcgcagctggctgcatggaattaaggaccacatacggaccgacacatgtgcccttgccctgtccccggccttcccgattggcctgcttctgcatgcattggagaccgcgcactgcatgccagtctgtactagtcccttcgtcccatctaattttaatcctctgttttatttaaaaattatttttaaaaaataaaaaatataagtcacatataatgtatgatctatgttttattatctcataacaacaaaaatactaattataaaaaaataaataagacggacgatcaaaattagacacggaaacgcatggttgcgcttataatgggacgggggagtactatcacccttcttaaaaatatctctatttttcacccattcgtacaaatacaaagttaaaaagattcgactttcacatcaacgcgactcttcagagatgactcatctcggacggaccaaaaaattatcgtgtttaagacgtaactttttttcactttattttgttttgataaattgtctcatactccctaatacaatgatcacttaaagattgacttattttaggagaaataagatgggtaaagataatcttatatcggaacataaaaggttccacaaggatagctactcattccatcctagaatatagtactagctggtatgggatatatcatgtccaaatttacagtattaggatacgttacatctatcctacggagtatattgctatattctgggaccgatggagtattacttttttaattaggttatgtgtccaatccatcgatccattgccacctggatcgaggactaatatactggcgttgattaatcaatggtgctaatataattattacacatgaagattccactctgattatattactactccctctgtaaaaaaaacttaactgtaaaaaaaacttaacatagaaaaaaaaatgtgacatcttctataatagtaacaaatctatacaaagggtagtctagatttattatggctgtgagggagtagtgtactacagtgtgcatactactccgtactagcagagagaggagtactagctaatccggcgaattcggcgcgtttttttttctcataattctgcacaacttgtattcttgcaggcacaccctcgatctccgatccatttctgctaaaaacagtgttgcaatagtagttctttttttttagggaaaacaatagtagtttcttttgtttgttgttaattagggcatcgatattattgccgccaatgggagatgtatttttactgctcaggtgcatgttgtgaacatatttgcgcgcgcctcatttcttaaatataaactaaatagttataaaaagatctgaaaaaaatgagaacgttgatatttgcatgtacaatcttgcaaaatttcaagtccaaaatcaatccatatggagagaaaaaataaacaaattttgtcatgattggtactaacaatattcatatatgtaattgtttcttgagtgtggaatatatgtagattgtatttagtattgcatatttgtaaatgacgtgtgacgttgtgatctatgttgcttgatttttattcagatcttttataattatatatttagatgacaagcaaaagatgagccagtgtatactgcatatgttaattaattagggcattgagatttcaaggtatgtttagctacttctcgtatcctaaaacgagacattctatttgagaattggggagttacgaagaattaaacttgcttggtattattcatgaccctatagttcactaattagaaaaaaaaaaggcacaacgtgcatgtcaaatatttgtactaccgatatatgcatgcatgcatggtgcatcttatttaggaaaaagtacatatgaattagaaagcactaaaaacaccattctctcccaaccatagcaaccttttgttaattagcacgcaatggagggatatgctgcaggcttgcaaatgttgacaaagcaggaaattaattagctagtttagttaattaatctaattacgtgtacacatcacggttgtgcatgccacaaattgccaagcatctagctataggtatgatctcttgtcgaaagtgcatacatgacaaggacaaaaattaatatgcttgacaaataactttgacataactatggctgtgtttgatgcaggctgaaaagttttgacgtgtcacatcagatatacgaatacacatttgaagtattaaacatatactaataacaaaataaattacagattccgcctgtaaactgcgagacgaatttattaagcctaattaatccgtcgttagcaaatatttactgtagcatcatattgtcaaaatcatagagcaattaggcttaaaagattcgtctcgcaatttacacgcaatctatataattagttattttttcgtttacatttaatactctatgcatatatccaaacattcgatataacatggtaaaaaattttgatgggatctaaacaaaccctacatatagttaaatttttggctctagctaagctactaatggatggatatattactattctttacgtcccttcaattcctactttcccctgtttgttcttagaggtacggagatataagaagcaaaaagttaattaattagcagcttctagctaatcttccgtatcttgtaaaggaggaaaattatgtttttatatatatggtaagtactaaagtatacagcaaaatgtccatgcgtgcatggcagtgttagctatagctgcacaggccaaattattatagtaaaatatcaaacccactaattaattttcactccaatcaccagatcagctagctaggcttcaactgatcttcattttcatgaatgcccctcccttgcttttatatatatgtagccactgctgacacaagaaaagaagaaaaaagcgtacatgtataatacgtatacaccatagcctctatatatacagatctttgatagagttggagctgcctttccaatgttgatagagacccattaattagctaaattagcaagagtacatcatgtacagttgtacacttcatgcttaattagcactaattaattaattgccaagctaggtaggcaaaatgcttatgtaatacgtgtgcgccgagcagtcatttcatgcacctagagtcaaagcacacacgccatagtttttcattgagtataatccaaattaatacagccgaagcggcaataaggcaatttgccattttatatatggcattatgtgtcacagtaatacattgtttaatcacacttagcttgcggttcacttcctggaaacacggtttatgtgtcagtctagcttagctttcagcccccaatgcacaatggcctctctcagtcaatgcaattaaggctcggacatacgatttgtccacacttagtagttgattaaattaattacttgcttttttttaaaaggcacgcgtgctagctagtttattaattaatattttcactgggaagaaacgatcgaagaatgcaatggctgctagctgatggctacgtatgctagctgctgcctcgtgttgatatcgatggagacgaaggaaacaggggagagacaatattttggcttgctcgatcagctccttggccctcggagctcaaaagaatataccaacacaagatacgcacacgcatacaatgatatactccctccggttatttaaacatggcgttttagaggtcgacatggtgccaaaaatatgactttgaccatcaatcacatattgtttgactgaattaactatcataaaactacatacttcagccacgaaacaacaaatctaacattatcacaaaactacgaattgaaacaatatcataaaactgtacatttattaacgttggccttttattgcaaaggtataacattaataattcctgcatgcatagctatagtgttagggaattaaaatctaaagtctatagcatcgtcgtaaattcattactaaatctatagttttgatatgatactttaccataaatttttagtttcatgataaatttgatatcaaatctatagttttgtgatatgcaattccttaatatatagttttgtgatagtttagtccaagcatttgtagttgcaaaatttatttcaaattttcaatacaactagggatatgcccgtgccttacaaagggatttcgagaaaatgagacaacggttgcccgtagtgttttggttttagaaacagttttctctagggatgtgcgtggataggattatcagaggatgataattacttcctccgtccaaaagaaaaaacccaaccttggtgaggatgggacatcacctaggtcagatacggagggagtacgtttttatagt

SEQ ID NO: 57945 - DNA, 1759 bp, Oryza sativa
attgattgattataatcaatctttcaggtattttatgacacatggatccactaattgattgattgataagtgcactattactgacattcttttagttgtttaatcacctagctagctgggggtatatactactagcattctagctataactagcaataatcaataatgtactagctagctactaatagtaatatgcaaatcgatcaatgtgtgaatgtgtgatgtgtttgtggtagatctggtacgtagtactatttgtaacagggaaagttgctgttgatggagaaattaagcatgtggttagctgtatcttggggggatccatccatccatcagatcagggccttgagccgatcgatgctgcctctccccggcgagcaacagtgccttcgtcacgtgcgtcccgcacgcgcccccaccactctcgctggctagcatctgtactatggtgtatactctgtagttacaatccagctaatctcatggtgatacctcacacgttgttacgaaattgaagtaatattgtattgttagcatacccgtcctgacaaataatgacttaattttgataaagattatacggacgtctcttaatttatgaaaacatattgattcggttaagcacatgtgtgttgggtggtttttgcaataaaatcgagtaggaggtgggtacatatttgcaacaaaataatttatgagatagtgttaaacttcaaataatttctagtctggtacgtagtgacgatggatatgatataacagatcatatatatgcaagaactatttagtaacagccattggttgagccttttgatggcatgtcatcacatatataaggatattttcatataggagtgaatgtttatacagaaaatgagaaataactgagatatatatatatatacatacgtagtgtgcaggaggatgatgcaatatatatataatcgatcgaactcggtcatagctaatcatgcataataccggtgtgtttggataatgggaaatggggagtgggattaggattaggaaataaatgaaaggttagaattaaatggaatatggagaatgaatggttaggatttgaagatgtcttttgatggatggaaaatcatttctctatctcattagccaaacactgtctcacctcgatcaaatccggatgtacacacatgggccatcatttatatatagctcgatcgatcgccggaacaggccggtgaagctctcatcggcgaccgaccgagtcgtacgtcgtcgtgatgaccgaccgagtggccggtgacatttcaaaccccgccccacgtcacaaactcccagtacatgtctgtctctctctgtgacttgtccttgtccttgtctgatctctctcacacacacaccccagctggatggagttagctggagtaggatgtatgaagtaccgcctctgtaaaaaccaacctagaccgtggttagtttcccctctattaccaactttccatcacatcatatcacataaaaaattttcatacacatataaacttctaactttttttccaaactcccaactttcttcaaactttcaacttttttcagcaactaaacatacccctaatcaaatactccatccgtctcattataagtgtaaccataagtttccatatccaattttgaatatccgcctgacggagctcgtggctcctcaccgggagaccgcgcaggcccccctttgccagttcggccgggggcttagggtgaaatctcaagctctctcggtatg

SEQ ID NO: 57946 - DNA, 13161 bp, Oryza sativa
gtatagacctggagaaactcggtggggttgacacttccatcatacttctcggtgatggtgggccggaaccttgggggccaacggacattccgaagactcgccacaaaggctctacagccgacaccaccagccgggggcacggagggctggtcctcacgtccatgtcgaggtgacactctggacgaagaggcgccctccgttgcgcgaggagtacgccggctattacgccggcgctcgatgtcgaggcgagcatccggctctccatgctgatcctcccgagtcggaggtgccgacgagggagtggcagccgaatggcgtgcaacagccgccgctcgccgcgccctccgccttgacgacacggagccggtagtggcggcgccggaggtcttggtggtggcggaccgtccaccagcacccaggcgctgctgtgccgtcatgaccaagttggccacgtcgtccagccatcgctgggctggagactccgggtcagggacgacgggcgggtgacgtaggagcgcgccaacagcctgaagcgcgccctgaggcgtgctgccgtcgccgtagacgaggaggcgacgctccccatctcgccgttctcctgcatcacccgcgactggcgatgctgcggatttttcgaccctctcgagcgcctccccctgcttaggattttggggtgggggaggtgggggagtacgagctcgacggcgtgggtttggctccccgtcgtcgccgctcacactcggagagaggtcgtgcacctttgcttgctcggccattaggctgaacaagaaaaacttggcgcacacggaggagtacgagagctcagaagacacacgctgagccccctacctggcgcgccagatgacggagctcgtggctcctcaccgggagaccgcgcaggcccccctttgccagttcggccgggggcttagggtgaaatctcaagctctctcggtatgtggaaagatcgcgagccaggaagaaacgcgagacacgggcgatgtatacaggttcgggccgctgagaagcgtaataccctactcctgtgttttggtggatctgtgtatgagggagctacaaagtgtgagccaacctctcacttgttctaagttccgaatctggaaaagatcatccccctttccctatgggcaaggtcctccttttatacttcaaggggataccacatgcacccctctctttccaaactggacttttcttctcttcataaatggacggagatttgcacggttgtcctccgaacatccttctgacgggacggcacacacctacctccacttctgccgaaggcaggcgcgtcgtgggaacgtggctgtctgccgacgacatgaccagtgtcagaccggtcattcttgtcctccacgcgtcagttcaacaatctgcatgttcgcccttcttcatacaacatataggctgtaatggttgggatgaagcctggtataaatctaaccagggctaacgtgccatctctaagagattacacgctagctccggcttgagacgagtgcctagaggctttcgtcttgacaggatggggcaaggcgtgcgtcagaccgccagtcgccacctaacccgtgatctgaccggtctgtgactggtcacagagcggataaaggaacgcgctgcactacgctgcatgcagcgtgacacgttcgaccagaccgcaataaatgtggttaggtgaggctcaccgtgttcacccaacccattcatgtggcgctaactccacaaggggtcggggcgcctccgccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacaccgccttatttaattttttttataattagtatttttattgttaaaacatgactagtactttgcgcgtcacttatgtttttaaattttttcaaataagacggacaatcaaagttgggcacggaaaatcatggccacttaaaatgggacggatggagtataatttattcatcttgtactaaaaatttggatatctagataaagactatttagacttgtagtattagagcaaatttaataatacacctaatagtctactcatacaatagttaattgtagatatacatcgtatcattaatacctaatacattgaagtttgtgctgcagttggctgtaaatttgtagtctgttttgttctttctttttttttcttttctccatataagcacaaatatgaggtgacaacttaattatacagcccgttttcttcaccttattatactcggctcttaggatgtgatgcgtatagcttagcgaaagcagatgaagaaaagtccattattcccaacaataacaagtgaatcgatctggtcgtctctctcgccaatcggattacccaaccgcatataaaagacacaaccaacggcggccgcgcgcgtgctgccctctaaatcgtcatatatactgtagcgcttccactagcccaagaactcaccaccaccaccactgaagagagagagagagagagagctcgagcttagccatggccgaccaccatggcggccaccacgccgacgggcatcgccggcagcagcagctgcagggggaggcggcggatcaggcggcggcggagatcatcaaggagcaggacaggttgctgccaatcgcgaacgtggggcgaatcatgaagcagatcctcccccccaacgccaagatctccaaggaggccaaggagacgatgcaggagtgcgtctcggagttcatcagcttcgtcaccggcgaggcctccgacaagtgccacaaggagaagcgcaagacggtcaacggcgacgacgtctgctgggccttcggcgccctcggcttcgacgactacgtcgaccccatgcgcaggtacctcaacaagtaccgcgagctcgagggcgaccgcgccgccgccgccgccacctcccgctccggcgccggcgccgccgcgggccccgaccacccttcctcctcctcctccgccgccgccgccaccgccggtcatttcatgttcaacgccatggacaggtcgacggatagctccaggcagttctagccaccgttctttgcgtcgtcttcttctcacccaacacccaacctttcctcctaatcttgagaggtcagtaatttaattaagctaagctactccatcgtctctagctactccatcttaccttactcctccatatgaacagctattgcagtggctaagctaattaataattagtaagagtagccagtgcttagctactagtagctagctagattagctaattaatctgtgttcatggtgtgatatgatggtgagaagctaggtggggatggatgtgctgagattgattgaaggacatggaagatgaggttaggatgaagaagctagcagctaagatggcccggcgacatgatggatatggagtaattaatcggagtatgcaaaatgatcgattttatatgaataattcttgtacgtccaatttaatttttgtagtgattaattattttgatctgcacgttatgacgattgacatagttggagttgggtatttttgaatctgagtaaatttaattctagatttgatcaaaagttgatttctaggttcctgcatgccttatgcctatatagggataatattgtgctgattgatattcctaggctagctatttcatcatgcatatatgggtttagtttgataagttttgactcttgagaaattagttaggcactgtctcttattcttgagcaccacatatataacttctgcaccctgtgtgttatgcattcttgcattgtgtgttgaccttcttcattgcttatatatataaataatagtatttcttatcagatttaatttaaactacataatatgcttgtatggttgattgatacacaaaccgaggtatatatgtcgctagcaaaatgcaccgtatagtttttatttactttgtccatcccaaaataaatcaacttttctacatattatgtctagattcctatataaaatttgattttttttctttgacatagagagtgccttgtcgtaattgtgtgagagtgtttctatgcctacaagaattgaattaatgtttgaattatgctagtcgttcatttatatcaattcattatagatcatagagttcaaattctgatgtctacaaaaattaacatatatagtgtgtatattcttagttagtgccagaagttatattttctttgccaaaaaaatatataaggcaaccttcttgacttcttttttttttcaaaaatggtggattatattaattataaatctttccttttttccatttttgttttctagagatctgttgtcttacatatatagtgcgatgcaatagatataagtatatggtcatattcgctcgtagtttatggaggtgtttagatccaagggtgtaaagttttggcatgtcacatcgggtattatataggatgtcgcatggggtgttcggacactaataaaaaactaattacagaatacgtcagtaaaccgcaagataaatttattaagcctaattaattaatcattagcaaatgtttactgtagcactacattgcaaatcatggagcaattaggcttaaaagatttgtcttgcaaattaatcgtaatctgtacaattagttattttttaagcatatatttaatattttatggaggtgttcaaacgttcaatgtaacagggtgaaaaattttgggacgagatctaaacgggcttatgtatactgtcttaaatgttcataggacgcagaaattgatggtttatctttaattgctgacataataaatggcatgttctatgaagtggttgcagagagtgagtacgtgtcttctaataatttaggtggatgctggcatgcatcacgcacaatgcatgtctgcacgacaaacagtgttcgatatgtaaatacatgtgtccccaaaccactctacgtaaattcccaaccagtatacacccattcattagtcacaaatactcgtcataattacccttcatgtcctaaaagccacgcatatgcctcatatatatctcttcagagttggtagtactacacacgaactcaaagttcaatgcaagtttttggtttgaatccgctttaacacaagaatacagttaatcggttagtgctggtctagtctagttctccactgttttttgcacatgacaattaagtgttccgtttttagctctcgcagttcagatagatggctagctctctgatatgcgcagggcttttttgggtttttttttcgcatttctttttgcttcagcgtaaattaaacagttaatttacctctgtttggtcagtaggatgatctgttattttagtcatgcatgactgtcatcatgtatatagactatatacccattcaaattaattcatatataccccctcgatccatctgcaaaagacttaatttctagctatacacttggacaatatatgctaatataaattagtacttcatctaataacgatttcgaatgcaaagggaccttcaagcaggaattgaccactcaaagatcgatagtactttttgtttaatgtactatacatataccccaccaattaatgtacttatatatacaagtcacaatgcatcctatatatggagtatatatacatacatatacccaccaatgtacttatatatatgtcgtttaaaaaagtagtactatatatgtaccatatacgagtattcaagaaaatgtactagagatgtacttttcaattaagctagctagagaagtcagcacccaatcggttggtgcagctgttgatatattgtcttattagctagtgtactcttaaataaatttgagtatttttgtggtagtatatatatatatgtaattaaccacacccacgtggtaaaatccaaattaacaaatactcttattcaattatacacttactagtatagtgttcatcgcgtccgtagaattctaaactaaatttatatacagtgattttttgtttcaattatatacttctttgtattttttatttataatattcataagttttaattttataaaacaaaactgattatttttgttattgcaatcaatctaaatgtaagtttacatatttcacttggattatatttcttgtcaagctgcgtctggtctgtaccatagaaatttacatgcatgcatcatctctaattaatacttcctccatttcacaatgtaagactttctaacattgcccacatttatttagatgttaatgaatctaaacacaatatatgtctagattcattaacatctatatgtatgcgtgcaatgctagaaagtcttatattataaaacggagggaatatatgattagtactactatacttatatatgtagtactccatccgtttcacaatgtaagtcattctaacattttctatattcatataaatgctaatgaatctatacgcatatatatgtttaaattcattagcatctatatgaatgtggaaaatgctagaatgacttacattgtgaaacggagggagtatcattgaaagatatatgtatatatacacagttttaaactccctgtttattgattaatcagtacagtacttgtatgcattaattgtggtatgtaaatttctagcttcatctcgacagttaattttcagccgcaatctgaatttgaattttgaaacttaattagtagagtgtattatttttcattgtagcttattttatagccttgccttttaaaccttgaacaatacatataatgtggacttataagtccattatatatgtataatagttatgaattatttttaattaattgtttgtaaactaactactacttcctccgtcccataataagttcatatttagcttcttccatttgttataaaataaatttattttttaaaaatcattgcactggagtttgtgaaagtagaaaataattacgttgaaaatagataaagtgaaaaaataattgtattgagatttgatacggtaggactattctagttttttttttgtcattttgggttctgtattggtacatgggatgagtaaataatgaatttacttttgaaaggaggaaatgaggaagtaattgcgagagcaagccaaaacgcgttatgaaaccacattagttagcaagaaaaatggcgagacgaggtagtcgattgatactcagtacctgcagatcgcaagatcaccaaaaacaaaccacctactccagcttatttcgtaggcgcacacacactacatacaccaggcacaccatcgactggattgataagggatagttggatatggcactactggaagctagctagggagatcaaaactatgcagagtactccctctatccaagtttatagagggcctgaatatttttctctctcctgtcagaacatataaggcacagcttcatttttttttgttgcttctatcccggagtaccctgctcatttgcatatatgcaggtggttgaatacatgcatatgtcaaggtgtggtgcaaagctaatactccctccgtttcaaaatgtttgacaccgttgattttttagcacgtgtttaaccgttcatcttattaaaaaaaattgtgaaatatgcaaaactatatgtgtacatgaaagtatatttaaaaatgaatcaaatgatatgaaaataataaataaatacttaaattttttgaataagacaaatggtcaaacacgtacttaaaaagtcaacggtgtcaaacattttgaaacggatggagtatttatctagattacagatttgctagagggaggtagagaaacaagttttttccaaatgtgaaactagctactctgcgctctctcgtgtgttcatcctttcgatccaaagcgaagcatcatgcacacaatatgatatttctttatgctatacatatttatcggaaagaaagtcattcgtgttaaatttgtgaaaattaaccttttgtcgatcgactatatatgtatatatccagcccgtgcttcaccattgatgtgaattaagtttgattattgtttagtactgtaagggtatatatccacatgcatggttgactttttctggtaacttgttccaactacacatatagtgttatatactgtaagactttctagcactgctcacacacatatagatgttaatcctcgtaaaaaaatatagatgttaatgaatctagacatatgtatatattaaatgaatgtgggcagtgctaaaaagacttatattgtgaaacggagatagtacatgtttcttagttataattaattctgtactgctgaatttttagtagtatatatgtgtgtgtcactaattaaactatacttgttttttgtactccaaatatgcaatcccaatccctaaacaccaactacatttaatcctttgtcgattttcaattatgtgggttaattgtctcaaaattttataactttttaattatgtaactccaaattatgtggattatttaatgccataggagatccaaaactgatgacgataccgagacacaatatttgataacgagttcagccaacacctatattccgaggacctccctggttcagcatattacaacatattagagttacaacgaccttgaccggatgccactgatcgatagccgctccctctcgcctatgctaagtcgctatacggttacaacatgtctatctctctatttaagagagagtttaggatagagtctgacttttactctattttttttatctaattcaacttcaagtcttaaactgtaaccgattacgtatatatatttgacacaaactctaacgtatgtagctagctaacacttgaggttgtacatgcatgcacatgatatgtgtcgaaagcctcttcgtcggtaccgtctagtacatgttagttaattcctcacaatgtccatgggaaaatgaaaccatataataaagaaaaattcaaggatggttccatccgattgggagctaggaatcagcgcatcaaaagatgaaaacttgatatgcacactactcctccaaattggccacagcaaattgctgtgtaactaccatttgcttaattatcccccttttggcgtcagaaagctgcaaatcggtagccttttatatgaccaagttgccttctcctccatctcgtcttcctcgtcatcctcttcctcgatcgtcgtcgtcgtcgtcgtcgtctcgacattgattcgggagtatccacggccacgtgccgcggcgatggaggccatcatcgccgccatgggagggccgcacggcttgtcggccggcaggtgtcgcccgcctagaggactatacacaccatcgccggtgtaaaggacgcagcctgattggctaaacttaattagtagtgctattagcttaagcttaattagcttgggccaaaaagttattcttctctgcactttcatttctttaattagtactagtatcgaaagttcatgtgtgttagtgtgtgctctctgtcacttttttcatattttatcgtatatatgtaaaaaaaaattatgcgggtatcttcttgtgactttaattgatctgcagctgctagttgagtccaaactgccgttgattaacatttttcttatcataacgaccgttaattaattagccgaagattaatttgattatatctacacacgccaactgaatatatgtacatgtagttttgtgtcagataacttcttttgcgagcgatgaatagatacagggcacaagtctacgtaaacgcttgattgcccatcgatcgatgcgattttatatcactctacatatatatacagtagtatacaaaattgttgccctataaaagtatatataaaacaaattgaaatgttggcttatgttacttttgtatattatgttcatgaaaaagcacggtaccgcgtacttgtagtgagtcaaaaatcagtccacatgcatatcaaacaaatttgcatgcatgtaatttcccattatttctttcctcaaattgtaaaaaaaagaactcttttccaaacaagttggatataaataattgaatagacaaataaatactgcgggcgcaccatatttttgtaaggaaagggaaagaatcattatctcatgtggtgctggcgggcaatgctagccctacgttacaacataacattccacacttttttcaacaagatcgagaaaatccaataaacaagtagaaaaaaacccgccgctcaacgcataaatagagctatagccggttctcttcagcatagtcagccaattcccttcagcacagtcggtaacaatatcacgaggtttgctacgacggtgcggcccatttataccatacgactctcttctcttataagggagataagatacataccccctttcccaccaagaaaatgagccgcgatctcaatttctctggattaaccaattgggtcgcctccaacccatgcaagggcttcctagggcgtcgtcgtcgtcaacctcggcgtcgagagatcgagacggcggcgatggcgatggcggcggcggcggcgtgacgatgacgaacgggcaggacaacctgctgccgatcgccaacgtgggccggatcatgaaggacgggctgccgccgcaggcgaagatatcgaagcgggccaaggagacgatccaggagtgcgcgacggagttcatcagcttcgtcaccggcgaggcgtcggagcggtgccggcgggagcggcggaagacggtgaacggcgacgacgtctgccacgccatgaggagcctcggcctcgaccactacgccgacgccatgcacaggtacctgcagaggtaccgcgagggcgaggagctcgccgcgtcgctcaacagcagcagcagcgccgccgccgccgccgccgccgccggcagcaggggcggtggcgccatacagatcgacgtgagagctgagctctccatcttcagatcaggcaacaaccaaggtcgtccaaacaattaaccatgcattgtatgctactgttgatcatagctgttcttgatcaagatgatcaggttgcaaatttgcagtaactttgcactacatatatatgcaactgagcagctcactgtcatggagttattttttttttgtgtgtgtgtgtgttgcaatctggcttgtgtctatgtactacgatgtgttttccggtgcgagtactacgatgtgttgtaccaaagttgtactgctctggtttcgaagaaaaaaaggtgtactgatatgatatatgtatggtttttaatttgttgcgtgcatacttttaaacgtaatatttcaggtttgattagtttcagtttgtcaattcgttgcaagtgatttgtatagttttcatttcaagttacataatgcacgtgaatatccagttaattttggagtataactagctataattaaaaatcaaatatgcccactgcatagtgcactctaccaagaaccaaatatagcactgtttgaaaatttaaattttgactgagaaatataggcatgatcgaaaagatgaggccctagcatggtcatgcatatttgaaacgtaaaattgatatgatgcatagttggcacttggcagtatggtcatacatatttacttatgtgaaaaaaatatcgttggtttttacattgcagacacgtcaaattctccctcgtttatcgtgcggaataatggcggccatctggacgtctggtgaaagttttggggagagaaaattagagggcaaaattaaagaccaaacaagcaagggatgctcctacttgctgcatcattttgggtaaagaaatccagcacattctgagcagtttgtgtcttttgattgctctcaggtgtgcagaaggctttttggtacgctgttccaagaggggttttgtattaaactcgagttgctccaatggcaaacgaagaatgttggattgaagagctcaaaaagggcaccgcaactcagggctaatttgcacttcacaataaaggttttgtggggaccctgcatgccatgaagaaatgttctagaggcatatataatctagcggttttttttctgacgtttgaacgtggttttcttacaagaaaagtctctgcgcgtttgtacatcatgcgtgactaatatatcctaattgtgcagaaaggtgtttttcaaagtataatgatgtccgacaacaagtgtcaagttgcgaagtgaagattgccgtggaagcgcactacccgataaatcgtctctcgagagctgcagagaatgataagattcacatgcggcaattcccactttatcgacgttgtctgcttattgttgcttgtcgtgtagggtatactattattagaagcattgtccgaccatgaaacttagttgaatattactatgatcatttggtctatgcaatgtcacgtatatttttttattagataaaagaagcccatgttatgtggttgagacgtgttaattccgtgtccgatttcctaccgtatacattagaaaatagaaataaatttactatatactacaaacctaaaaagatgtacttttctcaatatatatatatatatatatatatatatatatatatatcacatacaatagaaccgtaacaaatttgattttcaaacaagagatcaaaatacttttaaaaaacgttttcagaaaaaaaagatacttcaaaaaatgagttaaatatttttgaaaaaaaagtataacaaatgaggagagtaaaatcttgtatagatgtacccacacgggcacacccactgcaaaatctcccctgcaggtaaaaagggtgttaactctcttttcgtggaggtgaaacttaactgaatctccacgcctctgccagactgccagtgtatcccacttggaatatttaactctgctccaaacagcgatatttttcccctgaaaatgcgagtcgggaagagaaccctctttgatggcccggcccatgttgagttacgggcagggccgttaaagcccatcatttctccatgggctgaactggtcggttcagcccatgggccaacctgcagggtcagtgcattgcatgtggatttgcctctgcaactctgcacattggctg

SEQ ID NO: 57947 - DNA, 4088 bp, Oryza sativa
caaccaaatggaatggcaacacgcggcggcgaggaaattggccaagctgtcgatcgattggcctagcttgttcttgctatcaactactcgatcaattcgccgatgctttttttctgaaacaggcaagcggttcacgtcggcgatgtgcaccggtgagctgaacagaagcagaagagcagctggagatgggtccgttgcttctgcagaaagctgcttttcttttttttttttttttgcccgcaagatctgacctcactggtagggttcttgtgttcttgttagtcttagcagtagcaggcagccttgactttatagccccctcctcctccaaagataattgctctcgtcagaaagattgtcttgtcaaatctactacttgctggagaaactaaagatcatgacaagtcagggtcagggagaatttcctgaacatgaaattctagaaagatttctatttttttttcagaactgaaatactgaaataatgagcagtgtgctgccaaaatggttgctgtttccttgggaataatgtggccacactgacagacagaatcgaccatgatgctgagggatcctaatcggagctgtcagacgatgcggaattaatggaagaaagatcgtgtacgttagcgtctgattgggcagcttgatcagtttcagaacaattgagcactgttctggggttgttcatctgaagaatcactcaaacgctctctctgatgttcaggtagcaattctcaagtcgctgtcacatacttatcccaagtgaaggatccaaccttaaaatttattggtaccaatagatagacttgctggacatcttactggttaataggcctgtttaaactttttcttgccactgtaagctactaataatgagcagggagattaggtgttgacatatgatcgatgaagcggcgaagattcaggaagacatttatgaattcgcccaccaatgatttactgtatgaccatagcggaatgtttagcggtgtaaattagacgtaggctgcgtgtagctctctcttgtctaatctgtttctttgaaatatcgccactttttaggcttttagggttctagagcttggaccttgtttctatattattctctctctttgtgtttcccgtgtagaaatgctttcctgccctacgaagattctttgctacctactacctatccttaaggcaaggtgtataatcgtaattgtgttcttgtatcctcacttgtgtactaattctgcaattgtgatttattctctttaccaatatatgttcaatactgtcaagaaaagatataatgcattattggctactgttcatcatgcatatctgcgagtgctcagcagggtgcaggctattgttcatcgtcatctacgatctgagcctgattaactttgaggaaagctacaaatcttaccaataatcgcgtgctctagtctccgcgtaaagaatagacgctgcacagtttccaaatgttcagttaaaatatgcaatttttcagtgttacggcgaaagaacagttgagcagagaggacaaagtgagaatgtaaccatcgctgctactacagactaagcgcagcaatgacaatggtaatattcaggcatctaatacgaaaacaactatgcatttgtttaattaattagtaattagctcactaagcgattagtcatcacttgataatcatcatcaacaactcgatcgctagcctgatctcaagagatcgacagggatatgcattgtgggctcgttctgtctatttgtcaatatatttaacgatttcagtgaattgaaatcacgaaggaataagacagttttgctctcgatctttccctctccatcgatcacttcgcgagctgatcatcgactcgacattttcgctgtatgcagatcagggccggatgcaaccaaccttggtatcttcagaaattaactaagcaacgaagcagcaaagaggtgtagtttcagtgcatctgaattttcccctccctgtcgatcgattagcttgtccactccatcaactagagtttaaaggtgatcaaatagtagctagttagcgtgtgctctcagctctggttaattagctgacgctttgatctgcctagttcatgatccatggccatgatatggagggaatttaatgatgatataatgcctcggttttttaatatgtgacgctgttgacatatttttattgaacttcaaccaataatatttattcaattacttagttaattaaagtgaaattagtaacactagttctctcatcaaacttaattttaacatgcctagtagtatgtttttctatttgcacatatatttttaaaaatatgaatattcaaatgaattaataaagttaaccgcgtcactgaggtagtagtatgtcaagagtaaatgcatttgtaggttacatgtatgtcaaattaacaccgcactaattaaatgtctgggaacatatatggggtccatccatgtcaatcaagaaggtggaaaagctcctttatttatttttggttcaagaaattgaacagtgtcacctcctcttgctttcaggattgtttcttgtcattctgtgcttggttcaggctcagtcgttttcagatgtgctaagcaaataggagtaagcagtagtactatatctgctaggtagtatatctcagattctcagtagtacatgcatgtacagaaacatgccgtgttcctgaaagcaaatgagggagtgataatattcagttattctagaaaattgataatattcagttattctagaaatttcattctgaaaaaaactataccttacagttacagttaattgttcctgggagatcaagcagtgaaggaaaatctcatggaaaatacttggaatgttgcatatagttgtgaacttagtttctgaaagttcctaaaatgtagggcaattttagtttcaaaaagttgtttgttaattcgtctatccaacttagctaggctgagctcacttctgcatgggtgttcaacctccatcttacgcatcatcatcgttatcatcccttgcaaatcccaaggtccttaaacaattcaataacgtacctagtaagagctcttgatcatccatgaggcataaactatgtttgttaatttaggtagtcaactatatttaaattcaagagcaccaaaatatatatgagcctcttgtagagcagcttaaaagttaaaattacaatagctctgttgcagtaaaactaccgtagttcgtattgaattcagccagattaaggagagaagcctgtcactctctgtcagaaattcaagctgagagttagcactccataagaagagtggttttggggattggaaaaccacattaatttcaaattggcggtgttaattgcgatcagattataaaacgagacctaggcaagaaaacaaggcaacaagaagccgatcaacttgaccatgcattcacaggttgctgtcatgacaagccagtattatactctctgccaggaaaacttgagcattgtctcttgccggccgatcccgaggggagcaaacaacaaaggtagatccaaactatgcacattatataaaactaaaacttttttttaaaaaaattctttgctacaagaacaagctctcttctcaggtccacgcggcttagctatctataggccccatcgtaccctagtaaactaaagccaaaaccaaaatttaaattttcgtacttaattttgaagttgattttaggatattttttatttagtttttttaacattggcttttaagtcgctaagaacacatatataaaaattttacctataaattatatgtgtagctgtactagctagagtgtatctatggtgcatagttactagcttctagattaatctttcctaacagttagctactgtatatatatagcatcctgtacactcaagtcatccctgacacacacacagacaaagacaggttcaattctctctgaaagctaagggaaaaatagctacactaacatggtgaaaattttggtaggataaatagaagaccagctccctcttcttcctctagctagctgtcactcataccaagttcagccagagaaagagcaaga

SEQ ID NO: 57948 - DNA, 1152 bp, Oryza sativa
  unsure (1)..(1152): unsure at all n locations
tgaattgtctgaatattttgtgatttcaagttctgaatcctctagctagttgttgttttttctcaatagatggatagtggttacctcatcatttcagctaagctcgttgtatgtaattagcataaagcttttttggttaattaagtgcacataggatcaagctatacattttttatccagcgtgctattttttttagagaattgcctgtttctgttggctctgtgtatatacatacagatctagtaccatcgcctgttaggacagttaactgcaatatctatatgaaattaggtgcacgcacaaaatgatttatatttggaagtttggtttaaaagagtgattgaaaattagatctttatcacttggacaaaacataattgcagttatttaaaagataatgatagcacatacaagttcaatgcaacctaccaagttattggtgcaatagaaatgtaactagctcatcttgcatggagtggcatttacatctgcaaaattttgctctagctagatcacccacaaccatctaagcaatgcccacataaataaaacgtaaattttagtactacctccagttaatttaatgtacgaagttgttgatttttgacacgtatttgatcactcgtcttatttttttaaaaaagataactatcatttaatttatttgttttgttttttatatttacacattttttatttttgaataatatatatggatgttcaaactttattcaaaagtcaatgnatcatgcattaaaaatctacaagtactctctccatcccataatataagggattttgagtttttgcttgcactatttgatcactcgtcttattaataaaaaacgaaaagttgtgcttaaagtattttggataataaagtaagtaaaaaaaataattctaaaaatttttaaataagtcgagtggtcaatcagtgctagtaaaaaatcaaaatcccttattatgggatggagggagtactattttagtagagtttaactaacacgtttcgttggtgtgaacgcggcgcatgccatgcagacccgagcgcggaggtggtggcgctgtcgccgcggacgctgctggcgacgaaccggttcgtgtgcgagatctgcggcaagggcttccagcgcgaccagaacctgcagctg

SEQ ID NO: 57949 - DNA, 2874 bp, Oryza sativa
taacagctaaacttttggattcaaagtcgaagaggatatgcaacagctttgaataaaaagctgcatgaaagaacccttatagttcttctgtaatagccttttgatatgtcaaaaggaatttgaaattttgcactatatatcatagtaccaatggcactagatacagctacaaccagccattttaaccagaaagattaaattgaaagaaggtaattttatactagtaaaaaaatggaaaaagaaactatcatactgtttcaatatactagtaggcactacaaagggggaaaacatcgaggcatgcaaatattgtggttcactgctagtttccttgcccaatgtgaacaattctcccgttaatcatttttttcaacaaaaaacggttaagttagttctatgcaaattatttgtttgaagatttcccaatatatttccatctagcagcaagctaaaacgtaatcaagcaaaaaagaccagctctaaatgcaagcaggaggaatccactacaacattttgaagtaaaaaagggagctaaattacccacctctcccggagcaaagcacaatcaagcacaccaaaagcgccgcctttagtagcccgcggcgctccatgccctaccaaaaaaagagagaaataaccaagcgcccatggcaaatcttggcaaaatttgcacaaatcaactcacctgatgccccaaatcggccaaatccaccccggaaattctgccgccgcgcgatcgagctacctgctaccgacgagttggggggaatcggagagtggcgaccaatcgatgaaatcgaagattttattgccgtatataggagtagtaaaagattattaacaatccgagttcgtgtaagtgtttgagctagtgaagaaaagtgaggagcaaaataagttaagagaggcgagaaataaattaattaaagattaaattaaggagcgagaagagggaacacgaaatgaggattagcgaagatatatatatagccgagccggtcttgtgggtcaaatgaccaatttgcccctaatgcttatctggatttagctgattaggatggcggtttcgggtcagattggagagaggaagcggatcgccatccgataaggttcagagcatctctctcttcgtcttcggtctttgcagccgaatttctttcttgttcggccatgccatagagtgggctccacacgtactgaacagcgattttttgctacagttttttcccttttttttcattttttacctttattaatacctcagttccaaaatgtaacatagctaaaaatgtttatattttgggatgaagggagtatattatcatatgaagaataactaaatatagtcagttgtctctcctaaaggtgtatccccatcttaaaatataatataacgaattctaaaattcgacacataggtcataatttcaatatgagttatgatttatgagtgtagctttttcatcacgtactagggtggagtagttgcgtaggagtagtctttttaattttctattaatttgcttattgcaatcttgattataaaaacttacaaactttttaggtttttattgtagtttaaatgagatatacaacacaatttattaatgattacatattttacaatcatatgaaaaatgcattttgataacacagatgaagtcatcaatctgaactaaaaaccaagtatggcatttttttctttgtcctttaagatgaagaatcttgtttcaaccaagaatatttttggctatttagaataatccgttgcaacgtacgggtttttgctagtatgaagaaaatatgttgaattagatatgtgaaggttatgattgattgaaaaaaaaaacgatttatgtgagaataagaggtgaattactatattctaaaataatttttttaatactagaatctgctacatttgaatacgaccgaggtagtgctgctagataacgcacagtacagtcaacaattaatgtacggcacccacaaaatactgtttgcacatagtttagttttctcactgtaatttaagtatgggtatgtgtattttgcccccgcgtcgcctcccccacgggcgacacgggagacggaaaccgccggcgtcgcccgctcctcccccctcctcctttcaccgcctcgccgccgtccgagcagccaccggcaaagccgcgcggccgcaaggatggcggcgacggggcttcaccctcgtcttcgtctccctctcccgtcgcggtgggaggccgcgcgcgggacgcgcgaagaccgcccagatccgggccgccacggccggatctggcggggaggccgccggcggcgggtcggtgtgaggtggcggtggcagttggtggtggtggcggcggggattaaaggtggcggggtggtggcagcaattggtggcggctggcgccggggaaggcaacgacggtggcgggggagacggcaatggcgatagggatggcgtgcgtgctggcggcgtgctgcttctcttgctgggggcgtcgatagtggggttggagatggtgcggggatggaggtggcggcgaggcttgcgacggaggccggatctggcggcgaggctggcattggcgaccagatccaggcgctggagatggttttgccccggtggcggttgcgacgacagcggagagctcggcgatggcgttggggcggttgcgttggcagtgccagcggtttgcgacgacaactgctggcgtcggtggctggtgatagcggcatcggcgacggcagccgacttgcagcggccgtgactgaggagacggtggcgacgtcgaaggatgtggcagtggaggtggggaaggagttgggtgtgaggtgacggcagcgacggtgaggtggtgaccgtgacggtgg

SEQ ID NO: 57950 - DNA, 15418 bp, Oryza sativa
  unsure (1)..(15418): unsure at all n locations
aacctaacccggccttggctgaaccgacaacgatggttaattccccctcctgagggcattgtcgtgctgtctcacacctcaagggtgattaccgggcgaaagcccagtcttggctcctttgagccctgatggacggcggcggcggtcttccgtcgcttctctttttgaagacgtcgttttggcacccccttgctgtagggcgatctcgtctgtgttcctttgttggtctagcggcggccggtccggtgctaaccttctcctggtcgtgtgtgttggcgttgccggtacgtgggtggtggtatattttttttctttctcctggttatgacccttcagggttataatcttgtaattttttcctgctctatcaatataatttcgcaccgtctcgtgcgagtcgttaaaaaaaagtatgggtatgttgcaccaaactagtgatggtgtcgtcattgccggggacatcgcatctagagctatagcttggtctctttactctgcacgagtatccatcagtttgttgagttggttatgcatgaattcgacgtaacttcttcatgtggcaataacgatgtaacgatataagtatgatatattatgatgcgcaagtagctagtgtactgcaatagtcatatatatgaatagagaggcttgattaatttggcttctttctgaaatgtttaattatctaaaccttgtttgaaacctgctacctgaaagacgagcgatcgatcgagtcagcatgcaattaagcatcgacgtcgcgtgaaatggcagcgaatttagcgtgtgatagcctcgttgcttgaacgatcggagcagctcacctctggaatcgaagaagcctgacacgaaaaggcgagagagaaaaattcttcatattaattactcgcttaatatatactcccttcatcctaaaatatttgacgccgttgactttttttaaaatatttgaccgttcgtcttatttaaaaaattcaaaaaatttaagtaattattaattctttttctatcatttgatttattgttaaatatacttttatgtatacatatagttttacacattttacggtcaagcatgtttaaaaaagtcaacggcgaacatttagagtaggagggagtaattcagacgtgcgggaaaccgaaaggaggtgctgcgtgcctgaatcgaatcgcatcatattgagcgatcgccgacgcaggatggcaggttagcatcatcaggatgcatggaaatgtggaagcactggatttaccaaatttatctcaataataatgttaacggattagattccacgctctgcaagcccaagatattgggatgtgtagcggtgagattcggttgttgaagatgcatcatctagcaataggatggtactactacctgtaactgcagtgcacggtgagtgatcacgcacgtcagactgatcaaatcatgatgttgcgattctcggcgatatcgagctgcagcgtctatctacggagcagagctctccttgatcaggtccaatattccagtatggtcatcaggtcacctgatcagggcagctaaccaacaaccatttgatcttggtgtgcagtactgcctaaatgctatattcgttttaaaatattattacaaaggatattttagaacggatgaactactgtaacatattggagaataaaaattctctaataagcaaaaccaacatattagagaataaaaaataatttttagataaaacttttatatgtgtgttagcgacttaaaagccaacactgaaaaaaaaaccaagttgaaaatatcttaaaacaaattcgtaaaaattatgtttgaaaatacaaattttgtcaatggcttcggtttattagggcaactagtgagactaatatatgcgagcgaaggaacctaaagtgaactttttcctgaagaaatcaaccaaccgggccttgccttatataacggcccacccatctccccctcccaggccggacgcggagcccacggagcgatgcgatggaaagaaagccagcgctgcagcggcgcacccaggcccagcgcgggggctcactatcaccaaactcgctgattaattcgcgcgtccccccaaccccaccgccacacgaccacgagcgcggtcgtgcgatgccgtgccgtgccgtgcgaaacggctgcatatgcatgctctcgcatctggactggatcaacccaacggtgaccctgaccagtgaccaccggcttctcttctccgccggttagtgctgctgcttcggcggcgatgcgaagataggattctaaatttataatctcccagatggaagtacacccctttttttttatatcaattaaataattataaaaaaattaacaaggtagattaatatataatatatcactcaatgtttagattcgacttctacaagttacaataaaaataataaaaatagtaacaaattaaactgtaactagtgtattttttttatttttgctgtaacttataaaaggcgaatttggacttgcatgtttatggcgtaatatattacatattaaaaaatttaaaaagatttcatgactatttagttgatatgtagtgcttacaaaagtttccccatctcaaatcatcatcatccaactactactgcaagttcctacttctgtcacctactgctgtgctgcattccctgccccagatcgatcaggtccccaactcacaacgacccatgcatctgctgaacctgtgctttactgaaatcatgcacaccctaggttcgttattcttctctcacctctaattctcttcacatcgtactatgttacatgcaccattacatcaggtacatattgctcggtattcacaatggagtataaacctacctccgatttgttttcattccatcccagcagcatcctattctgcttgtttcgaccgatttaacagaaagatgttcagatacggttgctactacaatacaaacaccttttctgaagtttccgggtttttacacaaaagttgcagaagcacacggttctccaaatcatttcatatattccatcaggccgcaaatcaacagtatgcacataaaaattctaacaactcgcaacagaaacgagtctatcacaattcgaaattcagcataaattatttcggaaactgagcatatgcaaatcggtcagaaaagatcggaacctatgcctggctttaaagcttgacgatgcctcgtcgcttctcctcgatcccctctgctcatctgagaggatcggagcaccgccgccgccgccgccattagtagcaggggtacaccacgcagcgcctgcgccgcggcggcgtgcacagcatcagcagcagcaacgcgaggacgacggcgacgagcagccccagcaggttgaactccggatcgtcgtccgtctggctgcaacacagcttccccatgccacccgcttcagaaggagaggacgagagttcttggcttgcaagatgaacttctctcggtctctttctttgagaggaagtagaagagaagcagggcttcttggcagtagtgggttttctgaatctgaaagactctgaaagactccggatggaggtcgtctcgtctctgtattctatgacactttggctatgaatcttggggtgctttcaagcatcatgtgggctggctggttgttgaggcatcactgtctagcccttccatgatgcaacttcttttccatggctatgtcctttaggttggatatcagacaaatcgaacaaccaattccgcaccaaccatggccaccactaccagcacatcaggatagagttcttgtaagttataactatgcagagattgaagtgcatttcgggattttactagtgttgattaatcttgaaatgtctagttttttttaatttctttcagatttcagtatggtggacctgatcatctctcttttagccaagacctgatcaatgcaaacttatacattcagttaactggcactgtcattgacgtagtattaatttggatataggatcatcgctgatgcgctgaaaatcaagttggatccaccctttgatgatacggaaatgccaagtggtgaaagaccaggtcacattaatttgagaacctgttcttttattcttctctagcacggttctgaaaaacaatggttcctctcttttttttttacaggacactgttgaatattctggtgagtaatccctccgttccaaaataaatacagttttgtacggttcatgttcaacgtttgaccgttcgtcttatttgaaatttttttattagtattttttattgttattagatgataaaatatgaatagtagcaattatgggcgtccactgcttcacatgataatcacatcactttgggttacgctacgcacgtcatcagctttcattaatagccacttgctgtcactgtatcatgatcctgactgcaattaggcttcctaatgtggataaagacttgcaaagatggctaccaattgctgctgcttaatctgaataaagaacattcttacctgaactaacacaagggctgcaggctgacctagactgcactgcaatttttttctctgacggtgacagattcagcaataatgagagatcaatttactgatcccctcgtggctgtattacaagccaagcaacccctaatctacgtgcttattaaataatacatatacagcacatgctaatcaacgttaaatactcgaaattgcacaaactagcagtcatcatctcagttgaagatgaagtatttaaccaacaagaacagataagcatcatgtacagtttcttgctaataaactgaagggagaaaatttggacatttcgtggaggcatgcagcaatgcattttgtttggtacgatgcgtctcattttcaaatttcaattcagcggtgcttcaattggatcggcggtggcttgttgttcttgtttcggcgactcaattggagcggcggtggcttgttgttcttgttcgtcatcctttttatccttagcgacctgctcctctcctttttcatccgtttttgttgctgtcatggcctccttcaattcaattgtttgtttcccatctgattgccctgcacatggaatgggaacgtctaggagtattatgtgagcagttgaaatcggcagctgataaagttcatctcttttttatttttaaaggaaaacagatcagcagaattatagattgcaatttatgcaagcatgcctagatcactggatgtaaggaataatgttgttagagacaaaatgattagaaaagatgcaaaagaagaataatgatcgttgggtcccctgattttgataaacacaatagatgagataatagcatgtgcatgtgctaccttcggttttttttttttgagctgctaccttcgtatttagattattagatatatataacactgttgattttatgcagtccttggtgcacaactttgaccactattttctaagtattagaatataataatatgatctattaaaatcataatgttttaaaagtaattctaaataaaaattttacctgtatgatctcaatttttaaactaaataagtgtggatgatcaaagttttgaaatttcaaccaaaatatagttaagaatgtcatatttaacgggaggcaggaaatttcagattattatttttagataaatagtccttgtgcgtgtaatgtttagcaatcaaagaaactaaattgaaaaagtgttttcatccctcaggcgatatctccttgtttcatgcatgccacctaaatagttattattttttttaaaaaattacaagataaattaatatgaaatataacacttcacaaaagtgcatgttaaaattcaacttctacatgttgtaacaaaaataattaatgataactatttttaatttaatttgttatttttattgcaatttgtagaaatcgaatttggccttgtatgtttgtggagtgatatatttcatattaatctatgttatttttttaaaaaaatttatattatttatacgtcatgcaaacatctagggacattccctctgaaccttaccatcgtcatctttcgaaacggcaatggatttctcctcctctgtctcctgggagacgatgatctcctcgtgttcgaccttgatctcctcgcgttcgacttcgaccttggtgatctcatctctcgaaatgacagcggatttctcctcctcctcctctgtctcctgtgagacgatgatcttctcctcctcctcctcgaccttgatctcctcctgttcgacattgatcgcctcaatgttgcttgtctccttcttggcatcttctgcctgatcaactccggccaccgcctccatttcgccattgttggacttagaagagctaggttgctctagttgtgctacctcctcgccggccaccggcgccgggacagcggccgggaaggcggcggcggcgctactactggtgtcattctccagggtggccggggcagtcgtcggcgaggtgacactagtgacgtcatcctcctgatgaacctcgtcggcgttggcgacgaccggccgggcacgggcgccggggaaggtgacgctgccttcgtcgtcctcggcgacgggggcaaccgcgaaggtgatgctttcgtcgtcgttgggctgctcgtcgtcgtcgtcgtcgtcgtcgtcctcggctaatgccgcctcgtcgtcgtcttcctcctcgacggctgcctccattgttgccgtggcaacaacctcgtcgtcgttcttgttcttgttcttgtcctcctctgctttaattttctcatcgacggcggcgacattctcggttgatgcgacgtcgttcttggcgtcagtgatcttctccttctccttgacgaactcctccttcattggcactactacatcctctttcttctcatcaatggcgaccttggtcggaatcaccttctccttcttcttatcatcggtgacagcttcttgtttgttcttggcctcctcctttttcttctcctcgacgatcttcttcacggccgccggcgtcgccttggccgccgccgccgtcgtcgtcttctcgacgatcactacgccggtgtccttgacgacgacctcatcggcggcggccgccgtggtgctctcctcgacatccttcttctcctcatcaatggccttctctttcggcgtcgccttgcccttccccttgacctcttcgttgacactgctttccttgacaacggcggcggccgagctctcgtcggacggcggcggcggcgcgtgagacggggcggcgttggcggcggcgacgacgctggacttccgccggaagaggcggcggctggatctgccgccggtggagccgacggtgttgccggtggccacagcttctttggagccaccgcaacccatggcggcggccggctggtgatgtggagcaggaggaggaggaggacatgcggcgaggagagaatgtaggagacacaagagaggattgcatgggaaaatatatgctgcatgcacgcatgcatgaacgaatgttcatatggcgtttgcaaatttagggaaaccataaacaaacaggaggttttgtgacatgtgtttagtgctctaattgcagcctcattgttctatatattcgtagaaaaaaaatctttagcaaggctgtaggtaattccaggtggttttttcagcttcagatggaggtttaactttataatactaaatttgatgagctgttttacctgagatggatgctgccggttttttttgaaactgaagccagcaaagctggtgttatattaagtaggaaaaaaagtatttacatgatcaccaatggtgatggggaaaaacagagaaaaggaagacagggaaaagaagaaaaactgagtcttaggcggataatctcgagatgttttttgctccacatattctcaataacttgattttatcttgtatcttgtccagcagcgtatcttatccagcagctgcatcagagttttttcttgatttcgaaacacacgtctattccactcacaccgtatttcccatgctacccgcatgtggactgatttgttttctttggctttgtctttcccaccttgagatgttctcttaatccaccagtccaacagcggctcattttcatcatgtgtcatgtcaatttcattgcagttcagcctacttaggaccctctcccaaatctgtcaaaggacaatctttgaagagatgttgagctgtttctaaattcctataatatagttgatagaaatagttgtttggccattatctgatctatagctgatctgttgtccaaatcctattttgcagcaatagctaggcaaagtgtttgcatttggagggtgcccattgtttccaaattatttttgctgcagttgagtttatccttccgttgaattgtgctatataggttgacctcacactgtgttttccattgctcatccatcttgaagttatggtatcgtcggcaccttccgtgagggtgatgtcgttgctccatacttggtagaatacctcaaagtactccttgactagctaaactgtgaggttgtgtctgatattctctattcattggtcattagctagtccttcctgtactgaccttccttttcttttggcatgcttgtatagagttgtagccaattccttgagtagttgtccaccaattcagtttgattcctaaaagctcattttgcgtccatctcctattgacatcttgattgatcatgccatgagatgaagctgttggaaatgatatagtatactcacctaactggagtaaatcgggagctgtctgaattttgcccctgaatatctggaatgcaagttgctaaggagagaacagtagttgaaaagttgaaagagagaccagtgggtgagatcgagagttgcatactggcatgatgcaagccattgaatgttagttacatgcaccgatgcacaactactgttctcactgcaagcctataaatcgtccacttggaactacaacatcaaatcaaaccatatgacagcaatttgcaaggatatgttgccttcgctcctgaaaattctgttcttggattgagttctttgtgaagctgtagctagcattttctctcggtgaaatggatccacctgggcctggaggccgggaggaggccctggcggttggggccctcctggaggtggccctgggggatggggccctcctggaggtggccctggaggatgggccccactacctcctgctggacctggctttctgggtggcccaggccctggccctggttactgggggcctggatttggaggtttcatggggtcctggtaagctgtgtacattacactgccctaaactttctggaagtttaacctcgcgttgcaattgcaaacaaagtttttaattcatctgcttaggaattcacattatcacatatgagttaaaaggtctacgttatgtgcaagttcaaccaatcgaagcacacaccaccgaaatttcacatatcaactcatcaaaagtttgaatctctgaaactctcttgtgcagtttttatgtcctctgctgctgctgcttgctccaggattgttgtgggccattgctggggcgtccaggcccgggtggcccatcgtcacccttctgataccaccctgaccttacccacctagtgaaataatgcgatgtgtttaccattacacatgggaccaaaatcgttacacatcctctgatgaagaacaagtacctgatagcagcttgcagagtcttatatatgctctttactttgtcacttatctctaggggtgttatgcataatcctacttgtttgcatttgttagcaactcgacgatataatgatggttctgctttggtacctcgttgatgccttacaaatgtcaaatcaaatacaacctgacagttttcaaactgacaccagcccaggtgaaaaggaaaacaacgaagaaaactgcaccgattctaagaaagaaccgaatccaacacactataaaaaccccagtgaggggagagaaaagaaatcccgggttagtctactgagccagcagcatctcttggacggttctgtacagatgtaaaagctgttctatgcacgcaggcaattggtacctttgttatatgcaaaaccataatggctagtgaaatacgatgctaaggaatgctcccctttcaagattgatgcgtagctgccctccaattcttgtgacaaactgaagtgtccagctgatgggtttttggaagaacttgacctcataagcgcaggaggtaacccagagaagtaccaagaagtgccacataaaccacaaacagcaaggggaaaccaacttgattccttggtgttcccttctttcgtagaaacatctagccaagccatgcatcagaattagtagacatgtcatgcatgaaacatagtatatgaccagtggtttcaggatggaatttgagtcataccatttcttgctgtaacttatcccgctcctgggtggtagttctgctctcttctctcagctttattatcattttttcagcctgcaaatcagaaagtttgtgtttcacttcagaaagtattatctggaatataagattaaaatcttagtttatcaagcattataagctccatgtttcaggaggatctcattctgaactattgatttgtcctgtccaaaatattacctcttccaattttacttcgagaccattgagctttgacttcaggttctgaacatcttccgttacctgtccaaaatacagagcaacttcaataaaactagtgggaagattgtttaagagacagatcggaaatgtagtgagaaaaatatgtaatttgaagatctctataagtgcagcttagctttagtgcattgtatctagttgcatatttatttcattaaagctacttccagtttaatggaagatagaagaatcacaaaatataaaatacttatttcaagaaatacacttgttgtgtatgaccaattaaaggatgttggatgcaatggacgattggcaaatgtgaccaaaattcgaatcaatagtcagaacaagtaagcattcttatgccatggtgtttgaaaactaagtggagacattttaaccaggaataggtggaattttgtaaaaatctagccactaatagactttccaattgagatggttagcaagaaccctgaccagctaaaattcagtcaaagactagcactgcaggcctccagaaactcaactcatttttgccttatactccacttaaggggcatgtgaaaatagtagaggaaatgcttacatggcatagttgacgactctgcacattgacagccccttgctcacttaacacgacagctgcttttggaagagtttcttctagaggagattccttcaaacttgctaggttttgttcgaaaggatggagagattcgacagtaatggaagaggtatctgttggagggggtggagattctgtcaatataacaggtgtctccttcaatggtgtaggaacttctctcaggattggagtctccttgactggggatacgggtgcaggaacttctctcaggaatgaagtctccctgacaggggaaatatgcacaggaacttctctgagaattggagcctccttgacagggtaagggggtgcaggaataacaactgggtcttcttccagaggggaatgaacctctttctctgcaactggaatttcattcttaatgttcaacgtgtcctttaatgaaggaacctcaacagctgcctcagtgtttggaattccattaattggctgctctccaaaaggatgagatgcactaacaagaacaaccctcaatttactttcctcgatatatctgccactttctttagaaaactgtaaaaaaaaatgatgagttagaagaacaccatgtgtacagctctttccaaaaaaaagggggtcatattcttatgtgcttacataagaaggaacaaggtcctcatctgatgttccataagggacaactgttgtctgaaccaaaaacttgtcttttaattgcatgtctggtggagcagtacgttgtgcttgcatggtaacttcattcagacgagtaaagaaaagaatcaataagagaaaagagcaatttaactgattggtaaaaattataacagaaccaataaacgataagaaacatctgtctaataattactctcccccaaaagaaagcacactgtgcttctttactgcacagttcaactaggaatgagttcattcctagaaagctttatatagattccacagaaaatgaaaatggctatcttgcatgactttccaaaatgagcatacaaaatgcactttatcgtactccctccatttcaagttataagacattttgactttggtcaaagtcaaactgttttacgtttgactaagtttatagacaaatatagtaatatttataatactaaattagtttcatcaaatcaataattgaatataatttcataataaatttgtcttgggttgaaaatgttactaattttttctacaaacttagtcaaaatgtcttataacctgaaacggagggagtatatgctaatatagatcaacaaggtaagtaaatatatctccggtgcaataatccttgcatacacaaaacaatattgccagtgagtaaatgcagtagtgagctactgaacatacctgtgaaatcacatgttgaccttggaaggatgactccagtgtttggtcgaacacaataccttttaggtgatgttgttttaacctaacaaatttgaagggcaatatcagacatagtcctattagatgctcaaacggcaaaaattatcatcctttgattgagcataaaagcgattaaagaatacataatattcagaaaacaaaatatctaagtttagtgtcatcagaaatggcatttaaaaacaataggaaataccttgcattaaaaatacaattttccagccttctcgttaggttaccatataaatatgtatctagcatcactatataattcttgtacaataccataaaaagacatttaaatttagaaaaataaaagtagttgtatgtagtagcagacaaattaatatgtattctttgatatgcccatttggtattcaagaattaaggccatagccgcattcaaaataatagtactgatggacaacttcatggttacaattacctaggaaaggatacacaatgtttagatagcacaatgtacacagtacaccatcaggagctatacttaacataaaaacaagcggcatttgaatttgtctttgagagcactgacaaaccttgaatgcgacatattcattggatttgttgacaagatggacagtacatgaactttgcttcttcacctcaactgccaataataaatgagataccaagtcagattatcattcaaaactttgagacggaatgtgttttgtatcctatactgtacagcagttaaacacatttcaattatatggctgaatgttgtagtttcaaatacaggtgtggtaggaaccagtacgagaccgtcttgttcatccaatgaaaattgcaaagaccaatttaatcatgtgcaaatttgacaagtactctaaattgcacagttcataagaaaaccacctgcagaactaggatacgataattttcagtttcactccccttcctcttttatcagcacatgatgatcttttgagtgatgcatgactaaaaggtaaaaactaacaccaccactccctccttttatgattgttagcatgtgcatcgctgtatcagtccattctcagtagttactgcaaccgcatccaatccaggtaagccaattagacaagcaatcagatccctctcccacacacagacatcagactttacaaccactcgcaccacgaaatcgacctgtcagtaaccaaacgaacagaaaaaggagcagcccactaaaaaagcagcctttaaaaaattccaaaacaaaagtttacagaaaattccaaactccggagccatgtttgtagaatgttatctaagtaacctagagaaaagttaacagtaaaaacaaaatcactcattgcttcttcacttaacactgtaataatctaacaaaaaaaattctgcaagtacctacacctctaaacagaatcaaaaccattcagacaagaaaaattaaaaaatgacagtgaaacgaaaatcaaaaccactaagaaatgaaaaaaatagaaaccagagtggaacgaaaattcccactaatttgaaatgaaaatcgctaagacccttaaacctgttgatcagtccaaacgaggggaaatagttttggaacactaatactggaaccaattccaatcaacagaggctacaaattaaattccactgagggcgaaaatacccggcacgatacaaagtaatactacagcgaagcgaagaaacaggcagggaagtcgcacaccacgacacacatacacggaatccactcgattgaagtcgattcgcccgttaacgcgagacggatcggaattactctctactccactctctatctagggggtggtgaggcgtggcgccgtggcggtggcgtggcagcgggggggacttacaggtgaactggagctcgcgagggtggatctcggcgaggtcctggcccatctccaccgcaccacgaacgagacgccgcccgccttcagcaccgcctccaccgacgttgggtcgccgcgcgcggaagcctagctagctaccaatcaatcgaatcccccgcggactctgaccgggcgagctggagaggagagacaggcggcgatggcttcgagagaggggtggtggaggtggaggtggagttggagngaagtcgaagacgacgacgggaaggcccaccaccaccaccactctctctcgaagccgttttgaggaggaggcgactctcggggacgcggagcagaaggaggcgagattttccagggactggaggattgatgggggcggccttttcattggtgcgggccaacccggcgtatgtctacccgttttttcacattacgcccctacaaaatctaattttatactacaccttttgtgttacagagtctgatactcccttcatcccacggtaagttactccctccgtcctagaaaaaccaaccttactgagaatcacctttggtaacaattttggtcaccaaatccttactaagattggattttttttttaaacggagaggaagtaaaaaagtactggatatgatgcatactagtaatatattaacttattggatgaaggaagtaattggtaaacagtcagtgagaatctgtcaaataagcaggtttctaggttgttatgcctactatagttatagttcatttctaggtctcatgtttaggaattcatttatagattttgcacctacttaatctcaaaatccaaagtgcgaatctatcgttgtttgtaagaactcaagattatcgaattggttgcatctgtcggaaactctc

SEQ ID NO: 57951 - DNA, 7239 bp, Oryza sativa
  unsure (1)..(7239): unsure at all n locations
aaaccaatttatccgagtttaaatcctagatttgtcacgggtgcacacgtttacaacttattattctttcagtaagaagcgacgtactcgttgacggcgagacgtcacttcgtcaatctcaagatatatcggtccagccttctgaaggaatggaggtgcttatagaggcatggtgtgtgtgcgtgtgtgcgtttaaaaggaatgagtgtgcgtggggtgtctacatttattttgtgtttctaacaaaaaaagttggtgcatagaataaacatttggtctacttatatttgtgacccgagggatcaacccttatttgacattaggcgagaatttgggcccctgggtgcaaatattcagttggtctgtcatgcctatgacaggtgggtcccgcagcattcgttgtcgtgtcggcaagtgacgtggcaggtgcaggtctggtgccacacacggcacatgcccggaaatatacggcgtgattcattccgctcaaagtcattcctaccagtaccccgcgcagggtcgcgcaagtatcaaccgaatcgtcaaatggtccaatggcccaccgccacgtgggccggcctggttggtttctactgctaccgagagagatccagggggacattgactgtggatttccacgtggatttgcagtcttgcagagggtgcggcatcatggtcatccatcaatactgtagcagtgtagttgcacacccaacagagcagccattgatgcttgtgattgatgctctaccagcgtttctaaacagtttagggtggggttaccgtggtatataccatagttttaaaaactgagaaaattatcgcacgtgatagccgcgatagtcacacgattttgtaaatcctcttttactcccttcagatgagacttgagagtgaagttgatggtgttgaatcactaaattggtgaggttatctgttgcttgcaagatacagattaactaactaagcactagctctagaatccttttattctattcttcattttattttgttgttttactttacatttgtttgtatgaactactcctaacaaacaaagcacatgctctagaatccttttatttggtttttgttttacttttacctaagtggagtatgtgcatatctctactcttcatgtccatatacgagcaattattaaagttctgataaagaaaatggttgttgaagtcttaaatataagaaaatggctttgtaccatgtttaataaattggaagcacgctaggatagacaacttttgcagtgtactgtttcacaatgaaaaaaaaaagagaaaaaaggagtctttacgaaatagagtcaggacacagaactttgttaatgtgttagtagtattacatacacaatgaaaaaagaagaaaagagtcttcataaagaaaatccttttcacgcaatgattcaagtggcatgagaatcatgattttaaagttgtctgatttatataacaaaacttttcctcaaagttagctatatgatcttctttccaattatatcgtgattaaggagtacatttaataactattatgtaggtttctaagatagagcatacatgcttttgactttattacattatagtaattacttctcctttggggatatctattcgggggttatgtcgatggtcgctagtaatgctagctatatttttccctaaagaaaggcagtgctcctattttctcgcgtggggatttaatctgttttgcacaattgcaacattattaatatcatcataatatagaaattgaaatgtacatgatgcaatatttacagttgtatacataaaaacgattatcaatgctaaatactagtagtacaatataacgaacaaccaaccccgccaatgtttcactagcactcctatgtcattataaaaaaatgtattattagagtgtgttgagagaaggagaaatgagaaaataaaaaaatattatttttaaaagcttaaaaaaatattaatatgatttttaaagcaactttaccgtagttttttcttttaaaaaaattgcttcaacttcaaacgagagagcagtaatcaaacactcactaagaaaaacaaaatctacataattgtgtaaatcgccctgtcctccctgggacttgatttccttcaaaggtactcaggttttcgtctacggtggttgaggtctcactctccaaccgaccaccggccattccaatttcctagctagcacagtagctccaagtccttttccagccaaaccgctcctagaaaacgagaggtttccggacgctctcaccgccggtggccatcacactcgctgacaaaaccgaaggttggtacagtggccgtaacgctctcgctaatcaccatccactgctcatgctctctgctcttctcttttcccagcattgggtgttaggttacgcgcacatatcactgtatatataataccacactcatatcctctcggatgtgtcccctaacacatattctacgagacgaaattcagcgactcatcactggtctcattaaaatcttattgaaagtctacctgcatgtgcgtaatatacatgtacattaggatttaaatcctggtgggtggagtcatgtactcatgactctaagcaccatgtcacttatacttcccctaattgtttttttggtgtgatggtgagaaagtagagaaaaaaaaagaggtcgctttagcaattttggctgtttattttactactcttaacttttccttggatctatccatggatcgaaaggaaaggtctgaaaaaactctgaattctgatcatgagatgagatgacacgagaggagaggcagacgctgacatggtgacgtgcatagctcaggctcagattctgggatctttgagtggacccacgaggccataatatggcagtgccggcccaagttgggagttggtcatcgtctaaatgggccgaaactggatagttacctgaagactgcaccaattcatttctgcccagggagctccttttttttcctttttgaaaagaaaggagcttatctttgtttcttcagaaattcagatagttcagcttcagatggaacacttcttgttactacgaagcagcgaagagatgtcgagattattgccattttagcggacagtacatgaactgaattcaaaccaagctgacaaattgaggacacttttattcatcgatttgaaataggacagacggatggccgacgatactacagaaaaaaagacagtgagatttatcatcatctcaactaattgactgacacgtgtcgaaatggcaacaacacatattccctccgtccaaaaaaaaaaagtaaaccctgaatttctgtgccaacatttgactgtctgtcttatatgaaatttttttataattagtattttcattgttattagatgataaaacatgattaatattttatgcgtgacttatctttttaatttttttcataattttttcaaataagacggacagtcaaacattggacacggaaaccagggtttgtctttttttttttaacggagggagtaaccctgaacgtgtcgtgtctgattattttgtgcgtgcattcacgctctgctcgtacgattcactcactggctgccgatgctgaagtcgaagttgccgcacctggtcatggtgccgagtagcaagccgctgaacccgaactgccacttctccaggtcgaacaccaccaggttgtcctccatctgatgcccgccgatgatcaccgccggcgcggccgcggcgcccatgtcgacgaacgcgaagcacgccgcctcctggctcacctccaccacggcgctggcgccgacgatcgtccagttctggccgccggccagcatcaggtcgacgctcgccgtgtacgggccgatgcgcgtcggcggcagcgccgacttctggtagcacaggtcgaacggccccgccgccggcgcgcgcgcgagcccggccgtggccgccgcgaacgcgtcgcgcaccggccggtagatgtcggagcgcagcgcggtgtacggcgtcgccgtgctcaccgcgacgccgcctgtgccttggcgagcgctgagcgacagggcgcccggggggagggggacttggacgctgttcacggcgacgccgatgacgccgatgtagtaggcggtgttcttggggttcttgagcaatggggtgtacctgagacggtcgctgacctgctgcggcggcgcggcttggagccagaacgggccgccgccgaagatggccgcgccgacatcaccggcggtggggaggcacagtgcgaacttcttctccaccttcagctgcccggcgacctgaagcggcagcgacaatggcgcccgggagaggccagcgacgccggcggcgccggcggggagcgagcccagcagcggctgcggcgcgcacgacgcgacggcggagagccacacctggaacagcgggttcttgccgtcggtggcgttcgccgacagctgcaccgtggtaaggtcgccgtacccgcactggccactcgccgggttgtacgcggtggcggaacacgcgcagcgcccgccgtcgccgccgttgctgccggcggcggtgtacgggcagttggggcggtggttccggttggcgacggcgcacacgccggcgccgcacgggatcgtccggtgcttccccgggcacgtggaccagacgagcgggccggcgaggtcgaggacgagctgcccgccgccgttcttgacggaggcggtgtagagcgacgtcgaggggtccttggcgaggcgggtcagtatgggcttggaaggtggccggtgctggccatcgccggcggcgagcgcgcacagcagcggcgccgcgagcagcgagagcacgagcgcgatcttgtagctggacgacatggccgagtatgtttaatttgtgggtgacttagcatgcgtctgtatgcgtatttatagtggtttgtctacgtggacagtagaccagcagggtttacataaccacggttatcatgtgcaataaccgtctcagtttttgaaaccaccgtatatatcgtgataaccgtcaaacccgattatcatgtacagtaactttatcagtttttgaaaccacagtatacatcacgataaccatcaaacctggttatcacgtgcagtaaccttctcagtttttgaaaccacagtatacatcacgataacagtcaaactgtgaggcggtgctaacttcatgtaaaacgatttggtaaacccttgtaatcactggattttcttttatttttcgaggatattggaacttcaactaggcgtgtatatgaagtctacgaagtacatctgcacgtgctgtttgtgctaattagctcagacaattacctcgtggctagtatcatatgggttttcataatgctaaccttgaggtttgcgtacgccacttgaacgaattcaccgatatctgggaaggatatgatattattcttgttagtcgtgacactcaccagcttcgattctcagcacctctcactagctagtcacgtttgtcacgaactcgcaattcagtattatccatggaccatggaccgttggatcaagcttctacggtccagatcgtgtgaacggttggcggtgtgctggtgttgggttgattaaaggtctatttgtttcagctccaacttttaaatctagatacagaagttgaatctgaaataaagttatgaagcatgctaaactcagctctactttttttttttcattttgtgagagctacattcagttctactatcatttaaggtgaaattgaaactatttggctggctatagctccagctgtactagaccggacctaattcgtgagcctgggctttaactcggtgtaaaatgtgggtcctgtgtaatataatttgggcatgtcctgaccgttcgatcaaatttcagcggtccagattgcttcccgcggaggaaaacgttcatcctgatgatgtgctgatggaacgagagattgggaaaaaaaattaacgaagagagatggaaaaatgaaaaggacaaaatgaaaatataccgccaatggttcggagactaaaactccgaccccatttttcggctgggaaaacgtcgatcctcttttttttttggaacggttcggcgatcctcattccgcgctcgtctgatctcaatgcaatatgtgtgagagtgtcatatggcaatcacaggaaactattttaaacactcgggtggatgtccacccggtttttttgcatgtcatctaaatggttacgaaaaattttcaaaaaattgacataataggttaatatgtaatatatcactttacaaacatgcaagttcaatgcgacttctacaanttgtaacaaaaataacaaatcaaactctaattagtatacgtatattcacagtcaaatttgttatttttgttataacttgtagaagtcgaatttgaacttgcatgtttgtgaagtgatatattacatattaacctatcttgtgaatttttttagaattttttcataatcatttaggtggcatgcaagaaacgggtggacgtctatccgagatattagaatccatcatcggcaatcacaagcttgatgctcaagtatatatggattttgaattgttcttcagagagatgtttgtagttagctaagctacatcgtcatattagattagatcagatcatccgagcaatgctcgcagaagaaaacttgctacggttgtgacatgaacatcaggaacaatatattactacactttcatatgacaaaactactcaagaaaatgctcagggggtacaaaaactgtctcaacgatgcatcaaagtatcaaacatgcaaaagactgaaggaatctgccgtcgcaaggatctgtttatgaagtgccttctaagctgaatccggagcccgagcattcaaggtgtgcattccattcctcacacatcacactgcgaaatttttttgacgggtatcacactgcaaaattcagtagtaagggttgcatttaaatgttaggcaaaggtgtcatatgaattttgcaaaataaacaaaataaacagttttttttcagagaagaggcattgtcagatagaacggtctaaatcctgtacaaattgagaaaaactcttgcgtcccaaacaagttcgtcaaaacctcggaaactgttttaaaaaatagtcaaacagtcataaaaatgcatgctatctaaatagacataaaaaatatgaaaaaacaccgtgaagatagattaatatgtgatgtatcactaca

SEQ ID NO: 57952 - DNA, 2384 bp, Oryza sativa
aaatcaaatcaattggtaagtaagtttctgcatttgcctgaagatttacttaaaccaaatgcaagtgttagtgtgccagttctccaaggtagcttaggatggactgaattccatgcaaattttgcatgaaaaagttcagagcttaccgaaatgtgtcaaaatggcaggagagcatcggacaggtaggacctagtgggggtgtcctgggctagctgttaagcaggggaccactaggtttcctttgactgactgtgataggctggaaagccgggcagtatgatgcacttgtcatcttgtgtacaggagtgcgtgccatcctcaccaatgcatggcatggctacctgcatcagaaagggaggagaagcattctcttttcggcctcctcaaagtttcctgtcaccagaaagtgaaaacctgtctccagtctccctgttagagaagaaaaataaataacaacagagagagattttcttggaggatgaaagactgaagactgaagaatacaatcttggaacttgggagctttgaaggttgaaatttgcagcagctgctgctgcttctctgattttttttttttacttctgtaaataatgattgtggttcagtttctagttttcagaataattgtctgtctgtacatatcatgttttggatatggcctatgcatgctcgaggttagttcagtttcattttatgctggcaagtggtagcaagttgttattcccaaatatttatcctcgcttaaactactgcaatttggtcatgtcataacaagaaacaagtatgttcagttgatcgatctggttagaaaactatatgcatgaaaacgtttgatacaaaggcacatgctgacctcaatcaaagaggtctcgagaaaaactgatgtaaccaatacgacatcaaaaacattgggttcatttagggtcttaaagaattgagcaggcataatgtggtggctaccactgggaaataaagattgaagatcatgtctaaaatgaggacgacctttacaggcatttcagatgggatttggtaggtttgaaactacagagttctatattcgaccaaaagtatttccatcgaattgaactctgaacagttcatgctaatcttgataggtcagaatttggtcactttttttctgcagcaaattctcgtgctgtttcgagttcagattttttcagaaagcattttattttcagagtacattaaagcaagacttacctaacagacacttgctacgtttagttgatggaagaatctaaatgatttaggcgacaatgtgcaatacaactctttgcaggctagcagaatgcaagttgttttatattttaaaccaatgcgagttgtaacaagtaatagggggtccagtcagatactccctgagatccaaatctgaatccaatatattatcagatttgctcgcgcgtacgtacacattacagatagaaaattgcaggacatctgaacatttgtttagttccaaatctatctatagtaaattaagatttcattctgcaggcgtacgtttatctgaatgcaattacaaaataatgcagttacctggatcatcagactgactaattctcagagttgatttacacatacctcattaatttcggttcttccactgtcgactgaagtaaaactgcaaatcaaacagcaagctgacatcagtatcgttaattctactcactttatccaaaaaagtattgttaattctagtctaagtggccaagtacagacattcaagtgatccggttcatccatggattaaagtcaattttgagttttccaacaccaactagaccttaaccagtcttagtagcatataatactggttccatataattatatgcttacatgaacactgcggctgcaatgaacctggactgttcatggagattatctcagatgcaaagttcaattgatttccagatactaacatatatcgatataaacatcttcagtgtgcctaagtgaccagccaaaagccaaagaaaacaaaagattaaagaagaggagcacatgcaccatgtccttctgcagatgagaatccaatgactgccacaaaaaagaaatactcattgcaacaggccaacttccagcctgtcttgtgcagaattctagataacttcttaccagatccatataaactatatagtccgcaaagtattgccatctatatcaagtatcataatacctaaactacaagtatataggaatccgaaactagataactgaaagcctgcataaggagctttaatggcaggtgtacttcatttcaagtgttaaaactgtagtgtatgttaccatcggattctactaatgattctttcatgttgaagtcagcttcctgtataatatggtgaacccagagactg

SEQ ID NO: 57953 - DNA, 933 bp, Oryza sativa
agctcctgcacgtcatcaacctgaccgatcttgatgatctcactcgccttctccgcgcagacggcagcagcaccagaatccatgccaaaatttgcccagttctccaagaatctatgccctactccaaactcaccagttgatcagagtatcttggttgagtgtggtttatatatagtggctgccaggttcatcaccgccgtccattctgaattggtaactactgtaccaattagcgacagttcaaaattagttgcataatttctgtcttgtttggagatgactctgcgtcggacatccgatattccatcaaatatcggacgcatgatgtttgcgtgtcatcacaccacctgcgtatgcagcatgaccaaaaaaaaattggtccgtcaaatgttccagttgactaacgagtgaaatatcaagttatataggatgaaacaaaaaattagcaactaaaacatttaaaaagcttatgaaacatgatgaaaatacacgttgaaacatatcgctatcacatatgaaacaaccagtgttagtggattgaaacatatgtttttctttcatcaaaatataatcatacgatatcttgttataaagatttaattatgaagaatacagcggtgtgatcggattatagattagataagtaatttaagagaaaattcgttttgaatatcattaaaggtgcatgttatatggttggagatagagatacagacttggatatgtgcatatgtgttagagactgcccgtccgatttttcttggtggttcaagcattcgagaagaagcattttctgtcttgtttaggtgatcaacttgcgtttatcgattggtccactggcatggtggtgaaagggagatcgagaaatgcatggttgcacttgtattggagatcacttgcagtggcagagagcatagtgcatagctagctgca

SEQ ID NO: 57954 - DNA, 7104 bp, Oryza sativa
cttctctttagcagctaccccttcatagattcaaattttaaatttcaaaagacccacaaactcatctatgatcctgatcggagagttttaagattctgataagctagctggtaaaaatccgaagaaactgagagtatctgattgaaaatctatactgtttggggagcttctactagctaatctctagctgccagtagctcccaaagcataccctacatctgcattccctcgtgatctcagatttgctcgagatatgcaaaaacaccctaaaaagatggcctaattacgaattgggaggggtaaaatggcataatggtaattaataatgatagtgatagtagtacgacgccatctgtgatccatccataacccgttccgttccattcctgtctcctcgtgatctctacctctcgacggaatcgcgcgccgcgctctcgcgacgccgccgccgccgatcgatcgatggacgccgaggccggcgtcggcggcgccgaccagctgccggtacgcgccccccgcctccggccgctctgctccctccccccctcattgccctgtctctctgctctccttcacgcgcgctctctctctctgtgctggtgcggattgcgctttgggggggggggggggggcggaggctggatcctaggtttggtaggttaagtggattacgagggatgattttgggggtgggattttgtggatttgagttatgtttcggatgggatcaagggtttcattgcgaggaatttcacccgcgattttttttaaaaaaaatcggcgttcgatggcgagggtttcgcttggaggaatcggtcgtcattgggtttgtttgtttgtttcgcttggtgaaatccttaggtcttcattttgttctggtcgtgtagagtggtttgatcgtgtaggtggtccagggattcgattatgatttcaaaaattgattcagaggggacgtacgatcacacctgctaagcagatagattatcattcgtaatggaagatccccattggccactttgcggtagtccacatactactatagtcacatgatacaaaagcctgcaattcattgtaaatggaaaggactgtaacttgtcgggatgaagttatcgaattaaattgtagttttctttggttagatttattcgcagatataagttactatattaccatctgttatcggtaaattcagaaacatcagtatacacttaatgcctgtccctttccttaatgctatatactaaacggtaactctgcttgagtttgtgaacgtacaagtgttgataattttgattagtcatatgatgcttgcaagttttattaatatcagcctgttatatgtaaaccttagtacttgcatattcatggtattggtacgttctctttgatcatttttttggttatttgatgattgatcattatggtacttaagagtaactagcatgaaaattcatacttccaaggaaacatttcctgatggtagtttttttttccacatattttcagtggaggcaacactacaggaatttactgcttttagcataccagagttttggtgttgtttatggggacctaagcacatcacctctttacgtttataaaagtacattctcaggaagactacgtcgatatcaagatgagcaaacagtctttggtgttctttccttgatattttggaccttcacacttattcctttgctgaagtatgtcactattgtattaagtgctgatgacaatggtgaaggtacacagtacacactatttcttggaaatttggtataaacacacctgaccttacattatctatcatcttgatgaatcagcttacagtaaatatattatcaatctatttgctggagtatcacactaccaggcttcttcttgtcttttctttttacaaatttactctgtatctttgttcaacctgaagaaaaataagtaattcctgtcacttttgtaggtgggccgtttgctctttattcactgctttgcaggcatgcgaaacttagttttcttccaaatcaacaatcagcagatgaagagctatcgacatactacagaaatggttttacttcacgtcatggatctttaccttggctaagaaggttcatggagaagcacaagaatgccagaaccgtgcttctcctcatagttctgtgcggtgctagcatgatgattggtgatggtatccttactccagcaatctcaggtggatagtgccatctctctctgttagttcatgtaattcaaagttgttacatatcaacctctttgtatgttgatgtgctttgttctgcttgtttttccccctccagttctgtcatctatgtctggattgaaagttcgagctactggtttacatgatcgtaagtacaatatacctctaactcataactccttagtgcaacaattttagaacacatctaggctgttgagtgagtattgtcaatttcaaatttacagccctatgtaattacgttcgtaagtattaatcaatagaattattctttctctgaatgcattcaaaagtaggcacctctgttttgactgtaatttcatattattgtggattttttacttatgtgaacatctgaatgcacttgatttacttccctgagaatattagtttgtcatgtcaagatgcacctgcacagtatcttgcaaaatttaagttctgtagtgtctgcctgctactaccatgtattttgtagtgtctgcctgctactaccatgcacctgcacagtatcttgcaaaatttagtattttgtatttaccatgtcaaaggttggccagtataagtttctggctactatattttttttctggtgactatttctatatagtgagacttccatcctatttgcgtgataaacaatttcctttaggaattattgctattctacttttgggattaagtgtaataacttattttctgtacaggttctgttgtactcctttcatgcattgtgttggttggtctatttgcattgcaacaccgaggtactcagaaggtagcgttcatgtttgcaccaattgtcgtcatctggctcttttgcattggtggaattggtttatacaacataatacattggaacccaaggatataccaagctctctctccatattatattgttaagttctttaggacgacaggtaaagatggttggattgctctaggaggcatacttctttctatgacaggttggttactatttactccttactcttggggtataatctgtattcttgttgtactttactttggtaagtaaaatacttgttgggatttaaggttcattttctgtttcaattttacaggctgtgaagctatgtttgccgaccttggtcacttcacgagtgcatctgtcagggtgagttaacttatctgtctttagttgctcactttgtggagatatacttctaggtctgttaatatatgttatggtgtgatattgtgttgcctagtaaagcaaccatggaaacttagagaaagcaatttgagggaaaatataacggaagcaaaaagttaatgtactaaacagccttatctgaaaataaatttagttagcttgtgagttgtgactacatatttgaaaccaaccagaggctcaaaaggaatggaggaacctagtcattttctttgttgtggactaatgttgctcgtacaagttctctcatgtgacctatctggttcatttttattttgaagcctcctcctggattccatatagtattctttgctagtaattataatttatgtttactaaactttgcttgcttcttctgccagttttgctcattattttttttctattgctgaaatatatccatgttttgtccttgttacagctagcttttatcaccatcatatacccatgtcttatattacaatatatgggtcaggcggcatttctgtcaaaaaatatccttgacatgcccacaggtttttatgattctatcccaggtttgcactgtcacccctctctctcacatgcatgcatgcacacagatatgtaagtgtaatgttaattttaattgtcatccaggacctatattttggcctgtgtttgtggtggccactctcgctgctgttgttggtagccaagctgtcatttcagcaacattctctattgtgaagcagtgccattcgttgggatgtttccctcgagtgaaggttgtccacacatcaaggtggatctatggacagatatacattcctgaaataaattggatccttatggtgctctgtgtagctgtcacagttgcattccgtgatattacacttattggtaatgcctatggtaagcgcctgtaaccatgatttttcacgtgatcaagagctccttgcatatagccttttgtatatttccagtatactcaagtgctaagagtctaagcactgccattgccatggtttgtcattgcaggtgttgcgtgcatgactgttatgtttgtcactacattcttgatggcattgatcatgatcttcgtttggcaaaagaacataatatttgctctatctttctttttattattcggatccgttgaagttgtttatctctcctcatccctcatgaaggttactcagggaggatgggtgccgcttgtgcttgctttaatattcatgtctgtcatgtatatttggcactatgggacaaggaagaagtaccagtatgatcttcagaataaggtatcaatgagatatatcctgtccctgggtccaagccttgacgtagttcgtgtcccaggaattggtctgatttacacagaactggtgactggtgtacccaacatcttcacacatttcactactaatctccctgcctttcatgaagtcctagtctttctttgtgtcaagtcagtaccagtaccatatgtgtcgccagatgaacgataccttgtgggcaggattggacctagagcatatcggatgtaccgctgcattgttaggtatggttacaaagatgttcagagagatgatgacaattttgagaacatgttagttatgaacattgggaagttcattatgatggaagctgaggatgcatcttcttcagcaagttatgatactgctaatgaaggacgaatggccgtcataacaacatctgatgactatgactctccactagctgtgagagattccaatgacctagctgactccatgacgatgaggagcactaaatcagagagtcttcgaagcttgcaatcctcttatgagcaggaatcacctaatgtgagccggaggcgacgtgttcgctttgagctgccagaggaggatgacatggatcaacaggttaaagatgagctgttagcacttgtggaggcaaaacatacaggggtaacctacgtcatggggcatgtctatatcaaagctaggaagaactctagtttttttaagagatttgcaattgatgttggctactctttcctccggaagaactgcagaggtccatcggtcacactgcacattccacatattagtctgatagaagttggaatggcgtaccaagtgtagcgcgatgctcatcgcaggtcacgacgtcacgtggatacccggtagcaacaaatcatggtgagtactagccattaaaccatatgaacttacaattgttccagttttttgttcttgtaattatcatttggatatgcgccgcagctatatccctggaattggaagatattccagagagaacttggtgagcgaaagatctttttaagtatatgctgttctttagaggaaccaattaactttggcaacatcggatctatagcaatggaagttattatttttggttttatatcatttgataattgactaatcatcttcatttctccctctccagtgctacctgtggccgcctttttggagtcgaggctttgattcctatgctttatccatgcgttttcagtttcagttggtacagatgaagaggctctctatgttaatatgatcatttagctcaaataaagcatcagatctaatgatcgtagtttgctcttcccttttggtatatttacatgcatgctctgtaatttttatgggagctatgtaatggaaatatgcgtccccgtttttattgcagctatgtaatggaaatatgcgttctcgtagctgatatatcccaatttttgttaggaagcgattaccacatatattctttcatgtatgaatttcttatggaacagaacatctgtagatatacagtgcctcgtggaatttctctgcaaataaaccagatactagataacatcagtatgatttcctttttcatttggaactccacttttcctgagatcccttgggccgggatctttgtaacgcaaactggttttttttatctcgtgtgaaatgtgagattcatacattccaaacagcctgcaactcaaggggaagcaagatgaaaacagtgcttttattaagagaaaaatatctacacacaaccgaggcggctcaaagagctttgggaacccgaaagctaaaccttctgcaggctaaaaactctgccgatttgttacttatgtactttccagaggagctccatagccgtaggagggaaagacgcttcaggcagcagcagacgaagtagcagctgccactgtcttgttgagcagcacgcggagagcgtctgcagaggtcaccggagggctgcacttgaagtcctggcagacgtgcgccaccgctggcttctccggtgggctgctacgtgccatctgcgcgatgatggcgttgttgctctcccagaatcccatttcctcggtgttcctggggtctatttggatcacctagatcaacaaacagggtggccagatcagtaaaaacagtagagacgctacgtcgaatgtagaatttatgatcaactagttcatcgctcacagttctatttggatcatatgtcgaaaatgcggcagcaaccatgtcacggaattcagtcgattctttgttccccaccagaaccacctgcttcctggacgggacagatagcatgtctgccgcacaacacatcaacggcagtgctataccaagttccctcagcctcgtctggaagacagcctacgaaacaaaaaaatgtataacacgcatgagcaaatctcttgttcccagat

SEQ ID NO: 57955 - DNA, 2718 bp, Oryza sativa
agttgatagcagctactgagttaccagaaggctccgcaccatcataatcttctttaacacgcagaagaacagaagggtcttctccaggagtattgaaatagccaccaccttgtttgtccaagaacaattcatcctgcatatgtcaacaattatggcaaagaacaaagcaaattatgcaagatataaaatagaagtggcaaacaagtacaaattccttgcctgaatgacttgaaggtgagcagcccacataagccactctatcttaccaccatactcatagagatccagcaacccgtttattaggaaagcataatcatccaaaaaacctggtgcttttgctggcccatttcggtaactatgattcagcctgtttgagctgctatcatatagtttttcctttataaaacgtgctgccttttctgcaactccaagatattcctctggctgcaaaatatccacatacataagtggtgaaaactcaagaaataatttcagagcgatgggcaatggataaatatgatgatgcagaccaggtaaggaaaagatttatcgcacttaatgaggtagctaagatctggatatgaagccatatgaagcaacaaagagcgccacatgtgcagaaaagaatgttcaaatacaacattatgctactttcatcgtcacccaaggaacaacatcataggcaacatttccatttattattaaacagatcatgtatgggcatgcacatccaagagactgtttgaccaaggaaaactgccacagcaaatcatggaaaagattacaagagaacaaagtgaatgacaaattaatcaatcatgtgcattacaatgagaagcaatatctagagggtggagcagaaaactttacgttgcacccagtaattgggaaacaaaatctggttccagttggttctgatttcagaatttgggaagctcttgcaaaagcagatatagctagtccattccatgagacaataacctaaaatagactgtagttagtacattatgtgacaataaaaaaatggatgtgccagacatttaagcaagaaccttatcatccaaatgtggccttggcctttttgaccggacatcaaacaacttatgccgacaatcccccaggatttgagcatattcatcaacagacttgccacactttgatgccatcaaagaagcttgttttctttctattagcacatttttacccttgaactcatcgtgaggatcactcatccgcgaaaggtcgcaattgccagatgatttgacatagtaatgattcttgaatagctctgaattctccccaagtgtgtcttcaatctgtgtgaagaacataatgtacctatttaatgaaaagatgcatatctctagatctcaggcactataatgtaagtgtgtaaattcaatggaattattaatgtaactactaccaaacagatactatttatttttttaggagctattgtataaaactgagtagtatttacaaaattcgtttccttcaatgcttacatttggtatggaacaaaagaatcttcaggctataatggtactataaatcaagtggaactgggactgaagagtttaatatctatattagcaggatgtgatagcagtaaaactcaaatcaactgaacatagggttaagcctcacaaattagtctaagaagtttaaatcattaagcccaccttctatggactgggaagaggtatttatgtaacaaaatgttcacatgcactagtaagaatagttcatggatgatggacgtacctccttattagtccacacatagaaagctccctccctttttcttggagcaccatcatattctgcactatcagcatcttctgctgagtaaatttcaccttcttctccgatcatgtctctcctcaagtaatcaagtatatcacgtgcaactgaagaataatactcatctcccgtgatcagaaatgtatctagatatacattagctatctgtccttggtcgtacaacatcttctcaaaatgcgggactaaatacagagaggagatatgtgaggggaattccacaaagtggtatgacggaaaatttagccttgaacttaccatgccagcactcatccacactatatctatgaaagccacctccaacgtgatcatgaactccaccccttgccatacattgcaatgtatgagttatcatcttcattatattttgggattcactcacctgtccagattccaaatgcttccgaaatttatataacattacacaattctcaacaggtcttggaaactttggagcagagccatatccaccgaattttggatcataactgcctgctaactgcatagatatgagctgagaatctgtaagcgcacatatatctgatgaataatgatgctagtaagaaaataatgaaaaagtaagttgtgcaacccaaggttttcaggctctctataagcttcattccataagcagtgtttttcacaaaaaaaaaaggtcacaactacaacatagttggctgcttacatatactaattgaccagaacaaaatccttgtatgctgatattcaattctaattcagaagtgtatcaatgcaatatgtcaaaaaagagtgtaccagtacagggaaaaacaatgttgatagactactcaataataacataagaataaagacatacaaatatgtaccatcagccatcgcatgttcaaacataaacacctgcaattgaagacc

SEQ ID NO: 57956 - DNA, 6085 bp, Oryza sativa
accatgattaataaagaacaaagtataacacttaaggaaacagaaacacaagggacccttttagtctgaagatacaaaataagaaaaaaaacaactcagcttgggacacttaggaagattaccttgtcaacatctggtcgctcttcacggtccacctgtcaaaactaataatcagaaggaaagcaatacagttacattgattctttttgaagcatcattacattgcatttacatatattttcacacagtgaaggcatgtattattttttttcgccaggagtgaaggcatgtaaaatgatatgactataaaaatgctactggaacacttcaattaatatcagaatagccgtaccttgatgctaacaaacccatcatttagaatctttgcgatttcatcattctcaaaagactccacttccatcacatggcacctttgaaattcaaccaaaaataatagtaaccaatactgatgttaaacatgaagtgtaagatgcagaagagagtcacatatcacacataatacgaatatacatgatattaataaaagcaaaaggagatactaaaggcaactcaccaatggcatgtgctatagccaacttcacgggcacatcaacatttgccatgaagcaaaataagcggttagaatacaagaagggagaaaataaatatggaaagggtgaatttgaatgaatttttagcttagattccacttgaaaacagttcaagttacaatgattgtaaccatactttaccacggcacactattgtattattatatttgagagaatgcactgttcctattgttgttttagacacttcatacttgatagaaagatgggaacgtcctttctgcgagccttctcgaaagcctcttctccccaaggataccaatcgacctgcattaagtaaacaagtatgtcactaatctagtttcttctataaaatttttaaaaaaaacaatcaaacaattttctcggttagcttcttacatgtctaagaattagataatttttttaaaaaaaaatcgctttatctccataaccatagggtcatcgtcgactacgtgatactcaaattaattcgaggaaaagctcccacaagtggtgtgctcagtgattctctacaaattacaaattacgagatgcctcccaaagcggcggaagagccgatcaaatcccctcattctcaactcaaagagagcgcaaggtgctcgacaaaatcccgcagagaggaggcgaagacggcgtaaacgtaatacgtaatccgcccccgcggagactcactcaactcaccgggttgtacgcgtgctgcagcaggtaggggctgtgctcggcggcgaggcggttcgggctccgccccacgccgtgccgctcccctgacgacgaggaggaggacgcgccgcccgacgacgacatggcggcggaggaggcggcggcgaggcggcggcggcggtggtggcggcggaggaggcgaagcgtggagagcataggaggaggagggcggcggcgacgaagcggttggggaaggttggagaagaggagggcgaaagcggcggaggccgccatgtggcctcggcttctggacgacacctgcctgcctccgctgcacccgcgtccacgcacgcacgcccaggtcgttgtgacgctggctctcactgcctgctgggtcccactcccaggagaaaggaaaggataacattgttaagactaataaaattttaaaaagaatatagtaattttttcaatataaaatcaaatatattcaatgttatagaaaaatatttacaaataggttctcgcttaaaaatatttagtgactgaggatctatttgtaaatatgtttttacagataggtctcctttttttacaaatggatccttggtgctaatgttcatattagcgacttagctttcaccggcagacgagggagatggcgccaatgttattggcattgtcatgttagaccatggcgccacgaaaaaggttcattccgaaaataaacttttctaaagatctatttgtagaattattttttttaaaagcactgaaagttgaaaaatccagctccaatctctcactgctaaaaactaaccgaccaatgtctgatttaattattagttgataataaaaaaaatataataatataggaaagttgtaatgctagatttaacaagatgcttgtattgatagctaattattttttttagtggtaggcgacataacatcgacagcggggtatctgtagtgacttcgtcgaaccgaagatatatcgagcccttatttcaaaatagtacccataggtgtgtgtatgtgtttatatggtgagtgtacacacgttgtaagcgtccgtccatgatgacttcattaaactcaagatatgtcggcccttatttcgaagatactaataaaggtagggtgtgtaagtttattgagcccttatttcgaagatacttataaaggtagggtgtgtaagtttattgaggcgagtatgcgtgcgttacgagcatatgcgtttataccgtgtttttttaaaaaataattagaatatttaaagagaaagtggtggttaatgaagcttaaacatgccgccgtgtcgatgcattcgctcgtgcatcttcaagcggccctcgaagcgccacaaagcccacgtagaaatggagaattaccaaaatgcccccttcgtcttccatctctcgattctctctcacaccttcctcctcctccatctccctctccgtttgactctccctgatccgcggagctctcgagcgcccgccgccggcgagcggggtgcagcgccgcgcgggcgacctcctccttccacctgcctccatcatcgctgcttgaatcgatccgaaggtattcgttcttctcccgtactccatcgtctaccacttccgggccagttttgagtagatagatactttgtactagattggtaatccgttcggatttggaactatccattttcttccggattccttcgatgcgtggtcggatggaaattgagtccacaaggggcagtttcatttcaaaacaagaggaattcggggttcagttcaatctccgcgacactagtttggcccctggtagtggtaggcgacagtgtaagatgatagtatccgtttatggggatttagggaactattatcaaatatcgttcctagtgtttttgtgtgagactgtcgcactgtatctctctctccattcgttacatctactgatgcaaagttaaataggagtataattgtgatgcaagtctgcaatcctgaaattttgatccctctgtttgtgatgcttgatacagcattgtaaatggctgctgggaggggcatcagtcagcttttgaagaaagcatttcgtccatctgtaagtactgtgagaacttcggttcccccctattcttgtacatggttcttttgctaaaaattataaatttattccacgtcctttctactactgcctctgttttagatttcaagtttgatcaagtttgtagacatatatactaatattacaatatcaaattagttttattaagtctataattgaatatttttcataatatatttgtcttgtgttgaatatcttactacttttttcctacaaacttggtcaaacttaaagcaataatcaaaatgacttataatctgaaacggaggaagtattgtatttgtgttattatcaatcaaagaatctccatcctactcgtccagacatttggattactgttatcttggtagttctagatttttccttgtaggtactttgtttggagtaaagcagctgccttctgttttagcctagttgtgttgtatagactataatgtgggctcaccaggggatgagaaagttggtgtcatgatggcagataagggcagcaggccagcagggttagggatactgtgtagttttaagggtgcgttcgggtttcagggatgggaattaatccctcccgcacggaaaacggagcgatccattagtgtgtgattaattaagtattagctttttttttcaaaaatggattaatttgatttttttaagcaactttcatatagaaactttttgcaaaaaacgcaccgtttagcagtttgaaaagcgtgcggcggaaaacgagggagaggggttgggaaaaggggcatccgaacacacccttaaacagtcaggcaaaagggcaatgcttctccaatcggtagaagaaagggaaaaaaccccacaacagctggagttatccccgtgcttggaagtaaaacaaggaaatgaaatagtgatagaaaacaaaaaggggtcaactgtcaggctctaacttaacaagaaactcctaatttatctcctacaactcttttataccatttgctttgctttgtgtcggttcctctaataggaatccacaacacctaaatgcaattgttgaatgaatggctgactcattaatactgcggcaactgaacaataatggtttaacttaattgactatttatttaagttaattcgctattgttatttgaaaccataaactttgcagagctcatctccgctctcttcatcctggataaatcatgaagagtcctctggcttcactggattgagagcattggctattctgggagttggtgcttctggccttttaagttttgctacaattgcatctgctgatgaagcggagcatgggttggaagccccacactatccctggccacatgctggcatccttagctcatatgatcatgcatcgtaagtttatcgaatagacttatttttgttaaatagcttgttctgactagagactacttgacttcatttcaagaagcaatcgtgcatctaatatataatgattaactagaaaaacatactccccccatcatgtggtacaacataaaagaaacatcagtgtactatgctgtttgttattttagagataagcaaatgttgcagtgtcaatgttactgttatatgcccatgctgctgaggtagtcttttgagctgttcttttttcatatttttatcttttctttcacctctttatttatttattttaaaaacatatgagcagaataaggcgtggccatcaagtttatacacaagtgtgtgcctcttgtcactcaatgtccttgatttcataccgagatttggttggtgtggcctatacagaagaggaaacaaaagcaatggctgctgagattgaagtggttgacggtcctaatgatgaaggtgaaatgttcacacgtccaggtaagctgagcgaccgtttcccacaaccctacgcaaatgagcaagcagctcgattttcaaatggcggggcataccccccggatctcagtctaatcacaaaggtgagactcacaaattgctgtcagtcacatgtggtgcaatttctcatctctagattgtatctaactctttgttttttacatattttcaggccaggcacaatggccagaactatgtttttgctcttctcactggttatcgtgatccacctgctggtgtttcggtaaccctctctcatacatattgttttgttattttagtgttggtcgctacttgtaggtttcacatatgattctctgagtatctgatttgttagatttgtagggagtggagataatttggtgtgtgctctatggttttgtaacagtttatatcaatggatgcattgggcagaccatgccacacattttttactggactacgagtccttgacaatgcaatatgtgcattcattgcttaagctacatctctatccatcatgcactatcttttttcatggtgatgaatacggtgtttcctgttctagtttagcgttcatgtttttcaaggtttctgtcctttcttgaattaatgcaacatgttatacttttttctttgttggtgctgttgaaaattccctctaggcatagttaccggctttccagatcctttcagagctttgtttttccttttagttctttctcttttactccctctattacaaaatataaggcacaactacttttcttagatgtttcataatataaggcgtgcatgcatgcatgcaattaactagcacctcttctccactaaattattattattttaactcttta

SEQ ID NO: 57957 - DNA, 1103 bp, Oryza sativa
tgcagggccgtgtatttggcgccctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatccctacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgagg

SEQ ID NO: 57958 - DNA, 8558 bp, Oryza sativa
  unsure (1)..(8558): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatcaatctagtcaataacttaataattaaattttcatttgcactctacgttttttaattttaagtaaattcatgctcaaaatgcataagggtggagttttgtgaaactttgaaaacaacaatacttgaggttagatgccgcgtgtcataatacatatggtttctacaactttgaccatacaacacgaagttttctaaaagagtaaattgcatccatggtgcatcaacttggcaggtgggtgcaatttagtgcaataacttgagttgagaaatgaacgttctagtgcaataatttggtaggtaggtgcaatttagtataagaactttataagtgatcgtataaatgcaacaacttgcaaggtaggtacgattttgatacagtaaattaaaaagttatgctacaacttgattatttggagcattttttttataaattcaatttttaagtactaattttgacaatatactagcgcatatttcacagatttgataagtgtatttatatttttatcataataactaataactgaaagccaattaaactatatgtagaaattattatatttcggttgatatttgataagatgaagaaaacaaaaaaaatcttaaaggtaattggatgtaaattgtactactatgtgcttataaggcaatatccatatgattactatgtaatggcatattgacatcgtgaaaaaaactcaccttgtatatgcttagccaagttgatgtacaaaaatactaaattgttaagttcttatactagaacgcacccacttgtcaagttgttgcacttggacgttcaattttcaagttcttgcattatatcgcatccacatgccaagttgttgtaccgtgggagcaatttactctttctaaaatttactcaaaagcgaatggttttggtctttgtgattttgggacttcactccgataacatatggagttaaatataagtattaacaactaattcaaaataagagcttaaactaattaagaaggggcaattgcaaagaaagatggtagtaattcacttatactctaacacggggaacgagccatgctagcaaggaatgatgggaggcagcgtgcagggaaggtagtgaattagtagcaacattttattcatatgttaaaaaaacacaaagtatttttctggttattcatgaaagatagattgaaaaataggaatatgttaggaaggatgaattttgaagatactctccaacatctatttttgaccaaccttctgctcaagaatactaatttatactgatccctccatttcatactataagtcattttaacttttttctaatcatttttttatgtttgactaagtttatagaaaaaaattagcaacatctacaatatcgaattagttttactataaatgtaacattaaatatattttgataatacgtttgttttgtgtttaaaatattatacttttctataaatttgatcaaaccaaaaaagtttgactagaagaaaaaaacaaaataacttataatatgaaacggagaatgtaattaataacttccctagctaccatatcggttttctagatttttgaagtttttgcaccttgggatggatgccacatggtatcttttgcaacagtgctccttgattgagtgggtgaaactagcagcacatggttcaacggtcatttgttctgtatacttgacgtgcatgctgacatcgtgtccggtgtggttaattgccgctggccggttgtagcgtgcatgcaagttgaagccatatttttactgatctctctgaagatacatatgtttccccttttacatggagattatcatcacaatggcttggagtatttgaatcacaagcaatcatacgattttcagaaatataagtcctattcaagtttgtaaatccagacaaaaatcaaattttgtcttggttatctagagaacaaaatagagttaccacggatctactactacttttatatatatatatatatatatatatatatatatatatatagagtttaagatgtttccttcgtccgttaataaaaaaatgataaaaaagtccgattgtaattaaaaaatcccagggcaaaaaaatgcggcaaaaaaaaaaagctgaccgattcctattcctactaaaaaggcggaaaaaaaaagtgcggcaaaaaacgattgtaaaaaggaaaactatgtttcgctattttttttttgcggttttttcgtcgggccaaaccctagcgccgccgccatgtcgatttgcatctttatgtgtttcctcatccaattgattgcaaaaatcgattctccactactctcgtcattttccccttgaatttccctttcagttcattatttttttccccaagttttgtggattgcttcgattttggtaaaaaaacgaaaaaggggatcaagtggatcaaaatctctaataattttggagatcgagaaagattcgaccgcatttgacagagaggatcaactccgccatcatacggacacggtactatgcgagctcgaccagattaccggatttgatgggaggtttggctccgtcatggtacgggcacgagattgttcgagctaggcctacagctccacttgtgggctgaggcgaagagagataggccgagcagatagaggtagcggactgctctaggactagagctgaaaagaaggaaggaatgaacgtccggtccaaaaacaaagaagcatccggtccaaaacaaagggagtataatgtataggataaaaaaagtttttacccgtagcaacgcacgggcattttttctagtaaaggaaaaagtacgaattaaccccccccccccgaactatcacggtcgtccgaattacccccctgaactcgaaaaccatacattttacaccctcaactactaaaaccggacaaataaccccccgagcactgttttggacggttttaactggaatcagcatatgtggccgccaacgtggcatctgggcagcaaaataaaccattaaaaaaatctagtcccacatgtcatctctttcctcacaccaatccctccccaatcccattccccctgcttcccttctctctctcttgctttgcgtctacggctggagaaggaggagatggtggccggtggcggaggcggatcgatgcacggagcatgaggctcccgccgctcggcgacgtcggtgcgccggcgagcctccgcagaagcatgaggcggagatgagggacgagcacgacagccgcctttggttatgggggacgagcacgacatgccgcgcacgacacccgccgtgccctccccgaggaggactcgtcgcccaccgccgttgacacggagctcgagaggggtacctcaccgtcgtctccagggaaggggggagcagcagcgcagcgcggggacgggcggtgggcggcggcgtgtaggggcggctggcgcggggacaggcggtgggggcggtcagcgcgggaacaggggtgtgtgaccttctcgtttttgaagcgcgtgcggctgttgcggtcggcgcgcgagggccagcgacagttggcagcgcgggccatcagcgggcgagggctggtggggtgcagcgtcgcgggcggtcggcacgcgaggactggcgacaagtggcgtcgaggtggtgaggactactgttgacgccgacgtaaacgatacaattgcctggaccggtgaaacattggacttatcccttcgccggagatcgaagacgatgcagccccgcgtcgggtgccaagttccgccggaacgtaaaaacaaaagtagaagtaaaaaaggtggcgatgcgccgaattgtattgatcgtgaggacagattacatagaccccaggtgtacatatttatatccatgggttgatataagtccttgtcggacaagaaagaaactttcctaaagataaaaggaaaagataaagtccttataggacactaaacacactttcctaaagataaaaggaaactaacaaactattcctaattaatagataacttaccatgccgtattctctttaaactcggtctcttctggataagcttcctttagtagatcaatttccttaaccgaatatagcaagaatccgacaactgacgacttgacaactctcatcggctaatctcaggacttcgaagccgatgctgactctacgccgatgactactccgggcttaccaaatttcactgttaacaactacgtggcggagctggagcgcgcgttggaggtggtcgagacggagtccgcgagggcgcgtgtggagctggagatcgaccgtgcagggaggaaggtcgccggggaggagatggacgacgacgacactgacagcgcctccgccgccgtctcgcgccccgccgtgcccgtggtggcggaggcgacgaccgtgctgttgctcccggtggtgcacgaaggcgacggcgacgaggcgctcgcccacgcaccgaggcggaccaagacggacgtggacgtcggcatagtggaggtggacacggtgggcggtggtgccagggtgggggcccgtggcggagctcgccggcgaggctagcatccgcagccgccgtcgtcgccgccgacgctcgcccaattgtgcccgcagcagccgccgccgctcacccagccgcgcccgcagccacctccgctcgctcagccgcgcccgccgccaccgctcgccccgccgctgcgtgctttagcgaggggaggggatgaatccaggaggagagagaaggtgagcaatacaggagagagattgacaggtgggccccaccgaatttttttaaaggattgctgacttggctgacacgtgtatgccacgtaggatcaaaaccactccagagattgagtaggggggttatttgttcggttttagtagttgagggtgtaaaatgtctggttttcgagttcaaggggataattcggacgatcgcgatagttcggggaaggggtaattcgtactttttccgattatagaatggctagacagcatgcattgagatctatacagtttcttttttaattatatatatttaatatatacacagtaggagcctctaaatagcgacagtgctttatccattgaatatgatatgttagttaaaaaatactaatacgttagttaaaaaaaaaagtacttacatcgggctcgaaggagaacaagttcgcggtgaccagcgggcttgagttgttgttgtgataaggaggtgacagaggaagataagggagagaagatggagcatgatccttttgtgttctcatcacaagtatcacaggtgttctatgtgcaggaaccaaaagcacaaggatggcatgttgcacaaccatataggccgagggatctatatgatatgggtacagaaccatcagatagtgatgaggatgacccaacaagctagttttgttgtgatagacttcattatttaatgggatttgtctgttatttcgatcgtgtgatatgttcatacacttttgaagtattttttatcactaattttgttatctgccttgatatatttctctaactattttctcaatgaattttttcgtcgtgtgttcaaatggacttatttgttcagttgtttgtactatatacaaaatattgctgtgctatgaagaagctaagtatttcttttaggtgagttgttttggggacaaataaatgattttgtgctgatgaggtttacgctaacacccaaatatttgtttagcatcctgcactaaaaataacaatatgctgttctagtgcagtggtttccactagcgaggacactctataggtccagacttcgattcctttttagcccttattttttttgtccagttagctgtaacatgtaaatatattattagattaaattaaattaagtaaaagaaaaaaagagctagctgtaaatgtcaaatatatcctatcttactataaaaaaaattaaattaagtaaaagaaaaaaagagctagctgtaaatgtcaaatatatcctatcttactataaagttatcccccactaacttcttaagcttaacatgcaaagatgccacatcatcatccactaacaagatgccacatcatcatccactaattaacaagataccacatcatcattcactaacaatcatcacatttaaacatcatgcaaacatgctatatctttatagtttttataatttaagagcttttcaaatacaaacatgttaaattataatctaacataattatgtgaattcacatcatgtttcaatgtatatctttattatgttttatgatatcctatatacttatatagttcatcctcacttagttagtgcttaaatgattaatctatggttcaaattatctttctctttttttcctctaattaagtcatatcacatcaattgtttttagcctttagatgattaatctacggtacaaactatctccctacttttcttcttccataaagtcataccaccttactttttacgtttgaatcaccattctacatactatttaaatttaaattatcgtaaaccacattaatttacttaatctgatgttatctagttatcttacacgttattttttttattgttatcatactaaatttccgcagtaatgcgcagagtttcatctagttattgaaatattcatgaagtaacagaaaaaggaacacctgtaactgtcgatctattattaactcaataaaacaatataaaagccaccatattcactctcatgacctagaatttcccatattaataaaaaagaaaaaaatagagtccaagtgtatagattaaaaatatctgtaattcggaataataataaaaggataaaagaagtacatgtagaaatgcaattttgaaaagaaaacttaaattcgtatttaaaaattaaattaagacaagagtcaacgtagaaataccttttaggctgaaaaatatgaaattcggattaaaaatttaaaataaatattgaaataaaattatatgtataaatataattcaatctaaaagtcggaataaaaattaaaactacaagaaatagtccatatagaaatacaatttgaaactacctaaaattcagataaaaagatagcattgtgtacaaaagagttcatggaggagttcatggggtggcttggacatgggctacccattttttgggctagatctagcgtctggctggagcattctcgtctttatctcagcccgtggcgttgtgtgttgcagagacgcaaggtgggtgaagaggtaaagaaaaaggcctagttgacatatgctcatgtcgggtcatgcatacaggttggcatctagaatatgcgctggactgccatggtggattcagcctaaggaagcaaagagattttctttttccattacatagacaagatgcacgtgtagtcggtgacaccacactcatatactcacgtacactacgttattaaaatagacgaagacacaataacattttacttaaacttatgctggcttcgatttctgcaaatactagtaggcagtatatgctgataaatttaaacaggtaattatccaagagccaaattaaccaagacagtaataagaaagcacaatagtatcaataatgcaatttggttgaagctgtcctatagtatagaactatcctcctttttaataaaacggactagtagcactgtgtactgtaggagtactactcgattaaagcataacttttgcttgtttaacaccaccaattggaagcaagagcatcaagggtgaacactgcatgcagtgtgcacgttcacagtgcactactcttaatcgatcggtactgcctgataaaatcaaacttacggcattaattttgaacctgcaaattcggcgcaaatttctaatcatgatgtaatataattagctgatctcagctcactcccaggtagcctttatcgatctacatgatgctatgcatgctggcgcctatataaaccatgcatggcctctgcttcttcttcactcatccacacatagtaaggaggaggggcaatagagtttgctaattgctaggattgattcaacaatggcatcagtagtgttggcgaagatttccctgatcgaacaccttgcgcgcagactgcacgcgtccggcacggcacaacacagcaacagtgacaaggaactgagaggagaaattcagagcagagtgaagaacagagaagtttcagaactctgaactagatcgcacaatctttggggaattttctggttgtttttcattcaactgaataataaacttacaactgtaaaactgagctaaataaactatttatactccatacataacagaacgaatccgaggcaaaaatcgtgccatccca

SEQ ID NO: 57959 - DNA, 7360 bp, Oryza sativa
ctctccgccggtctaccactgaatcgatcgatcatccattccatcaatccacacttggttgcgtgattaattaatttgcaggtcagcttgttcgtgaagaataaatataagttgtgagatgtgagaggagtgtgactgtgtgagatcgatcgatcgtgtaggatcgaatcacaagaactaagccaaccagagggggtgaatggttggtatacccaaaaaccgaaaacttttagcggaaataaaagttaccctcgaaatcgatggagatcggtctgaccgaagtagattagccggtctgaccgaagcgtagcccccggtctgaccggtgttgatctaccggtctaaccgccgtgatcgcctgccgcctactgtcgccgccgtcggtctgaccgccgtgctcccgccggtctgaccgccgcaatgccgctggtctgaccaccggtgagttgtcggttagaccgccgaaacccggtgaaacacaaatcgaagaactcttaaagtgaatgacgactttattaattctctctatgtttacaaagtgcaccaacaacactccttacaaaaatttcgactaaactcgaaaccctaactcaaaactcaattctattgctctctaaagcgataccgggaagcctcacgctccccctctatttatacatgaggtaggcagcctaaagccacgaaccaaactcatactaggagtcctaaacaccttaggaaaccctctagtacaagaaagaaactttacataaccaatcgtaccaaatttggactccttccaatttcgactccgcatcccatacgcacacaataactccatcgtatgccatatggaatctccatcaaccacgtgcatcaactctagccttagtatcccgcatgatctctgaccacaacggacgtcgtcttatccccaagccaactcccggtccatcaccgtaaatactctcccgagacatcgagtcacctacacatggaatagacaaagaaaccatattccgagaccaagctatctccaacttgactcattagcagtaaacaatagtattacatacgtataatatccatctagaagtcataatcatgaaataaactcggatatccaaataaacaacccgaaaccgaaaccgacacagtgtcggccggtcagaccgcgggctggccggtccgaccgcttgatcaccgctggtctgaccggcaacacctgcccggtctgaccggtccacataaaatgataacctgtagattcacctgtgaaatccaatcatctccaaaccacttcgtgaataaattccaaataacaaaaccaataatctctaatgctcaattgttcatcacagaataattatcaaaaacacctttgattttacagatcgatgtatgtgttggagacttggagtcagtgcataagcattggctttcaggtgataaataatttcagagtgcttatgtgtgtcgtgtctgtatttattcgcacatgtaatgcgacatgtgttctacataatgtaatttaaatatttataagattgttcatgttgacgtagaatcgcaatgccacaccttgagcacgttatgtgtaactcgcggcagcactcggagacgcgccatcatagggagtgggtagatgccgcccaacgaccacccgcgaaggaccccatcaggatgaacgtgcgtcggtttgttctaggctcagcaggccaactaggacgtcctctaataccgtagagacgagagatgacaagtaatcgaggatttgaggatttagaatttggataggtagcaagaaggagagagatgtagaatatagagggtttggataaataaattgattttgatgcatgattgattgcttgttgtttcaatcatccttggcccccttatatttataaaaggggtggacttgcttcctggggtttttccatatgcatttaggcatataaatcaactaagacttgaaaatttcggtctaaaacaagaaaacacgagaaatatctaaattggacttggactatgtgattaagatctaaccgcctggataccaatggtctaatctcagtgcattgtctgctttgaccggccacataatgacggttagaccagccttcgcgggaaagctctggcattttttaaatttggctcaaacttgctataactcgaccctactaccaaatttgattatcaacacatgccccccctgtctttttggcaaacttatgagccaaaaaaatactatgcatgagatcatctaagggcgatatccaccaataccgaccatgaattcctctaaggcttaaatgtttaatggtgatgtaagaaagctacgagaggcctctcttgttcagattgtattttgtttttctttggcctccactcttgcctcaccactttcttgtgtggattcttttgtgactgattcttttctctcaaccggctatgagatgagtgtggttgattatttaaaatgggtcaatgtggaaactggcaatgcccataatggataataatatggtatataaaaaggcatcatccacataccattaaaaatctataatacatttataccaagcgtaataccatggaaaaggagaagtaagttgccggtggtgcatactcgcttggtagatgaacttgatctccttggtcgcttgccatattttgatatctccagattgtcgtcttgcctcctaagtatttgtcgaggaatgatcctctctagcaggtggtcgtgagacccccccctttgtgagttcggccgggggaaatggcacgatgatcaagggcctacttccgcttgcggtctaatcgctagatcgctctcgtggctgtgtgggagatcaaggattatacaggttcgggccgttattgagtgtaataccctactcttgtgtatgggattatggtgaatttttacatgaggttttgagctctaagggaaacctagctgttcttcctccgagctcaagttctctgagagtcgtcccctttctcggtgggcgaggtcctccttttatagtccaaggggataccacatgcactgtttgcacctacccctccatcggagggggggcacatggccctaatcataccgctatcctttgcttcaactggaagcaacatggtcgcctggctccaggtggggcccagcgccgcccccgcctgacacgggggacatccctgtcattccctattattgtatgaagacttcggcggctcaccacgcgcgtggggcgcccctggaagcgtgccgatgggacagggcatacctgcccccactccgcctgacacagggcggaacgtgggggcactgcccccgtcccgtcgcctgtgaccggtcacaggccggtcaagctcgattgatatggtgttgacggtccttaaatcataatatcggaccgtcaatacctgcatataatgaaataaaacatggtatccaacttagtggtaggtattattactaatcatttccactagtattggtgaaatatgtgtatgcaagtaatttgaggagaaaacacatccgtcatgtgacaaaatgcacctccgcgcattcaggacgcgtttacacggattagaggcccaataagtcaataaaaaccatttagaattgggccaaaacatagcccaggttgttgggggcccaataagcaacctcccggctgaaggagaggccgggaggagagtttttgggtttggccgaacccaccagttcggacaaaccaatcctggcgcttcccatcatctgctttcacctggacggctcggatttctcccctaaggcagttgcagggtgttttggtcatttcccatacccctaaccgtcatttggagcctatataaggaggtcacattctcatttccaagacacacaattttgagctgaattataagaggctctattgtatcttttgtacattataataaggtagagagtgaggggaagctctggaggagtgcccggaagtttggcgctcatccgacttctatctcgacgagtgtagcttcctaggaggaattcggggggagtaccggagctgtcggtacactctgctctgggttcggagaacctcttctataaagtaagcattcgtgttcctttcttatattatttaattactttgtctaagtaagatagattttcatctttgcgggttctttatctagtattcatactaagtgctctagtactaggactctggataaagaaggaagttcatgtacaagtattagagtagtaattaataacttagacgtggtgtctaggttagagattacctttgtttgttgtgtatcccacggatttgtcagaggtaggcgacaagtggtaacagccctgaatcccgtcctaataattctccacgttcggatacatcatagagctatagccggaaccacgctggcagaccagcaggggtcggtgcccgaagcaacaaataggaaattaccttcaacttagcttagataattaaaacacatagaaagtcctctctagcttgcctagcctatctatagttgttgtcattggatcgtcttagccttaggtaaattacacacgttccctgagttcgatatctttttggggtcacccgaaggtgaagtgctacaacagtattccgtgcgcttgcggatttatctgtggacgtaagaaataccaacacatgggtcaatcgagcggcgccgcacatccctccacgccgcattaaatgctgcttggggcggttggtgcaccgcgcattgaaggcgcggagcagtgtctttcgccccgcccgctctccccgccacgaggtggtcaggcgagggcctcggggtagcacgccccgaaagcccgaggagtgcgacgtggcaccccgaggtccctctggccacctcagcgctacccgaggggcggggggaggcgaggccacgtagccacgcgactagatgggaaggatacttccctctactgtgcgtacccccgggcccatttcaccgacagtattgaagtcttcaatgtggtcttctccttgccatcgggaatctccttctcttgcaattcaacggtctgtataggaaaaggtagctcatccacctgcatctttgtaaaagtcaatcgtcattcgtcaattgccgattgaacttgtctatggaatacattgcaatcatttgtggcatgagaattggagttgtgacacttataatatgctcgccgctctattcttcaagtgaaggtatggcgtggccatgtgacaatttaattttcttcttttactagtaattattcaaaaatcctattgcatttggccacatcaaacgtgaactttatttcctcttgctgattcttacgactaaccagcttaagagcggagcaaacggatggtttagagttggagttcaaaacccatttgtgtatgtatacatcaactgtctctttgttcaaagattcttgttgatcaactatattaacatgggcacaatcagacttaactttttgcgagattttggcctctttaactcggctctcttgagttaaagccttttgaagtaattggcttacatctaagaaagtatgaccatctagcttttcttttaaatattcaagtaaaccagaataagccaaatctaccaagaccttatcagaaagtgttaaactataacatcagtttcttatatatataaatcttctaatgtattcaaaagtaggctcgttatacttttgtttaaccgaggttaagtacgacaagtttaattcggtctcaccactaattaaagaagtaatcatgatatttttgttctaactcagaccaatcatgaatacagttggtgcaagtgaaataaacccaaaaaattgcgcgcatcaccaaataaagacaatgggaaaaagcctaagtttcaaaatactactagcactagcttcttcgcattgaataataaactggtcgatatcctctaaagtagaccggccatgttctccagtgaacttacacaatgaggcaatcaaaacccttgaggatattgaacattatcgtagtggccagtatagagtttttgatatatacgccttttaaccctagtatctatgccgaaagcatttttgaaagcttcggcaatctcatcgctaagactcttgggttatgctcatgtgccattgactacaggatctgacaagactcttacttgttcatatcccatatgaactcctcaaattctacttaacaaaaaattgattgtccatataaatatatagcccctaggagagaagagcatcgaatcataagccatagccacaagtcacatcgaatatcaatcaggaggaagtgattaaattggcactataaacatgtagttttgtaataattttgttacttaatctatagctttgtgaccatatatttcaaatctttagttttgtgataaacttaacactatatgtacttagttttatgatataataccttaaatcaatagttttgcaatagtttgatcaaagtatttgtagttttttgtgaaatttactcatttacttacaaatagtatcaatcatgcaatttggttggaactgtcctatactacagaactattctcccttttcataaaacaggctagtagtactgtgcgctctaggagtaccagtcgattaaagcttaactttgcttgttaaacaccaccaatcggcggcaagagcatcaacagtcaccactgcatgcagtgtgaatgttcacagtgcctccatgaactgctagctgctactcttaatgatcggtgtctgatcaaatcaaataaaatgcacgtacggcgtgaatgattttaaacctgcaaaatcggcgcaaattgctaatcataatgtaatatactccctccatctacttttgatagttatatttctaaatctaaaaaatttattttcgataggcatatttcaatccaataacttatcctcttaataactttctcggatttaatgtgtgactcaccattcttccatataagattggctgcataggcatcgagaaatgtaaatattaataaatcgtttgtttacgaggaatgactagtactccctccattccaaattgatctacatatttcataggtacaccaagaccaagaaaaactcctggctccaggtggggcccagcgccgcccccgcctgacacgggggacatccctgtcattccctattattgtatgaagacttcggcggctcaccacgcgcgtggggcgcccctggaagcgtgccgatgggacagggcatacctgcccccactccgcctgacacagggcggaacgtgggggcactgcccccgtcccgtcgcctgtgaccggtcacaggccggtcaagctcgattgatatggtgttgacggtccttaaatcataatatcggac

SEQ ID NO: 57960 - DNA, 10816 bp, Oryza sativa
  unsure (1)..(10816): unsure at all n locations
aagggtgaacactgcatgcagtgtgcacgttcacagtgcactactcttaatcgatcggtactgcctgataaaatcaaactaacggcataaaggttgaacctgcaatttcggcgcaaatttctaatcatgatgtaatataattagctgatctcagctcactcccaggtagccatttatcgatctacatgatgctatgcatgctggcgcctatataaaccatgcatggcctctgcttcttcttcactcatccacacatagtaaggaggaggggcaatagagtttgctaattgctaggattgnnnnnnnnnnnnnnnnnnnngtgttggcgaagatttccctgatcgaacaccttgcgcgcagactgcacgcgtccggcacggcacaacacagcaacagtgacaaggaactgagaggagaaattcagagcagagtgaagaacagagaagtttcagaactctgaactagatcgcacaatctttggggaattttctggttgtttttcattcaactgaataataaacttacaactgtaaaactgagctaaataaactatttatactccatacataacagaacgaatccgaggcaaaaatcgtgccatcccacgatccgcaattctctgactcgctacacacacactcccctgcgctaaactcacgcacacgacacggtcttcaactcccagatcgccgcatcacccgcgcctgctaacaacctgctggcgacttattctccacaccgttgcaactgcaaaatggatcacgatggggccacagctgaagatacaatttcaacatgtagcacgaacactactactcttcgccgccgtcgtctgcgccgccgtgatggcagttgccgctgctgcggacggcgaggtggcggcggtcgtcgtcggtcaggccaagtgcggcgagtgcaccaggaagaacatgatggcgcaggatgctttcaagggtatatatatatcatgatgatgatgatgatgatgatatgttcatcattgattaattgcgatcgatatatcaccgtccttgattaattgtttggtgatgttcaggtctccaggtggcgatcaagtgcaagaacagcgatggcgagtacgagagcaaggccgtcggcgacctcgacggcgacggcgccttcagcgtgcccctcgccgccgacgacctccacggcgccgccgactgcttcgcgcagctgcacagcgcgacgagcagcacgccgggccccgggcaggagccgtccaagatcgtaccgctgtcgtcaacaacggacaacggcggcgacaaggctaacaccttcgtcgtcgtcgctggcaagaggatgcactcctccacatcgccggcggagtgcacgtcggcgttcctgtacgactacttccacaagcaccccttcttcgactatttccacaagaaaccccaaggccccgaacccaagccggatcccaagccaacgccattgccggcgaacggtggtggtggcggtgcgggaaacggtggtggcggcgcccaggggaacagtggcggagctgcgccgtctcccagctctccgccggtctaccactgaatcgatcgatcatccattccatcaatccacacttggttgcgtgattaattaatttgcaggtcagcttgttcgtgaagaataaataaaagttgtgagatgtgagaggagtgtgactgtgtgtgagatcgatcggtcgatatatgtgttggagacttggagtcagtgcataagcattgcctttcaggtgaaaaataatgcgcgtttcagagtgctcctgtgtgtcgttgtctctatttattcgcatatgtaatgcggtatgtgttctacgtaatgtaatctctttatgtatttttaagattgttcatgttgacgtagaatcacaacaccacatcttagcacgttatgtgcaacttgcgcccaacgaacacccacctgccagggtgaacgaacgttggtttatcctaagctcggcaggcaagctagggcatcttctaataccgtggaaacgacagatgccaagcaattgaggatttgaggataataaaatttgagataggtagcaagaaggagggagatatatgtagaatatagagggtttggataaataaattgattttgacgattggttgcttgttgtttcaatcgtccttggccaggaatgctactgggcgagcgatcgcccttaatcgctcagggcgatcagtttttgcgccccccccccctccttccctccatctctccaccttgtttcctttgttggcaccgcattactttcctattttagtaaatttatacacctaaagtttacacatctaaagtttagagaccaaaaatttataagtcaaaagtttatacatcctattcaaatttgaatttgaattcaaatatttatatatatatagtatttctatacatctaaagtttatacacctaaagtttatagacctaaagtttataagtcaaaagtttatatacccgtttcaaatttgaatttgaattcaaatatccgattcaaatttgaatttgaattcaaatatttttcatatatagtatttctatacatctaaagtttatacacctaaagtttaaactttagacctaaagtaagtttatagacctaaagtttatatacccgattcaaatttgaatttgaattatatcttattcaaatttgaatttgaattcaaatattttctatatatagtatttctatacatctaaagtttatacacctaaagtttatagacccaaagtttataagtcaaaagtttacatactcgattcaaatttgaatttgaattcaaattttttatatatagtatttctatacataaatttttctaacttttatttttcaaaaaaatttgtgtagtctactgtagtataaagaggagaaggggaggaggaataggggagaggagggagtatagggggaggggggctggatccgatcgcccaggcgatcgcctggcgatcgatcgcccattagggccccccgtccttggcccccttatatttataggaggggtggacttgcttcctggggttttttcatatgcaattaggcatataaatcaactaggactcaaaaattttggtgtaaaacaagaaaacacgagaagtatctaaattaaattggactcggactatgtgattaaggtctaaccgcctggatacctatggtctaatcacagtgcattgtccggtttgaccggccacataataacggtcacaccagtcttcgcgggaaagctctggcattttataaatttggctcaaacttgctataactcgactctactgccaaatttgattatcaacacatgcccccctgtcttttcggcaaacttgtgagccaaaaaatactatgcatgagatcatctaagggcgatatccaccaataccggccatgaatgcctctaaggcttaaatgtttaatggtgatgtaagaaagctacgagaggcccctcttgttcagattgtattttgtttttctttagcctccactcttgcctcgccactttcttgtgtggattcttttgtgactgattattttctctcaaccggctatgagatgagtgtggttgattatttaaaatcggtcaatgtggcaaccggcaatgcccataatggatgataatatggtatataaataggcatcatccacataccattaaaactccataatgcaaaccaagcgtaataccatgaagaaggagaagtaagttgccggtggtgcatactcacttggtagatgaacttgatctccttggttgcttgtcatattttgatatctccagattgtcatcttgcctcctaagtattgaagtcttcaatgtggtctccaagtgtaataccatgaagaaggagaagttagttgccggtggtgcatactcgcttggtagatgaacttgatctccttggttgcttgtcatattttgatatctccagattgtcaccttgccccctaagtattgaagtcttcaatgtggtcttctccttgccatcgggaatctccttctcttgcaattcagcagtctgtataggaaaaggtaatgcaggtggatgagctacctttgtttctaattgcatttggccacatcaaaagtgaacgttatttcctcttgtcgattcttacgactaaccagcttaagaacggagcaaacgaatggtttagagttggagttccaaacccattcgtctatgtatacatcaactgtctcattgttcaaagattcttgttcataaactatattaacatgggaacaatcagacataaatttctatgagattttggcctctttaacttggctctcttgagtcaaagccatttgaagtaattggcttacatctaagaaagtatgaccatctagcttttcttttaaatattcaagtaaaccagaataaggcaaatctaccaagaccttatcagaaagtgttaaactataacatcggtttcttgtatatataaaatcttctaatgtagatcaaaagtaggctcattatactttttttaaccgatattaagtacgacaaatttaattcggactcaccactaattaaagaagtaatcatgatatttttgttctaactcagaccaatcatgaatagagttggtgcaagtgaaataaacccaagtaaatgcatcaccaaataaagacaatgggaaaagcctaagtttcaaaatactactagctaggcttcttcgcattgtataataatgtaacatcctcaaattttaaactaaaatttgactgcatcatgctggtttttgactagattagtacaatttaaaattttatttgaatccttttattggttcaagtattattcctttagaactcttttaacttaccctaattattccctttatcctaaaacttagtgaattttagcaaattctcacaaatttcgaactttagtatatttctttagtttaccccctttcattagtgagaattttctatactctaaaccctagtgaaaccctttcaaacttatagattaaattcattcttttctaggaaaaatattcaaaatttctgaaaacactattcattgccctcaaggtgttcgatgaaatgcccagcccaactatctcagcccaacatctacccaaacctttgcaaagtctaagtttgatccttggggaccacaacccatccaaaactgtggttcactttgccttttccaccccctttacttgcgccaccctggcatcctccatcgccgcacgccgagccgccgcgcgtcggcttcagggccgttcgcgtgtgcccgaccgccttggcgcgccgctagtcgttcgacgccctaagaccaccgccaccgcaccaatcgtgatgaagacgaagccaggatgacctccgccgcaagttaccgccgctcgacgctgtgcacgcccgtccaaagccgccgccaagtccgaattcgcttctacccggggtgaatcgcgccaattcttgccgcactgttggattgaagataagcggtggtttcccctatcacaattcaaaccgaccaccgccatgctgaccgttttaaccctcgccgctgccgcgcgtcgagcccggattggcgccaacacgtcgccagacgttttcacccatggtcaagtcaagccttcgtcagtaagaattcgaacgtggcctcccgccactcaaattgatcttgccctccctctcacagctccctgccacccctgccgtgctcaatttccaagctcatcaatggcgttgatggcgcccgagctcatccacttcttctggccctataaataggaccccaatcccttccttgtccatcatcgatcatcatcaaccataaccccacaaccctgaagctctgctttgccaaaccataccatcaaccacttccgcccgtcggtcgaacaccttgtgtgcgattgacttcacgcccctccatccactctccatcctaactaatccttagaacacctaatatcaaccatgctctagcatattggagcctaaccgaagctttgcgtcgagtttcacctcgtcgcaccgagctaagcactgtcgcccctgctctgctctggttctcaccgccgagaagtttttccggccgcaatccgtcgtctcagcctatctcggtgagttctttcattttaaccatctacgtactccctagattccatattcgcaatcggccagcattaccatgccaccttctgggctgccgacatgagctcgtccgtcgccaatggaggtgctcgtcggcaagttcttccacaccttgccgaaagtcggcaagctacctaaatccttctaagtaccccgtagatgctctaggaaccctccccgtgctatgcctaactctcaccaccccgatcaccttcacggcctatccatgtcaccgccgccctagccgttagcccacccacacatcaaattaacccctccgccgccactcgccgtcgccggagaaccctagctacctcccctcctcggccgcaaccccctttccccctctatcaccgccgaaatcgctaaccctagcaccgccggccgtaaatggggaacggctagaggttgaagaagagaagagagaaagagactgacaggtgggacccgcacacagtatcatttcacatttaatttgattttcaaactttagaagctcatatcttttaaaatatagatccaattccagtgaaacttggaccaaaattcttctaaaatcattctctatcttttgagtctacttttgctatttttctattttattttatttttcctatttttggattttatttgaattccttttgaatttgaattttatatgtttaaccctaggtcttgaagagtcctctgacatattagataatatcagtcaatctcaggacatcgagcaaggcaagttactattctaccttttgatcatttaagcctatattttacaaattatttatttatagccttctattcaatactctattttatatgcataattcaaccatagaaacccaaacaatttagtattgcttattttgcttacaatctggtctaaatatttcatacttagattgggacagtacgtaggaattggatgattttcgggtggctagtactgtctcgatcgatatagttattaccaggtacttatgtcgaacgaacaggtacgaccatagtttctagaatagggacatacctagtcattatattaattagcaatgtggtacctctgtatcgtggttcttatttttaagtcctcgagcaagaggcaactatagccacgaagggcaatttttaccattaccatgtacaagtaaatggtcgatgatactcgagtataaattattatgttataattctaaaccctgatcgagatgacgtggtgtcatacgagatcccccttaaataccccgggaacaccagaactcctctcgctgctgataacgttacgttcagagcgcatgaggactagagttcatggaacaggtaccacaattgttaataacctaatactgggtcatgactaagctaatgaatattggcaagtcgtggactgcgagtaaagcgtacatctactgtagtagaatattcatgaaactattcgaatggccgtactcatggaattgagtaccgagacccatatagtactctggttagaaacctaaagtctatgtatttacaaactcttgctttaatacttccagattgtttattattgtcttttgcaaagaactctactctataccaacacataacatgtttccatggtaacttgccgggtattgtgaatactcacccttgctcttataacccctttttcagatttgggtcaagaagaagactcctatgattattactacgatgactccaataacatagaaaatccctagaggttatacctccctagtcagaatgtataaaacctctatgtaatagtcttacttatgtgagtacctattcttgtaaaaccttagtattgtaaaatttaacgtatgcaatgaagaaccagttgcatattatgtatcaatatttactgatccaggggttgatacattaatctcagccggatccaagtttttaattttgggacccgacaaataaattggtcgatatcctctaaagtagatcagccatgttctccagtgaacttacacaatgaggcagtctaaacccttgaggatatggagcattataatagtggtcagggtagagtttttgatctatacgctttttaaccctagtatctatgccaaaagtgtttttgaaagcttcggcaatctcatcgctaagactcttgggttatgctcgtgtaccgctgactacaggatctggcaaaactcttacctgctcgtatcccatatgaactcctcgaattctacttaacaagaaattgattgtccgtataaatatatagcccctaggagagatcaaagagcatcgaatcataagccatagccacaagtcacatcgaatatcaatcaggaggaagtcaatagctagccgatgattctaagtcgttggattaattcttggtgaatgcttgttggtaggctagattagctagcttgctcccccattgtaatcagtttgatacattctagagatattcatataaactggattatggctattacccacatcggggcctgaatcaatataaaaatctctgtctctcgtttactttacggcaatctcgcgtatactttgataccaacatcttctatactttaaaaaaactattatataccgtcaacaagtatattctctaccattatacagacaagatgcacgtagtcaccactaaatacatacaccgcacttatacactcacgactgtgttccaatcatatgtttataaggcggatatgttgatcgaactatcacaaaaccacagatttagcatcaaatttatcagaaacctacatatttaaggtcaagtatcacgtaattaattatatatttaacattgaagttatcacaaaactacaaaattttgaggtcaaatctatagcaccaccattatgtttgagctataaatgttgtagttttgtgattaaattggcactaaacttgtagttttatgataattttgttacttaatctatagctttgtgaccatatatttcaaattaaatctgtagttttgtgataaacttaacactaaatctgtagtttttatgatataacaccttaaatcagtagttttgcaatagtttgatcaaagtatctgtagtttttgtgaaatttactcatttactgaaaaatagtatcaatcatgcaatttggttggagctgtcctatactatagaactattctccctttttataaaacaggctagtagtactgtgcgctgtaggagtaccagtcgattaaagcttaactttccttgttaaacaccaccaatcggcggcaagtgcatcaacagtcagcactgcatgcagtgtgaatgttcacagtgcctccatgaactactagctgctactcttaatcgatcggtgtctgatcaaatcaaataaaatgcacggcgttaatgattttaaacctgcaaattcggcgcaaattgctaatcatgttgtaatataattagctgacctcagatcactcccagctagtagcctttatcgatctatataaaccacatgcatagcctgctttttcttcactcatccacacacagctctagcctcttgctacatagagtttgcgaggatttatcagcaatggcagctgtagcacgagcactactcttcgccgccatcgtctgcactgccctcgtgatggctgtcaccgccgctgcggacggcgaggcggcggcgatcgtcgtcgggttggccaagtgcggcgactgctccagcaagaacatgaaggggcaggatgctttcaagggtatatatatcatgatgatgatgataatatgttcatcgctaattaattgcgtactcagctcgatcgatcgatatatcaccgtcgttgattaattgtttggtgatgttcaggtctccaggtggcgatcaagtgcaggaacggcgacggcgagtacgagagctaggccgtcggcgacctcgacggcgacggcgccttcagcgtgcccctcgccgccgacgacctccacggcgccgccgactgcttcgcgcagctgcacagcgcgacgagcagcacgccgtgccccgggcaggagccgtccaagatcgtgccgctgtcgtcaacaacggacaacggcgtcgataaggctaacaccttcgtggccgtcgccggcaagaggatgtactcctccacgtcgccagcggagtgcacgtcggcgttcctgtacgactacttccacaagcaccccttcttcgactatttccacaagaaaccccaaggccccgaacccaagccggatcccaagccaacgccattgccggcgaacggtggtggtggcggtgcgggaaacggtggtggcggcgcccaggggaacagtggcggagctgcgccgtctcccagctctccgccggtctaccactgaatcgatcgatcatccattccatcaatccacacttggttgcgtgattaattaatttgcaggtcagcttgttcgtgaagaataaataaaagttgtgagatgtgagaggagtgtgactgtgtgtgagatcgatcggtcgatatatgtgttggagacttggagtcagtgcataagcattgcctttcaggtgaaaaataatgcgcgtttcagagtgctcatgtgtgtcgttgtctgtatttattcgcatatgtaatgcggtatgtgctctacgtaatgtaatttatatatttataagatttttcatgttgacgacttgacagaatcgcaacg

SEQ ID NO: 57961 - DNA, 9382 bp, Oryza sativa
gcatagaaatcaactaggacttgaaatttttggtctaaaacaagaaaacacgagaaataccaaaattggactcggactctgtggttaaggtctaaccgcctggatgcctatggtctgatcatagtgcattatctggtctgaccggtcacataatgacggtcagaccagtcttcgcgggaaagctctgttattttttttaatttggctcaaacttgctataactcgaccctactaccaaatttggttatcaacatatccccgccccccccccccaatctttttggcaaacttgtgctccgaaaaatactacgcatgagatcatctaagggtgatatccaccaataccggccatgaatgcctctaaggcttaaatgtttaatggtgatgtaagaaagatacgagaggccccctcttgttcagattgtattttgtttttctttggcctccactcttgcctcaccactttcttgtgtggattcttttgtgactgattcttttccctcaactggctatgagatgagtgtggttgattatttaaaatgggtctttgtggcaaccagcaatgcccacaatggataataatatggtatataaataggcatcatccacgtaccattcaaactccatgatgcataccaagcgtaataccatgaagaaggagaagtaagttgttggtggtccgtactcgcttggtagatgaacttgttatccttggtcgcttgccatattttggtatctccatattgtcatcttgccccctaagtattgaagtcttcaatgtggtcttctccttgccatcgggaatctccttctcttgcaattcaacggtgtgtataggaaaaggtagctcatccacctgcatctttgtaaaagtcaatcggcattcgtcatttgccgattgaatttgtcgatggaatatattgcaatcatttgtggcataagaataggagttgtgccacttataatatgctcaccactttactcttgaagtgaaggtatgacgtggtcttgttacaatttaattttcttcttttcaactccctctatcccaaaatataaaaacctaagactagatgggatgtttcctagtacaacgtatttggacaaacttcgtatcaagatacattgtactaagaaatatccatctagtcctatgttcttatactctgggacaaaggtagtaataagtagtcaaaaatcctattgcatttggccacatcaaacgtgagctttatttcctcttgtcgattcttatgactaaccagcttaagagctgagcaaacgaatggtttagagttggagttccaagcccattcgtctgtgtatatatcaactgtctcatcattcaaagattcttgttgatcaactatattaacatggggataatcaaactttaactttctgtgagattttggcctctctaactcggctttcttgagccaaagccttttgaagtaattggcttacatctaagaaagtatgaccatctagcttttcttttaaactaggaaggtagcccgcacgttgcgcgggcatttctatctttccgaatattaaaattatgtatggtggctctttgtatgtattttggatacgaatactacttgctctgctcttgaatagtatgataatacttcaaaatcagtaacccgctatatctctttttttaaaaaaaaaaacatttagcttgcaaattggacaatattcacttaactgtttgaaccattcactctatctccccctttccaacgattaaaatttaataacaaaattaaagatagaaatttgttacctgcttgagttcttgctaagtattattatttctaagatgggttaattgaatgttctaacatgtagccttctagatatatcatgttatcaaattatgcatgcttcaagctaatgcgacttaaataatattacatagatacttgagttaagagaagatttactcataaaaaatatttgtactggggttcccttgttgccttctcttgatggtcgctcgatcaacaaaacacaatacctcctatgggctctttttgtgatgcattggatggctggcaacctagtaaaactcaacgctagtcatcctgacaacaaccctctaaaccatgcaatacaacctcacctgacatctcaaataattttatgttagacaacatgtttggatgaatgtttttttattaaataatgtatgtatacacatacccattgaaataacccaatggctaaaattaatgggagcattaaattaacgaggattaagttttagatgctttatctgttacagaagaaatttaaagtttcctcttatttgttaaaggctttaatagatgctctaggagggttctttagggcgtttaataaaccgatgaaataatactttataattttatatatcatagggattagccattgataatttttatttacttttagggtattattaggatatatgctcttgagtttttctgtcttttaaatttctatgattcttattaccgtagacatttttttagatagattaaagtaaatcacacgtgtctttggctatgtatgtttataaaatgaaacaaaatgatataatctatattataaaatggagcaattgcacatttgaccctatttgaatgtctaactaccgatttgaccctgttttggtcactttgctcatttgacccttcttttcaaaaccgaagctacactctgaccctcttctcttaagagcattaatcggtgttaacaaaagccccaaataccacttccacccatacttatttgaccttatttttccaaagttaggcccaattttgtgcggaagaaaatgcaagtagcaagctaatggcgaagatgtgcgtgggcgccagtggtcctccttgtcaccgtgccgccgcccctccaccatcaccgcctatcctcctcgtcatcgagccgacaccatccctcttcctcctctcctcctaccatatccgtggttgccgccacccctccgcagccgccgcctccattcgccaccgccggcaatcctcctcgtcgctgagccgacgccaccctcctacccttcatggagctgctgcttcccctctgccgagttgtcaccgcctcttccaccaccgccagcggtcctccttgtcggcgactcaatgttgcctctttgccatcgctcctaccctccgcgaagcagccgagggccctccacagctgttgccatgtggccgccaccgctcctcctgcccatcgcgctttggacagagagaggagagagagcgggataaagaatgagcaaatgagtggttgaggataaggttgatgtattcagtgtcattttagtcatttgggcttgtaaatacatgtttttcttttttttctaaatgaaaaactcacgatgtagtgaaagtagggtcagacgacaacttcgattttgaaaaacatggacaaatgagcaaactttttttaaaaaaggatcaaattgatagttaagctttacaaaggggttaaatgagcaaatgtcccttataaaatgtcctttatctgtattatgcgtctaatggtacacatgttcatcatatcttagatattcgatatgatgcacaaataccttgttagcaattgtagctcgatgaacttttggtatataatttttaaattttaaagatagaacgtttaaagagtgttgaaagaatattttgtatttattttgtagaaaatatattttaattgtgtatgtttgcgcaaaaatatagagtgatattttaaatagtataatataaaatcctatttttaataccatcgttttctttcaatggcaccatgtacgtatttttttctattttaccgcttttatcgtaattaagttcgtacacgagtttcttttttccatgtgatacttcattgtttattaagtgtataccacagttatacaaagttatatgtatctatgtacgttctttttttttttggcccacagcataggaaggtatttttattaaatagtagatctaatctaatggtccaaaataccaggtccaccaatttaactgaaaatcgactgtgagattagataatgccatgtagttgtctaggagtgtttgtatgagtgacacgtggcgtcttaggagtatttgtaggaagtttcatggacttttagtatagatattcaagtaaaccagaataagccaaatctactaagtccttatcagaaagtgttaaactataacatctgtttcttgtatatctaaatcttctaatgtattcaaaagcaggctcattatacttttgtttaaccaatgttaagtatgacaaatttaattcggtctcaccactaaagaagtaatcacgaaatttttattctaacttagaccaatcatgaatagagtggtgcaagtgaaataaaccaagtaaatgcatcaccaaataaagacaatgcgaaaaggctaagtttcaaaatactagcactagcttcttcgcattgaataataaattggtcaatatcctctatagtagactggccatcttctccaatgaacttacacattgaggcaatctaaacccttgatgatatggaacattatcatagtggtcagaatagagtttttgatatatatgctttttaaccctaagtatctatgccgaaagcgtttttgaaagatttggcaatctcatcgctaagactcttgggttatgctcgtgtgccattgactacaggatccgacaagactcttacctgctcgtatcccatattaactcctcgaattcaacttaacaagaaattgattgtccgcataaatatatagcccctaggagagaagagcatcgaatcataagccatagccacaagtcacatcgaatatcaatcaagaggaagtcaatagctagccaatgattctaagtcgtcggatttattctcggtgaatgctagttggtaagctatattagctagctcgctctcctattgtaatcagtttgatacatcctagagatgttcatataaattggattatggctagtacccacaccggggcctgaatcaatataaaaatccttgtctctcgtctactttaccaaaatctcgcgtatactttgataccaacgtcttctatactttaaaacaaacactgttatcggatatatactatcaacaagtatattctctaccattttacggacaacatgcatgtagtcaccactaaatacagacaccacacttatacactcatgactgcgttccaaacatatgttaatagcgcagatatgttgatcgaactatcacaaaactacagattaatttagcatcaaatttatcagaaacctaaagaattaaggtcaagtatgacataactatatatttaatattggagttatcacgaaactacaaaatttggaggtcaaatttttagcactaccattatgtttgagctataaaagttgcatttttgtgattaaattggcactaaacctgtagttttatgataaacttaacattaaatttgtagttttatgatataacaccttaaatcaatagttttgcaatagtttgaataaagtatatgtagttttgtgaaatttacgcatttacttaaaaatagtatcaatcatgcaatttggttggagctgtcctaaattatagaactattctccatttttataaaacagactagtagtactgtgcgctagctgtaggagtaccagtcgattaaagcttaactttgcttgttaaacaccaccaatcggtggcaagagcatcaacagttaacactgcatgcagtgtgcacgttcacagtgcctccatgatttgctactcttaatctatcggtgtctgatctaatcaaataaaatgcacgtacggcgttaatgattttaaacctgcaaaatcggcgcaaattgctaatcataatgtaatatactccctccatctacttttgatagttatatttctaaatctaaaaaatttattttcgataggcatatttcaatccaataacttatcctcttaataactttctcggatttaatgtgtgactcaccattcttccatataagattggctgcataggcatcgagaaatgtaaatattaataaatcgtttgtttacgaggaatgactagtactccctccattccaaattgatctacatatttcataggtacaccaagaccaagaaaaactaataactctcttatactatctttactctagcaacaaactcaatgcaggcaccatccccactatttcctagccaatagcaaatcaagatattgcatgtgggttataaatacttgtgtgcatagatgcatgcatcaatgtccatttactccaatgtacaagcaacgaataaacctaatgaatgaacacaaatatgtagatcatttagaaataacctcaaaaatactatatgtagatcaatttggaatggagggagtagcatgtttgaatggatgataagtagaattacttatccttgatctgtgtgccaagatgaaaatataactatcaaaagtagatggatggagtaattagctgacctcagatcactcccagctagtagcctttatcgatctatataaaccacattcctggcctgctttttcttcactcatccacacacagctctctagcctcttgccacatagtccaaataacaacagagtttgaggattgattcagcaatggcagatgtagcacgagcgctactcttcgccgccctcgtgatggctgtcaccgccgctgcggacggcgaggcggcggcgatcgtcgtcggccaggccaagtgcggcgagtgcaccaggaagaacatgaaggcgcaggatgctttcaagggtatatatatcatgatatatatgttcgtcgctaattaattgcgtggtcagttcgatcgaacgatatatcaccgtcgttgattaattttttggtgatgttcaggtctccaggtggcgatcaagtgcaagaacagcgacggtgtgtacgagagcaaggccatcggcgacctcgacggcgacggcgccttcagcgtgcccctcgccgctgacgacctccacggcgccgccgactgcttcgcgcagctgcacagcgcggcgagcagcacgccgtgccccgggcaggagccgtccaagatcgtgccgctgtcgtcaacaacggacaacggcgtcgataaggctaacaccttcgtggccgtcgccggcaagaggatgtactcctccacgtcgccagcggagtgcacgtcggcgttcctgtacgactacttccacaagcaccccttcttcgactatttccacaagaaaccccaaggacctgaacccaagccggaccccaagccgacgccattgccggcgaacggtggtggtggcggtgcaggaaacggtgatggcggcgccgaggggaacagtggcggagctgcgccgtctcccagctctccgcctgtctaccactgaaaaattcatccattccatcaacccacacatggtctgtttgattgcatgcatggttaattttatcgttcggttcttgcgtgattaattaatttccaggtcagcttgttcgtgcagaattaataaaagttgtgatgtgaggagtgtgagtgtgtgagaacgatcgatttatgtgttggagacttcagtgcacaagcgtgttggttttcaggagaaataatacgtgttccagagcgctctatatatgtgtgtcgtgtctctatttatttgcatatatatgtaattcggtaatgtaatttatatatttataagaaatggaaaattgttcctattgccacagaattttctctcaaaatttacttatacatgtagttaattaaaaaatagttggacggagatgttgacctcttgctgctgctgctgctgcgtggacgcggacgtggatcacacgggcggtggcggcgggccctggaggaggtggagcagcaggcggccgcggtgatggagaagcaggagtcggaggcgggcgaggagaggcatggttggtgcggatttgtggttggtagccgagaccgtgggaggcctccttcgccactcgccagcctccctccccgcccagttcgctgaactccccaactcgtccctctctacgcgctcgtttgcggagagaggagagatataggtagtatagatggtcatatggcctagggcccgcgacccggtccaaggcataccaatttggcctggcccaaacacggcacagtccgattgggtgacagccaccctgtgcttgggtcgctccctcggcatggtgggccgatccagccctcacggcacgatcgaaaaaaaatagtagaagaacgtaaaatagacttaattaaccatataaggcaaggccgaagacaagaggaatacaaaatagacttattttccagccatatggacacagcccacagaggtttaggaagaacaaatagacttattctatgaagaaacacgataggctgtcgtgccttcgggctagctcaacacgacccgagtcttactgggcctgggttgtgtgtgcagcccatgggctggcatggcatgccccggcgtataagtcgggccgtgtcggcctgactgacttcggcccaggcccggccgtggcgggcggcccatttagccatctataataggtagcgagggtgaggtggagaaagtgggacccacatgtaggtcccactattttttattttcttgtttgactaacatgtgggtcccacatattttgttttaatattttagttttcagttttgctctttttatttttattttgaatcacactgacacgtaactcgtaaacgtcaacatcaatgccatgtaagacaaaaacctagttaaagaagctacgtaggtgtcatgttagctaacgtgaaaactaggaataatactgtcgaggaatctcgtttgcattggttttatgtatattgggggatacactgaatctgttttgtggtttagagacgaatttctgactcgacgacaaggtaagggaccaaaagtgaacttgttcctcagcagtttagcacacgcatcgacacagcacaggcacaggcatgcatcatgccatttgcaggcccgtgccgtgttgggtcgtcactgacgggtgggtccgagagcggtgggccacacgtcagccaccacacggttcctttgattttacgtcagagtatctcaatcctccatttggacagctataagtaaaaacagaaatttatatttatttattttcacttttagcagcaaaagttggggattttggactatttgccatcctcttgaatgacgtattcccaaatgccatcttcccaaataactttgatgttttaccatccgagtccactgatttgtctctattttaccactttttactaccaactcagcaaattgagtagaaaatgacttgactgcc

SEQ ID NO: 57962 - DNA, 1827 bp, Oryza sativa
atagtcccaaatccccaaaagttgtagggttaattagacacatgccattactaatttgaaggtttggaaaaatgccattactatttgacaaattgtaaagatgccattacaaatcgcacgatactggaaacatgccacgttctacgcctgatccgcgattgttgaccacgtgtgactaaaatttgttcttaatgaccaaaatgcccccgtttgaccggctatactgactggagtcgggttagcaggagcagcacacattttatcccctttctcgttctcttagacctaaccctagcaggagcagcgacgacggcggcgacgtcatctacggcggccgcggcgacgacaacgtctacggcggcggcggtggtggcgacggcgcgggctacgacggctgcggtggcgtcttcgacggcggtggcgacggcgtctacggcggcagcggcggcgtattcggcggcggcggcgacggcgtctacggcgtcagcggcgacgactctttctttccatggaggggttggaaacgtactgcaagggatggagcccaaatcaaggtaaggtagtcgattccttcgattcgatgtgccgtgagctgaatgtgtaggttttttttctgtgcattccatgtgtggttgacttgatttcattccaatgtcagtacactattgttctcgatagagttaaaggttcatggttttaccaccatagattcggatggtagacggaggtatactaagggttgtgtgctgaaatgggatgttgagtatggtagcttctctttggatttgttgatgctaagcttaagctcagaggttagatggggtgagcagcagactgcaacagtgtggtttttgacaagggcagtaatgaggacgttagaattgtccatgaatctcaactggttgacatgtttgaaatgtaccaagtcagaaatgcatgctgaattaatggtcttagttgttgagagtgtactctgcgatgctagtgctaataacatggagccaacatcaatgccattgtgtgttcttcgacttactcagacagggcagggagcatctgcatctaaagtggcagtttcaggtgaacctgcaactcaagaagcggatgaaacattgcctaatgtgtttgacatggagaagtatgtgggtgttgatgatgagggaatttatattcaacctattcacaccattccacctacagatcatgctgaaacctctggtcaacctagtgctgaaaatgctaaaccatgtgttgaaaatgctgaacctggtggaccttctgggactgctcaacctcatggtgaggttgaggtcactgatgatgacccagcagagtttaatgttcttcataaccttgagatgccagtgattaaggaggaagctgtttttcctgacatgataacattcagaaaagctattaggcactttgcggttgttacaggatttgaactctctaatttgcaaacagatccaacaagattcattgcccactgcaagcatgaggggtgtaaatggcgcattcatgcatcaaggttgtctaatggcaaaactattcaggtttctatgtcaatttgcacatttgtatccattttgcttgaaagttgtgacttatagcactatttaaaatgtgtgtgcagataaagaagctaccatttgcacatgagtgtcccacaaccaagctcatggaagggaagatggccactcaagactggattgcagatagactgaaggattggttaaagaaaaaccctaacaagggagctaaggcagcaaaagagaaacttgaagagcgatatgagatcaagctgaagtattcaaaggcttgggc

SEQ ID NO: 57963 - DNA, 912 bp, Oryza sativa
ataatttatttcctgaagccattgattacctagacaaacatcattcaaggatatggtataggtctggtttcaaggaaacttgcaagtgtgattacttgaccaacaatgcatctgaaagtttcaataatcagattaaatctctgaagggtctacatctccatgagctagttgattctcctagagagttattcatggagaagatgtatttgaggagacaagttggtgagaagttgactgatggaatcctgcccagtgtgattaaacagctcaatgcagcaacaaccaacctgaaagttgtaaaggttgctaggagtgatgatgacatggctgagatcacattggttgagagtgacaacaataccagaaggcacactgtgcatttgatcaaccaaacatgttcatgcagaaagaggcaggtttcaggaaaaccttgcaatcatgccttggcatggatatgttccaacagaggagttgagattaaagatttgttttagagtacttttctgttggcatgttcagagcagcttatgcagggagagtgccaactatgccagacaaatcacaatggcctgtggtgaatttaggcttcaaagtctgtccacctagactcaagaggggtgcagggaggcctagagtcactaggatcaggggtgcacttgaaccaggggcaagaagggtgcgatgcaggagatgccatggttttgggcactttgccaagacttgcaaagaggctgaagcaccagaagacactgatgaagtgcctactgctttccccaagaagaggtaatatgctgcatggttgactatttattttgaattcttttacatatgttgcatttgctaactaacatatccatatcactgtttgcaggaagaaaactcaagatgaaagttcatcaaggcctgctaaga

SEQ ID NO: 57964 - DNA, 22152 bp, Oryza sativa
ttgaggcctatgttgcctggcactgtgatatgcactgtgtgcaacatgtgaacatgcagtatgctgaaattagtccaaacctgtgaacatgcagtccatattgtgaaatattgctgatcatttgaacacatgccatgtgaaatatttgttgctgatcatctcaacttataccatgtgaaatatttgttgctgatcatctcaactaataccatctgaatgcacaaatttcctgtgaactcattttcctgtacttctttttcatttgtctcaatgatgggcagtcttttcaaagaggaaataaaaacacagaactttcagttctttatatacttcacaccaaaagatatttcaatgtcctataccttccttttttttttacaccaagtgaacatatattagcatagttttagtgcaggagtcagcagttagctcttgctgcaaacacacaatatcagcttgtaccttgagctgccagacttatccttaacagagcacccagagtgggaaattaaatccatataattaacacacctatgtcattactcagaaattgaatccacataatttatagacagtgattaacattacacaaaatggcactgatttacctacttgtaccaaatatggccacaaaatttacagaacatacatagaaatacataattatggccaacaagaacaacatcacataaagttgtctactacgactacacttctcttctttcaacatcttctttagctgctcacactttttcttagaatcattcagctgctgatatatggattgcatctgcctatggtttgcctcaaccaaaccctgcatcctcgacctctcttccttatgctcttctgcaagctgtcgcaacatgtctctttgaccatcgtcctcaccagcatgggaataagcaaccatttcctccacatattcgttcaacagatcctcccatattcacaacgagcaacactttggctgcacaacacatctcaaatcaatggcatcaatcaagaaaacgaaacaaaaaagaaaggaatttcaacaaaagaaaatgaaaaacaatggggtttacctctttcccacactgaatccaccgccgccctagattcctcgaggtgttggatttgttcactgcagcggctttgccgcaagcacatctcaaccatggtgccgacgacgctgcggcccgtgtgcgctgaaagctacaaccgctcgagcccgtcgaacgaatcgggctgcctctccccgccattgccgccaaagcccgccgctgccgccgacactgccgccaaagcccgatgccatcgctgacgccgccgacgccgcctccaaatcccgccgccgccggagaagcctagtgttaggtttacggttcactgtgaatgcacttggtcaaactgatccactcggtccctacatactcatacacaagggcattatggtccatacgtaaatacggtacgcataaaaacgagtacaatcgcggatcaggcgtagaacgtggcatgtttccagtatcgtgggatttgtaatggcatctttacaatttgtcaaatagtaatgatatttttctaaaccttcaaattagtaatggcatgtgtctaattaacccaaagttgtaacggcagttgcaaaggcttgggctctaaaacccccctcttccttccgcttcaattccatttcattccaatcttagggattccatggaaccctacctccggtgatagccgccgccgccgcctcgggcgatggcctccgcttccggcctcgtcaacgccgccctcccggacgacctgctcgcggaggtgttccgccgcgtcgccgccgcggggggcaaggccgaccttgacagctgcgcgctcgtgtgccgccgctggcgcggcgtcgagcgcgcgtcccgccgcgccgccagggtccccgtcgacgggcccgacggcgacgccgtcgtccgctgcgtcgccgaccggttcccgggcctcgccgatgtcttcctcgaccacggcctctacattgccgccggcgcctccgccgccgccgcggagcggagcagggtgagtccttctctggctgcagttcgggaatcgcgcgaaattctcgcatctcttgtgttcccctgtggaattgaatgaatgatccgatgttttattggttcaacaactaaatccgtggttaagattttgttttcttggtctccctgagaaattagcattttgccagagctgcatataatttagatctctggaaactattttcttgatgtggtttgtctatcaattttgcaagtcactaatgcactatttttgtcacaggcacagggttgggataacgaaaaccccaagttagatgagcaacatatgcagtgttccacactaagcgaagatacgcaaaaagaaaatggcagtgatggtgtcaacccaacctcatttactgatgctgggctacttcatctcattgagggttgcaaagggcttgaaaagctgactctaaactggtttttgcacatttctgaaaaggggctggtgggaattgcaaatcgttgccggaatctgcaatcgttagcgctttcggtaatttcttgttagttgtacttgttctgttttctttcgtgcattcaatattgtttcacacgtagcatgatctgctttcatttccaatgcgggcaaatctttggaactatgaagaagttaatgcttccttatggtgaatggtgatcatagatgcctcttttattttaactattttgtcgaatgaaacttgaggatcatattgtagcaatagtgagttccgttgtggtaatggtctcctttttgaggtttatcattgtccaagtcagcagttcacgttgtaaacttcgcattgaggtttcatttcatgctgatatttagtgttgtattcccctgagtttcattttttattgacaacatttcttacagggtggctatgttcaaaaccatgggttgattactctggcagagggatgcaatcttagtgaattaaagctgtgtggtgttcaagagttgacggacgaaggactggttgaatttgtaaagatacgtagtaaatcattggtctctcttgatatttctttctgcaatggttgcataacatacagatccctgtatgcaattggtacctactgccataacttggaagtcctatccgtggagtccaagcatgttaatgaaaacaaaggaatgatctctgttgcaaaaggatgccaatatttgaaatccttaaagatggtatggcttggtgtcggcgatgaagctttagaagctattggttcatcttgctctgctttagaaaatttgtcacttgacaaccttaataagtgctcagacaggtaataggtccaattattaaatctactgttgcatttttacagggatggaagtatcggtgtctcatttctcttagaaatttgatatagcttatactgatactgcattgtgatgcttatagaattgaagagtagaaatgctgaaccatttgttaacaattgttttataatttttttatattgatttgaacacatgctcttttcttaatttcagtagtgaaccacctgagtataagtttgcatgttaagtagtaaataaagaattatgttttctctaagtactgcaccttgagaactttggcaccataggatatttaaagcagactacaggaaagttaattttttgtgcgattagaattcttaggccaagataatggtacaaggttaacatcaataaatgttttacataaaaatgaaatcagcgtaaatatgaaattgataaattgagggtgcaatttatgcctttttttaggaccttcccaaactttcagagaaatatgcacttcttttttgtaaaaaaagaagttcaataatgcacctgtagatttctcacttttaggagtaattgtatatattattgtagttgggttgtgaataatatactgaaaatatgggaaaaatcacttgtggggcatatttgccctgtttggtttcaaattttcatgatcatcgtggatattatttatgacaaaaaaaaagagtaaacttcataagtaacttttcctggtttgacagcatttgtccccataattttgcgggcgtacatgtgttcagcaaatgctccaatatccacttttttggagagtttttggaacactttcaatgtccaaccagcataaaggtggttactagtataagtaccaatccaattgttccttctgtttcaaaatatttgtaatgcccacagttcgcacaagccagctagaagcacaaaatctaagaaaaagttggtaagagagtaagaaaccatggctgctccctaataaattcataatacggccacctaactttcaaaaactttgattaaggacggtggaaggcaggtggtagggaatgagggtaatcttgcaggtagaagccacctacaatatttgtgcattgcttaagaaggtatttctccattgaggagatcaagatgtagctattgaaaatttttccacctgcgacagtcttgcaggtggtagggaatgagggtaatctttggtgtctagtgggagcatctgccccgccaaaagttttttagtggttcggcaaacctaggcagctagatagccggggttgaccggggtgtgggtgtgttttttgcggtaggagggcattggtctcttctactttgtatttttcttttattttcttccccttaatgaaatgaaactcaattctcttgcgttttcgagaaaaaaacatatattgtgaaatagtggaattactcctataattgtgctgaacaaactatcagcacatgggtcttacttgtaagacaccgttagaacaacaactactttggtgaactactgtatcatttatagtttatcctttcctatatatggaaagtcaagcaatccccatcaaaacatcaagaaatctgctatatgcgaagtttcttttctatagttttctcatgtccacttactttaagatttatacctacatgaacatggcacacaatatgttgttaaattttttaattggtatgtatatttgcaagttagttctctctaaaaatcagcatattaagagtaatctcctgaaacggtccattcaaagtggatatattggtcaagacattttatgtatgcatcttctaatgcatgactgtgctgtagtagtactgtgttacttgacaccgtttatcccgccacagtgcaatgttagttgggaagaaccatagacgggactagaataatttgtttctttctaagttgtgtttatttccttatatgcgtgttccttttatttgtgacaagtttctctagatttagatactatttcttaaaggttaagcaaattgtgaaatagttgcttaaaattattatgtttttcaactgtaattctctatgaaatatcaaaaaaccataaaccaaattttagatttgccaatatagaaacccaaaatgtaattatactgcttataaggctaagtacaagcctgattcaagtatgctttgctacaaggtaatcaaacaaggagtactggttactgaggtttaaaaccttatagcaaatttgaatggttggcatctactgatctgtaaatgatgaaagttatacatgtgaaatatttatcaatgactagttgcctactgcttgcacttcttaccttgttgtagtatattttctaggaatatatggctacttattttcacttcagttccctttttctcttattgcaagcattgaccattctttgacttctgttgttcttttcagtaatgccccttatctttggagcgatgtcctagggctttattcaactgctaatcatttgctactgcaggagccttttttccatagcaaatggatgcaagcagctgaaaagtctaattatcaaatcgtcggtcaaattcacagatagaagtattgaacgtgtttcccagaactgtaaaatgctacaacacatggaaattaacatgtgccatattatggaaagtgctgcattggagcatattggacagcgatgcatgtatgtttcttcttgattacttaacatattgcaactcgcgcaatttttattttgacatggtacaaagtttgtttttgttaacatacttcctaccttgtacttttcaatttatacatatataaacaggatttcttttattatttgctagtccgttgaggtttggactaaatgtattccttttgacaaaatatgcacgttgttttgtgataaattaaattggagattaggaaaactgaaggtgtgctaatatgcggtaacaaataattaataagcctgaaagtttcaacatttcctattcaatccacttgttattttgatgtttgtacaacagctgtaatctaagttgcatatcaaatgtttgctcaaaatggaaggttaatgttagtccaattgttcgtattctcttgaatccagctatgattagagaaataaaaagttggaacaaaatcaacaattcccagacatgtattggacttgtttcccctgttaagtgttccacaaatgtttcccaatgagtaaattttacataactacatattttatggtccaagttgcagaaaactacacatactttgacatttggcacttaactacatatattttggtattaaagtttcacaaaactacactatcaacgaaatgggccattcgcgagatggcgcggttgttccacctaggatgcagacttgggaacttcatcctaggtggaacaacaacaatgccacgttcgcggcctaaatatgtatagataaacatccatgtcatctcacaggtaggcccatttgttaatagtatagttttgtgagacttcaatatcaaaatatatgtagttaagtgccaagtgtcaaaaggtgtgtggttttgtgaaattcactctttcccaaattatcaacatgtctaacaaatgtcagtgtgtgcaatatactggtataatgattgaagtgctgtcgaaacctaaacttattagtctcgtggttaaggaacagacagttttttagtaaaaacaattttatgaagtagtgtaattttaccttgtttaacttagatagcaacggagtagtctaaaaacgatttttttttacctggtttggtgtgacgagattagcacatcaggcctaattcccatagcatgcacatgacacgtattctctaaactagaaccttcactctttttgaatatattagtaatttataatatcataatactatgcctctgttattttcttatgggcaaattttgaagaactgggttctcagctgcttttgtcattctaaattatataggttttgggcgatacatgctactactctaagcaattacttttgcctttgtcctactgtcaagctagacttcacaatatactgttgattttttttcttttgtgtttgtacatgttaaacgcagaaatcttctagggctcactctaaacagtctgtggattgacaataatgcatttctcggatttggtcgatgttgcttccttctcaagtctgtctgtttggccaactgttgtaaaataagcgatgaggccatatctcacatagctcaaggctgcaagaacttgagagagctttctatcatctcttgtcctcaggtacatttctagtttgtattaatctacatttatgaagattgattttacatttaagaaaaaaatgatctataccatcaaaatttaccttcagatttataacactaaaagtttgtggtacattttaataccaccaaaattttacttccatctccccgcccaattttccttttcttttggtgcgatgttcaagactttgtctccaatcacttcaaggtgatggatttgtaccagtatagggaaatgggcatggctagcgaggaataatgcatgctttctccagtcacttgttttgatcatacgaatgatgatacgttatcactaagtcatacagatcactatgatagtttgtcttagggtgatcttgcagagcaccttgtgtcttcacatagtgattctgcatatcacagcttttgtacgatcactatatttatctgaatagtgatcatcaacgacttgtcccagtattataatttacattgttaatcaatacttcctccgtcccaaaatatagctacctagtacaggatgggacattatctagtactatgaatctggagagcctgtccagattcatagtactaggtaatgtcccattctatactaggtagctacattttggatcggaggaagtatataataagaataaaaatccttatttttgttgttattattatacaaaataataatacagtacatgtggaatacgggttcaatctcaagagacatgcccattgaacaaaagatgcatgttgatgaaaggtgcctatttgtccctttagaggctatacatatggaagccataaacacctccaaggggaggatcctgaagtccttttttttacataaatttcctgtaacaaagtttcattgtagtctcaacatttccaagggagtaactgaagtcagtctccctttatttgaaattttgaatttctcagtattggattgttggcaccatctgttgtgagaatagaccctgccattgtcgtggggatgaccctgccattgtgtccatggagccaccatcaaaagtcattgctgggtagggcccttgatgtcatagactatgccaccgatctcatggacgaggatttttgtcatccttgctgatgaatcaaagaatccctttggcgaggcaaaactgtcacatgccgactccacattccctggcagtttgtagcaagtagcaacttttctgtccacaagcacaagtatttcctgagcccccctcctgttgaagggagagatccaaagagcgatgaaggaatgctgagtcatcatggtctcataacggctttgttgatgaggatttagcacatgactctgagtagaatcttttcctgagtcttaaccacatcccttctccctcattcgatgtggtaatgttctcctgctttgtcaactctggcatttgccaggttacagttgtctttcatatttgccaattaggctaatgtttatcccaagaccaacatgtggcaagccgacaccagagtttgctgctcggctgctcccaaaccggaatacggaatgagaaaatgtttttattttatttcattgtaactttgcttgtatatattaagttgaagttttactctgcagatcggggatgaagcattactatctgtaggtgagaattgtaaagaacttagagagttgaccctccatggtcttgggaggtaagtacttgaatccatgattcacttttttacatgttctaatcaaagataactttaattcgttagcctttcttagatgatagttccaatcaaaagttaaattgacttcctgagttcaaagtgaaaggtatacagttgagttgcatgtcattaatttttccattttataacattttcttcaaagcattctgacatcattctgttctaaacattttttttgttgagtataaaaacttttgttctatctattatgacaaagatctgctaacatttggctttcatttacaggttaaatgataccgggcttgctacggttgatcaatgtcgtttccttgagaggttagatatatgtgggtgcaatcaaattactgattatgggcttactaccattataagagagtgccatgatctagtccatctgaatataagtgataccaaggtctcccctctctctctcaacatcataagatagaagatattgattttcttgttctaaaatgacctctagtcttagttaatttcagaaattgtttatagaattcgtcatgtttgttttcctaccttcatgcatagcaattaaagcattgatttttcccctcatggtcctgcactgttcttcagaaaattggtgacaccacactagcaaaggttggtgaaggattccgaaaattgaaacatctcatgatgcttcgctgtgatgcgattagcgacgttggcctagaagatattgcaagaggatgcttgcagctggaggcgtgtggggtgttccgctgctctcaggtaactccagcaggcgtggcagccctagctggaggcagctccagattgcagaggatcattgttgagaagtgtaaggtgccagaggaggccacagggaagtgcaggatgatcaatgatcccatccttatttcttattattaagacgtgaaattgatgtcttccgggcatagctgtgaaggaaatcctttgctcgtttgagcttacatacatttaaaatgtgagaatattttaaacaatgatttcctggatgatggttgaactggtgggtttttattgttggaatgttttaaggaaactctttgctcgttgtagtttacatacatttaaaattccagaatgtttttaaacaatgatttgctggatgatggttgaattggtggggttttttttgttgttgggacgctttatggaatgtgcaaggtcgggacatactaatgttgtgatttcctaaactttatgatctagcaataatcaaaggaaacattttgatatgattcttaatataaacttccttgcctcacaaaagtttatttggaagttctttaaattgcaaaaaaggagttttcttttctaaaggttgagttggctttgagccttgattattatcactgtatgaagattggtcattctttaatttgaactgtggtttcatttgagacgacattgtctaattaattaaggctagtacgttttacctactaggaatagttattaatataggcatagtacttcaattcaatcttataggtatcggtcgtacttaaattcaatctttttccctttgggaacatgtacttctggacctgaagcttaaagggaattatggattagaagggtttaaataaatgtaggctgtgtttagatctaaagtttggatccaaacttcagtccttttccatcacatcaacctgtcatacacacataacttttcagtcacatcatctctaatttcaatcaaaatccaaactttgcgctgaactaaacacagccgtagatctgtattattggagatcaagactgtacaatgcgtacatttacaccaacttggttgaatgcacacacatgaacatattgaagatgacagtcaaccccacgacgtcgtcgatcatcgttgcatgtgcttcgatcatgcatccaacataactacatcctctactctcctatgtgtggtcatgcaagattctctgcaggatcttgctatctcgggccctcttgagatttttctggtccaaggaaaaaaaaataagcactcctattgttcatcctttagcttataaaccaaaatttaaacttcaaaatttaattttgggacagatttttgggttaacggtagtttattttacaacatttgtatttaaacagctaagaatgtatatctatatatatatatatatatatatatatatataagttttatttataaattatttttgtttgttggtaaaccgttacagcttataatcaacaatgtagtgacaactaaaatttcttggaactattaaagctcttttgaactgcttcaatttcgggaaatattttttaacaatttgaatttctcccgatgagatttttatatgtatagtgggtactgctggattttcccccgaaactgagatgaacacaaactagaactagagttctacttattacatagaagcgtagctcacgatataagagatcatgacaacggcgacaacatattgaattgagccggcatttaattatacatagccaaagtacatactactagtatgcatacgtatatttatactctatactctatactatctaccatttcatcactgccagtgagatttaattcgctggtaaattaactaaacaaaatgtagcttactgtagcactcctacgctatacgtacgtttgacattaactcttttcgtggcacatcttaactccatggatcatcatatcgatcgagctgtaaataaatagataaaataaataatcagtgctgaattattaacatccagtaatgcaattatatatgcaatgatcgcctatataagcagttcattggacgcccttgctcttcacctgcaaacagtgcaactactattgagagccacacacaactgtagcttcgccatgggagcaagctggctgctcctccatggcgcggcgctgatgatactgatggcggcggcggccgccggtgagacgacggcgacggcgtcggtcgtcgtcggcgcggccaagtgcgccggctgcggcaggaagaacatggacgccgagaccgctttcaagggtaagtacgaatgcaagcaactactcgctccgtttcgaaatgtttgacaccgttgactttttagcacatgtacaccgttgactttttagcacatgtttaaccgttcgtcttattcaaaaacttttgtgagatatgtaaaattatatgagaatcaaatgataggaaaagaattaataattacttaattttttgaataagacgaatagtcaaacatgtgataaaaagtcaacggcgtcaaacatttcgaaacggagggagtatatacggagtacactcttgatgatgggacagtggtatttgacaaagattacaattgacacctctcataaattaaaagtagaatatacgcgatatttgggtacaaaataaccatcgagtcgattatataaacattgttatgtttagatctaaaagtgcgcacatcctctaccataacgacagatgttgtaacagacacctattgacatgtgtgggcctgttatcacagatgatattgcttgggccaaaaacttactagcaggccataggattatgctttacctaggctcaagaaaattcttggatcagtcactgtaaccgattcgctttgattaaaagaaactgtgtcatctaactgtgcatttgcatgatcaccaatcaaagcaactattaaatgcacaaaaatgttgtgtttatttttgttcattttgttgacaggacttaaggtggcgatcaagtgcaagaacggcagcagcgaggagtacgagagcaaggccgtcggcgagctcgacggcgcgggcgcgttcgccgtgccgctcgccgccgacctccgcggcgccgactgcgtcgcgcagctgcacagcgcggcgaccgacgcgccgtgccccggccaggagccatccaagatcgagccgctgtcgtcggagggcgagacgggcaccttcgtcgccgtcgccggcaagacgcacctcccgtcgtcgacgtcgtcctcgccggagtgctcgtcggtggccatctgcttcccctgccacaggcgccatcgcatgttccacaggaagcccatgccggagtaccagccgcctccctcgccggtgtacggcacgccggcgccgggatgctcatgctcccctcccagcacgccgccgggatacggccagccggcgccggaatgcccccctgccgacccgggttacggccagccagcgccggagtgccctcctcctcccacgccggcaccggaatgcggccagccggcgccggaatatcctccttccacgccggcatacggaacgccggcgccggagtgcccaccatccacgccggaatacggaacgccggcgacggcatgcccacctcccacggcgccgggatacggatcgccgtcgcctttctggccccctgtctcgccggcgtacggcacgccatcgccgactccgatctaccgtcccccggggagccactgatcgatcgatcgagttcactgctcgatctccatttccaccaaataagttgatgatgtagctactgtatctcgcaactactggcgtgcatttcatttatcggagaaattaatggatgcaaagccacgcgtgcgtgttcatggcttcttgcgtgtttacggcatttgggaatgtgctttgcatgcgctgaattgatgttgattttaacaatgcagtacgtgataataattaacattcaagtatgcaagtctaattactggcaaatatctcttgttgtataatgtcctgtgtattgatctggatcaggggtcgacagggtcatgctgggcgagagtccctctaataaactagaaaaaactactataaattttgacgaaacaaatctaaccatcgatttcaaccaataaatctttcttctaagtcaatagctcaaactaatatgtgcaaaatttgctacatgatataaaaaaaatgtaactatctaggggacaccgcaagaacacgtttctgtgctagggcactgcaaaaaagtagtaattatttactagacacccgtaatattattttattatatccgaataaatttaagagtgaaacagttatgaaagtacgatactacccttcaaacccgatcaagcctcactcacatgttgggacccacctatcgtccccctcccttgcgtggcaccacaagcgagtgcacggtcatctttctgccctatacgtagatgtgtatatataaaatttatacatatattatataaagaaggtgaaagttcaagttgcctctctaaacttatgtcgtacgatttaccccctaaactaattaaaataccaatatttcacaccctgaactcttaactctaaacgaattatctcctaactcattcgagagtggttttcgacctacgtgtacaagttgcaatctagtcagtaaatacaaataaaaaatcggtgaggcccaattgtcagtgatgcgtgtttatcctcagcctcaacggacgataattggggccgcgagtgcgggcgggagtagaagctagaggagcaggacgattccacctcaccaaggcttcagcaataacgaaggcagtgctcccgttgcggcggcgaggtagctgccacctctctctatgccgggacagaggaggctagatatctgaccgttacttcctccgtttctaaatattcgatgccattgacttttttaaatatgtttaaccattcatcttattaaaaaaaatttaagtaattattaattcttttcctatcatttgattcattgttaaatatacttatatggatacatatagttttacatatttcacaaaagtttttgaataagatgaacgatccactatgtgttaaaaaatcaacggtgtaaaatatttagaacagagggagtaatttgcaagccacagctgccagtacaggaacccaggatgggaagacgaggcagcggtgactacgcgatatatagccgacaaggaggtaatccccaggcgacggctggccacgatggcgtctccggcgtcgcatgcctcaatcacacggggagcatgcacgagacggattcggacagagacagtcgtcgtgaagaaaaaagcacaagacggacatagcagctaattaaatcaactacttgcatgcatgctagtcatcatcataaatcttcttcttcttcattggtaaagctcgttgcaatgctacgtgccagtggcggatccagaaaatcgattcgttggtgtcatataacatatctatcgatgtcttaatatgctaattatgcttagatcaaatgttataacatatggataaagagtttcactataggttttaccaaaagtgttgggtttagtcccacatccactggtggaaaactgggactacgaatccgggactaaagatcgctatctttagtcccgggtgaaataaccaggagtaaagatcgatataaagagagggatctttagtcccggttaatgctaccaaccgggactaaagagaggataggggcagtcccggttggtctattttctttttattttctcccaagtgggatgtatatacccagatcaaacaacaaatccccaaatcgagtgtcatgcatatacctaaatcaaaccccaaatctccaaattcaaagtaacatcacaaatcattcacatcacaaatacaaatcctaagttacttacacacaaatcaaatacatcacaaatcttaaaaaaattacacacaaatcaaatgcatcacagatcgattatacatctcagatccatgcaatgaatcacaaattctaaaaaagaaattatacatctctcaatcacaaattataaaaaaaaaaagaaaggagagccggcgcgtccccgccgcgcgcgccgcgcgctaccccaccgcccgccgcgcgctgtgcctcgccgcccggccactgcgtgagggcacgcgaggccacctccgtcgccgcctggccgctgcgtgagggcgcctccgcgcttcccggccgcgcgaggccgcctccgcggccgcccggccgccgccgcctgagaagtggggaagagacgggagggggcggatccagaggaggttgagaagtggggaggagagggaaggaggcggatccagaggaggtagaggaagagatgggaggagaaagaggaagaggaagagatgggaggaggaggaagaggaagagatggggtgagtgaggagagaaggagataaatgtcagaacttattaactgatcctcccgtgcgccttggtcctctcgatctcgcacggtgcatgtcgattggtgttaggttggtgtaaaataagttaataacttattttatttaaataagttattttaaataacttattttgttttataagttattttattttatcttattttattaataagttattttatttacacacacctcccggttggtgtcaccaaccgtgactaaagataaagaggggtctgacaccacctgccgtcttttaaaccgggactaaaaataatctttagtcccggttgatgttaccaaccgggactaaagatcaaaaagtagctctaaccttttgaaccgggactaaagatcatcttttgaaccggtttttagtggaaccgagactattgtggatttcggccgaccgaccaaagatggtttctccaccagtgatcggtaattgatgatggggagtatgacttaaaaggtgggagcaatcctcacccaagagactagtctgttgggttgtgtaggtccaggacctaaaattgtggctccggttgaatctggggtggagcaagcccaatgtgatctgggtggtccacggttggtgggccgagctgcgaactctaacataaagtcatcggtattacttaacaccggtctttttactgtagatccacccctactacgtactagcatagctagagccctttaactgtagatccgctcctactacgtactagcatagctagagtgcgacgacgccgatgaagacgactgggctacgaaagggtaaattgtactactgcataatgtagagggtgatttgaactttacattaatatacaatataaactttgtatatacacttataaaaatctttgcatatgtataaactttatataagtatgtatacactttaaatgtaaaaaagatttatatgtatgtgtacagagcgaattttctaggatttatccgtcgacagcgaggcgcctgtggtaacttggtaacttcgtcaatcttaaggatttgccggcccagtattcaaagatgctcataggggtagggtttacgtgcgtgcgttcataggggtgagtgtgcgtgtgctgtgagtgactacgttgttaaaaaaaactcggtaagtatacatacaaacctcgtatatatgtataaaaataaaaaattccatggacccataaacttaaggcaacaacatgtgattttttttgtttccgttgttattctatttgtaattaactaaacaatttaagatcatatcacccatattttaaaaatatgtatgattagcaaagatcgttagtgcggaaattatagcaaagaagccgcatctgtttattattatttttttgtgaggtgcttaattagtcaaggcaattagtagcattagagccgtatatatatatatatatatatatactggtttattattttttgatgtgttgcatgtcgatcggtggttggaattgatatgacttgcataattggtctagcccttacctaataaattagttcacagttcgttttgtgcttttcgattttgtcgagtgggtaatgagttgccctcaggcgatattaattcataattaattattaataggatatgtcaggtttgagttcgtcgtgtccccgtatcttttgtgcgggttcgtatcctctaacatcaagcagtaatgacagagagtgagcagtgatgtgatataatagtatatgtattcccgaaaccacgtgttactactcttaggctgcattcgagcgcaggagaaagagagaaagattgtttcgtttttcacgtgcacgcttcttaaactactaaacggtatgtttttttcaaaaaatttatgtaggaaagttgctttaaaaaatcatattaatccatttttgaagtttaaaatagctaatacttaattaattatgtgctaaggctcacctcgttttacgtatctttccaatcttctcgatcccctccttttcaaacacacccttattctggtcgtgatctcttgtgatacaggtcgaagagctcatctcaaatcattgagcgtgtttattatagaacaatctttaccagttatatttaataaattgtgagaattttttttcatgttacttcctccgttttataatgtaagttattctagcatttctgacatttatattgatgttaatgaatctatacagatatacggatgtctagattcattaacatcaatataaatatggaaaatataagaataatttagatggtaaaacggaggaagtatctggtacgtgaaagagaagtaatcgatcgtccgctgctcaccaccctctcgatcgtgtcaccgggagcacaactttttaaatttgccttgtggagagatggtgtgagtttttacggtcctttggttgagtttttgatttaaactatatctatgcaactattcatggtcggtttggtttggttataattattgaacagtgaacagtaaatgaaatgatcagaaaacagatgggatatgtcagtcacgtgtcaattatacgggatgattctaaacttttcagaccacatcattcattgtttatatatcatccaaataataataaaacaatttaaattaatatctgataaatcactaccgatatgtaaatttaaatttaactgtaagacaaatttgactaagctatactttaatgtgttatttatttaatgtaatatgtagaagtcaaatttaacttgtatgtttgtgaaataatatatcaaatatttgtctatcctgctaacatttaaaaaaaatatttaacaatatcccattgggagtttaaaattcatttcctagtttaataaagtgagggtacggtctcagctccaatgaagcacagccaaacggtttcagctccgtcaaaaagggagtgaaataggctggagtactctagaaaatgaactagagagctggagctgagtttatgctccacaacttcactctagacataaatcctgaagaaaaatttagaagttgaagccttatcaaatactcggtccgtccagatcctagtcctatgtatctagacagtaagacagttagggatggcaatttcccccgcggggccgggtcccctgcggggagttggggccgggccctgtatttgggcggggaggggacgggagagacatttcacccgcagggccccgggggatgtatattaaactcttaaaatgtagcgcataaaaggcccaatagaacccaatacaacaaaatagtgacatatataaacaaaaccctagctctctctctagtctctccccaaccccatctcccctcccgtctcacacataggcgacggcggcggcgcttcacaatgcaggtcgccagggcacggcggtcgccctctcggcctctcccatccccagctcccctcctctttcctcccctcctctcccctctccggttaccctctcccgctctccctccggtctaccgagtgccgacgacgcacgtcgcacgggcggtgcgcagggcacggtggccgacgagccgcgcggcggtcggcgcaacgcacaggcgctgtggtcggcgagccgcgaggggaagcgctgtggccggcgagccgcgaggggacaggcacggcggccggcgagccgcacggcgcacaggcgcggccaccgttcggagagtcaattatgtacaattatgctatttttgatggtgtgtgaattttgtaccatttttgttcttgccgaattgatagctgtcttgtatttcttatgctgatgggatggagattttattcaatgcgggccccagtcagggtgcggggccacggaggggtcggggacggggctagatttagccccgcatctccagtcgggaccgggggcgggggcagggggtgaagtcgggggtcgggagcggggccgttccagcccaacccggccccgccctgccccgttgccatccctacagacagtccagatttatagtagtaaaatgtactccatttaaccaaaacttcttatattttgagacggaaggagtagacccttggtggcgggcccaactaatttcagtacaaagacagccactccagatattaggtggtggtagtacttgtcagtactgatagctaaatacagtgacatatattaactatttctttatgtcttattcactcggctctaggcatcattggtattctgatctagacatattgtaaaaggaaaaaaggaaaaagaagcattgctaaggcctagttcgcgaaaagaaaatatttgagtgtcacatcggacgtttgaccgaatgtcagaaggtaatacacgaatgaaaaaaaataatttcataactcgtctgaaaaccgcgagacgaatctgttaagcctaatttagtgcagcacttatagctaatcatggactaattatgctcaaaagatttgtctcgcaattttcatgcaaactgtacaattaattaattagattttgtttttatctatatttaatgcttcatgtatatatctaaagattggatgtaatgttttttttgttaaccaggcctaatactgatattctggccttgaaatgtactagcccatgctgcacagtgcacagctagcacgataaaatataatcttgacacagctgcacgttgcgccattagccatggagtccggcggcttccttgcacgtcgtcccgagccatgcgccgccgccgccgaccccgacgacggcgacgcccgccgcggcggttggcgcgccgccttcttcctcgtcggtaagtggcggcttctcaggctttagtgatgacatcatctctctcagccaggcttaatttgttgctgacgtgtgcatgcatggccatggcgcagtcgtcgggttcttggagcggattgggttcttcggcgtgcaaggcaacctgatgctgtacctcaccggcccgatggccatgtccacggcggcggcggccaccgcggcgaacgcctggggcgggacggtgctggtgctcacgctcgccggcggcctcgccgccgactcctccggcctcggccggtaccgcgccgtcatcgtcgccagcgcgctctacctgctcagcttggggatgctcacggcgtcgtcgtcgtccatggcggcgcagcgagccacgtcgccgccgtcgtcgtccgccggcggcgccgtcgtcgtcgtcttctacgccgcgctctacctgctagctctggcgcagggcttccacacgccgtgcgccgaggcgttcggcgccgaccagttcgagagagagggtgacgacgatggcggcggcggcggcggcgcgcggcggcctgcgtcgcggagctcatacttcaactggtaccacttctccatatcctggggctacgtcatctccaccaccttgctcagctacgtcgacgagaacgtcggctggaccgtcgggttcgccgcgtgctgggccaccatggtgctctacctcgccgtcttcttgctcggcacggggacgtaccgccgcgccgagcgacctgccatcgacggcgccgccgcggcgcgtcgtgcgtggacggcgaggttcttcttcttcttctcccgaaaccgaaaggatgccgccgaacagcttctagaaccacaagaggaggtggtggtggtggtggatggccatggcgatggcggcaggggatt

SEQ ID NO: 57965 - DNA, 25291 bp, Oryza sativa
  unsure (1)..(25291): unsure at all n locations
tgctccagcgcatcggcgccggcatggcgacgggctgcctcgccatggccgtggcggcgctcgtcgaggcgaggcggctccgcgtggcccgcgacgccggcctggtcaaccggccgggcgcgacggtgccgatgggggtgtggtggctggtgccgcagcacgtgctgatcggcgtcgcggaggtgctcgccgtgatcgggctggaggagttcttctacgaccaggtggccggcgagctccacagcgtggggctcgccgtgtcccagggcgtgatgggcgtcgggagctacgccagcggcgcgctcgtggcggcgatcgactgggcgacggcggcgaggagcggcggcggagagagctggttcgccgacgacctcaaccgcgcgcacctggactacttctactggttgctcgccgcgctcgccgctctggaggtggccgtgttcgtctaccttgcgcagcgatacgactacaagaacaaatccaagccatgatcgatcgtattcttttctgattttgtatcttcttattttagatatgaacaatggcgtgacgttatcatttagaaaaaatatcaaacatattcttttaattgtatatccctactattataaaaagagtaaagtgcacaggtagtccttaaactaataatggtgtgtcatctagatccttaaactcttaaaatgtatatccaaattctagaacttgtcatagtgtgtcatataagtcccaattcaccacagcccctttctacatggcgctgatgtggcatgccacacggacataacgtgacaaacggaacccatttaaaaattttcctttttcctttttcttctgttcttctatttttcttctcctttttttttctttcttctcctttctctgcgaccggagcataagaaaggaaagaaaaaccgaagaatgacaagaaaacaaaaaggaaaaagaaaaagaaaaagaaaagaagaagaaaaaagagaaaatgacacgtcacgttcatgtggtgtgacacatcagcgccgcgtaggatcctaaaggggctatatcgatttgggacctaaatgatacactttgacaagttctgggacctgaatctgtattttgagactttggagacctagatgacacaaccttacgagtttaaggaccacatatgcactttacttttacaaaaattaaagatatttttgccggtgttttggtacgtcattcgtgtttgagtcggtttttaaatcactcgcttttggaaatacagatctgtgtttgagtcgtttttttaagttcgttcgcttttgaaaatacaaaaagagtcgtataagaaatctctttaaaaaaacatacatgataattacttgagataatcaaacttctaattacagctcataattttgtaaaagaaacaaatccaagtgaattcccatagtaaatttcaccttaactaaaccgtataataataagatgattaacttatctaaaaaataataatatgattaaaataacctttccgttgcaacgcacggatattttttctagtgtagataagagagagagagagaagagtaaatgatgccttctgtttattagcatacattctaataggaggagactatatcaaatggtgtgcgctgaattgtcctaatcagcgaccttgttactaaaaatagcaggcatgtcgatgggtacgtgccaaataagcgattgcatagggcctccaatttttttcccatataaacatgaggcccacttccaattgcccagctatagcttgcaactgccaatagcccaattaggcagatcgatcagcaaggtcatgctagattgccaggggtggggcactattggactgtgcgatggcctaacttggccctgctgctagctggctgctctgcgattctgattccgcgccgtgacaactgctgagacgtccatcccaattccatgcacagtgactggcgaggcggcgacacaacttgctgcttgtgattccgaggctccgagcggcaacggtgacggcaaaacagctgcctcgcctcggctcctgccttccccctcctcgtccgctcatcatcctcgactcgactcttgacagcttgacctcggaccggtaagattagacagtgattgagtacatatatgatagattgtaaattcataatatgcatcaaattaccatgagttcatgattgtagtttataatttgaatgatccattaaatcaaattacaatgtttgaataaaattacttgtattgtacattacaacacatattacatctatataattgagcgaaaatatgttttatttatattagacataactttttaaattatagggcatttgcatttcaccctagggccccaaatttctagagacggccctaaaaaatagtaccactgcacctttcactctctaaaaataataccgctcatgaacagatcatgcttttgaagttttccaacctaccaatttcatgtgttgccttggccaaagagcccacctacttcctaacacctaaacttcaaataaaattttctcttaaattactaatctgatatacaatcagattgtatcattatgttcattgcaacttaatttttataacaagatctcacataattatattttaatggaagaagaatatgtgtagtaaattacttttgtgtatctataaattacttttagattggattagattacttcttagacattctcataatattgtgaatatgttacttttattgttgtttttagttagttctataatttatgttgattcaatttaatttctagatagacacatgtttttaccaccacaactgatttactttaaattttaataccatgataacttacttttattttgtgttaagttacttttataatttgtgtgaattattttcaggctttattgaatttactttcataaatatctaagaagtaatttattcaaatctaaaagtaattataagtagttatatttagaatcatgcaaaattatcccacatcctttaaacatgtgccaaataatgcaaaagacatataaacaaaacaaactgtaccataaaactgtcaaatcgacataaattttatcattatttttaactcctctaagaacatagttacttctaatactgcgaagagttacctttctctagtagtatagctacttctaataatgtgaagagttacttctattttttagttacttccctctagcatcaagtggtacttaagttacttctaataccatgaaaagttacttctattttttgagttatttctctctagcagtctagttgcttctagtatcatgaagagttacttctgtttttcataatttcttccctctaacaatgtattacttctaataccttgaagagttaccttccatatgttgcaaaattacattttttgaaaaaaaaatatagtggttacttcaaataaagaaaatatttgtatttacttaaaaatcttcgtacattttacttgtgaatttacttcacatagttattacaactgacctgctacgtaattagttctattactatggagagttatttctattgaataactaagttacttctaaaatttaagtaaattacttttaaatatttgaatatattcgatattttgagtgtagtaggatggttcaaacgaattttaaaagtaatgtgtggtttaaaagatataaatcatcaaaagttctataagaaagatagactagtataactaatcttgttggttggtggtggcctcaatacgtagcaggtgaaagggcgcacgccgtgacagtacttaatgtcaaccttaaatgcatccgtcgctggataaagacaaaatagtgtgcacattacttgttgactcgcacggatggatggctggtagacgcgtcgcgctataagacgaaacgagagcacgcacgatttagattttgcaattctaaaagatatcttgatagcttatatatatcctataatatgcctatataaaaataacattcattatactatgtcatctagatataacatgaaaatatttcaaaaaaaatatccatggatatctaagttatatatgtattattcctatcacttataataaaatctattttgggtgaatcagtgaaaaaattcattgaaaatgctttagtgaaaaaaatgcacaatacaaacatcgcatgaaaaatgcatgggttgataaaattaatcaaatctaccaggttttagcagagtaacgacattgctttgtgaagactctacttcctcctttcagactaaatttgtgcatgtggtgcttgcagttggtcgggtgactcgtcacctctgtacgtgcatctatctcgcctacttgtcgcagtacccactcagtagtcaggagaagctattgtggcgcctccgcgtgagaaatccatgttgctaaagcataaaaagcccatcctgcaggcgtgaacaagctatatattcctgatgcatacgacgatgctgcatgtgttgcgggtaatagaactgtgccgctctattaatgcaggtacagcaaggattgttactcctctatatacatatccgatgtatagaggcaaccaatgttataaaaccagcaccgaaatcgacatcggtagctaaatgtggaagaaaacaccgtagtagatccaaacacgatgacgacaccaaggcactatatttgataacggagttcagcgaggcttcatctccgaagcactgattacgggcgctcctccccgatccagcatattacaacgtatcagagtgacaacgactcacgaccggtcaccgccggcagccgctccctctcgctatgctatgtcgccatgcggttacaacaggcacgcccttctatttatgagagatcctagaatagagtccgactcatactctagtcctacacctaatacaactccaagtcctaaactctaaccgactacgtacacatattcgacacaaactctaacaaactccaccttggcgaatatgccacgccaatccaaattcgttacttgctcgaatttcagtgtaccaggacttgagttgatcctttttcgccgctcacaccgagccgccctgacaagcctccaccaggctcatcgtaacaagatactccagtatccctgtaatttcttccttctgactccacccgcaacaatgctccaccttctctcatatcaccacagtcatcttgccaagcgaattgaattcttcctagctgtcacatcatagacttctcgaagaccatgttcacctctatctaccgtcttaagtatgacttgatataatccatggctagataaccgatgtcataaccaaatagataaatcaaactcaccagacatggagaaaaccctttcttccttatcatcttatgaaccgagctaataaatccaacatccacactttttcgcatccgtagactgaattcctgataatttgagaaaatcaccgttgctttgaatcattcgaagaaattaccaccatagcgcttgctcttctccttcagtgacgcagattctatatatccccatcatgcaaaccctgcagattatggatatattctgtactgccaaacgattttcacccgctgttgcccgggacgttcttcacgcacgcttgttgtcacacacctacacccgagctgcaccttttgcactgatagcttggccacaattgatcgaagggctccccgaagtgctaatgtctaggtgttgttgcttttccacggcctcggcatccatcacagacactgactcggctggcaaaaatcatggactcgggttcggagtccctcctaccagtctccgtgttcatctcgctccaacatctatccgcaccatcagcctcttctcttggcccactcctgatcttagcaccttgcaccaccacgtctgcccaccacgcccgcgacatgcactaatccgagtgctaatgcactagtgccgctctgtcgcctgtagattagtccgtagccctgcacaccatgcaaaaacttcttttatctgtacgtctcatgcatccttcccatcatagccaccgtaagattaccaagccaacaagctcctgcatcataattgataccttgcatatacatgcaattaatttaaccaatgcactttggatttgctcctgtacatgactggctatgactcattgcacgagttccagacaacttctgctcgttctatattgtgtgatgttcctgcgcgtgccgctgccgcctcctccgaccggagctggcccgacgaacttcgccggcacctgcacgacgactacaccaagccgtgctcctaccactcgacgctcgtcgtcccaaatcaccgccgccaagaggtcccaatccgatctccttttgccttggtgatttgttcgattgcaaagcaatcccatggaactcctttgctgacttcatgaggccaattgcatccgatttcttcaaatcagagtccgcatcgccgcctcttctcgtgttcgacttggcttcgtcttctacaattgtgccgcacgcgctgtgaccggactccgagtccgcatccgctactgcgccgcgaaccccatcagaaaagataccgcgtaatcaccgctcaaaccgagcctgctaccaatgacgccgctttggtctacgccgccggcttgaccacaacgcgaggatcgctcacaccgccgcggccctgaccatctccaagcttcatgtacgcctccacgacttcctacaccgccaccaaacacttcgggtcaattccattgacagcgaatgccgccgatcaataaccagtgcctgccacaatgcaatgcttgtcgtgcgtacgtcgtcactgtagcaatccatcacgcactgcctcgttatcaacacctccacatcagcaccaaggatccatctgctccgacttccaattgaccacccctcaatccagtcgcgagccgaagccgacaaatcacatgccgtcttcccagtcgccgaacaacccgagtgctatgtctagccatctccctgtcgaacgcaactcatcgaaaggccccggccaccccaccaagagtgttcgattccaccgaccgagaacgccgatcgcctccagtttcaatcaaccccgagcgtgtggccacacgtctccctgttgagagtagctcaccggaaagttcgagccacccgcttgaagtgtccgacccaccgattggattgccaatcgcttccgccgccatcaacccgagcaccacgtctggtcatctccttgttgattgcagccatcaaacggttcaaaccgccgcctgaagtgtccgattccaccgatcaaattccgttgatcgccgccgtgctccaccttgcatccatgtccgtccctggacaccctgtgtagtcgtcgcggcgtggagcacctccctcgtacctctaccatggatctcccgtaggctctgataccacttgttataaaaccagccccgaaatcgacatcggtagctaaacgcgaaagaaaacaccgtaggagatctaaacacgatgacgacaccaaggcacgatatttgataacggagttcagccgaggcctacatctctagggcactgattacggacgctcctccccgatccagcatattacagcgtatcatagttacaacgactcacgaccggtcgtcgccggcagccgctccctctcgctatgctatgtcgccatgcggttacaacaggcacgcccctctattcatgagagatcctaggatagagtccgactcatactctagtcatacacctaatacaactctaagtcttaaactgtaaccgactacgtatatatattcgatacaaactctaacaaccaagtgaggatcgcgtacgcatagcacggccggcagcatctaagagtgactgagcgagtgcatgcgtgcatgggccgctcggtgcgccgctcacctcggtgacatacaaaaatcagacaacagataaagtactattagccgaaacaatatctacaatcataatcatgaatcattttaatcattgttcatgtactacaactgatattgtgtatttgtcatcttctaaactgtaattgccatctgtcataaagaaagctgattgagaacttatatctagaaagtacttattggcccatatgccaaagagcccctatttgatgaacatccatgtgcaaacagaaatagcaaacaccttattttctctctatctgtcaagtacattagttcatcacttccttacttgcttcgcatggcttgacaccacctcgtgcctttacacaagccatcacgtcacatgttcctgttcctcaccatagcaagacaccatagctacccttcctcctcctccctagtgacacggcgtattacaagaaaaatattttgtagagacatttttctaatactatagagacacttttcaaaaaatacctttacataggcattcaaaaaaatgtctaataagtgtcttatggtgaattatctctataaacgaagagacattttacaaaatgtctataagatggtagagatattttctagagacattagattgtaccacaatcatatgaaaccaatgaaaaaaacaataaaatattttcccttgtttttgccaatcctcgaaacttatgatcaattgcacaaatcattcttatcttcaaggtactaaccaactcaaccccaagtcattacttatatgttgttgccttgagttacttatatttagtcatttagtatatatttttattgtaagaagtgtctttacagagtttaaaatgtctcaagaaaatgtctttatatatcaggcacagtttaaagtaccgaaagaatgcctctacaagataaaatctaataaaatgtgctgaaaatatttctaaagtgttcatagagtaaaagttttctaggaaatttttaaagtgcctctataaaatgtctctacactataaaactcccgatctaagaggcaatttgcaaaatgcctctacaaaagtgtctttatataaaacttttgttgtagttgcggcaagtgcgaggcccttctttcttccccaagttgtgctagtagcaatcttggggtccttttcctagcgagacgaccattgccttctttctctgcacccccttactttatatcttctccggtgatgagctctgcaaccggttgaaagttcaagatttgagcaaaaactcagagattcaattggaagaagttaaagattttgaatataaagatgttttagattttggtataatgtttgtgatctcagttgaaagtttgaggagttaaaaagttttatatgtttcacttaaattatttgaaatctaggtatgaaaagcaattgtgaactgaagatttgtacaaaggagaaaaacgtatggcatataggtagagtggaagggaaccagtcgcgtatcagcatatatgcttaaaacaacagaatatatgagtaaagttggcaaatgcgtctttatcgtccaatattctgtttagatgcttcctttttttagaaacgtttagatccttctttgagctgtaaagtgacttcaaactgtcataggtctaacatctcatattatgcacactactaaaaaaatgatttttctggacaagagccccccgtaggttgcaggcggatcatcgtaactagttgtgcctgcaaaacccggcatgcatttttttcgtacggctccttaaaagacccacatgcaaaaatatatttcgcgggtggatctgttaaccaatccatccctataaaaagagcagcatctttgcatccaacaacaaccaatcaaccaataatagacatatatcggcgagaaattttaaccaataatcaactaatccatccctagaaacaccaaccaatatatcccaaaaacatgaaccaatcaagatcgggagaaatttgggatgccttacacacaaatcgggagaacatgcggcgccgctgaccgctatgctccgcccccgctactgtacgtcacacctaccatcgtgccccgccttctcacacttgtcccgcttggcatgcctgagctcgccggacacgttggcacacttcttgaccgtcttcccctcgggccccgtggtcgtggtcgtgatcgacgccacctccgacttctcaccagtggcatgctccgcccgaccgctcaacacgccctcaccctaccataaacaccaccaccattcaccctaggcaccttctcccctcctcctcactccaccgatgggcaactcatctctgacgcggcctcgccctagcgttgggtgcagaggtacctcctttgacctatttctcctccgttggcagcctcccggccaggtgggggaagaagagggagggagcgagggacgaagggggaggggtagggttgtgcgagagagagagagagagagagatgacaaggaggaggggatgtgcgactacagacggggaggagcggttgcgagagagaggagaggatggcggtacctatgagttgatacctatgaggagttttgtagcagtgacactaccaaaaagcgatttttatgacaattgagttttatttccagtggtggatctaaaaagctttgcccctgaaaatggaagagtggtctaaaaacctagccctgccagtaaaaataatttttgcaggtgggattttaataagagcaccgcttgtaaaaatacctctatctttgtgagtggtgctcttaacaccctgccattaagaattgattttttaatggcggagtaatgaacaccacctgcaaaacctactactgaaccaacagttgcatcgtattatcctctcctctcccttctctctcttgatgtttgttgcagcacggggaaggggtggctaggaggcccaggactgcgcgaactcctcgccgtcctacggtgcacacctcgcgaagaataagtggcggggaaggggtggcggccggtttgcagcaaagggtgggggcgatggctactcggtgaaggggagaggcggtggcaaagcgtaggggacacgactgcttcaggttgaggatggccctatgaccatgacggctcgagttggcaaggccgggacgacaatggctaccacggcgatggttcgtcttctctgcctactctgccacgcagaacctcaagagctccatcaacatcatgcatgtgcatcttggacaacgaagacaacggtaatcgagaccggaccaccagatctagcggtggcggtgcttgggaccgccagatgtctagctatatctggtggcggtggtagtccaaggagatggctgccctcggcgacgacggctccacgtgtaagctcggtgacggtggccctcggtggcgatggctccacgcgtagttcggcaatggttaccctcggtggctagggttgcggccagctcggtgatggtggcgacgacgacaacttcagcttgggttcctgcttcctactgctcggcaataacaaatttgggaagcttgtgttgatgcatgtgaatttgggataaggatttgggacattaattgtggatcctgattttaattttttttccattttaatttttttcctcctataagaatattttcgttggcgggtctctttacctattgtacagtgaaactagtttttttcgctagcggccttcttagcttggccacctgcgaaagtcaatttttgctggcggtcggcaaggccaatgaaaaccagcaaaaacctgatttggacgctagcaaaaacctgatttgtacgtagtagtgttagtacttcataaaaatattactatccattattcttgccaatctcatttgataagttagtaactaaattactacgagatctggtcgataaaaagattacttccattatatgcactacaattacaatatgatccactagtaatgttgtactcaagtcctcgtaggactctggtatttttactcacgtacggtttaattgaatcacaaaagatcgagcatatgctttctcttttgcaggggcaaaatgatagtaggagtatattgtttacttagtactccctccgtttcaaaatatttgacaccattgactttttataacgtgcttgaccattcgtcttatttaaaaaatttaagtaattatttattttttttatatcatttgattcattgttaaatatactttcatatacacatatagttttacatatttcacaaatatttttgaataagatgaacggtcaaatatgtgctaaaaagtcaatggtgtcaactattttaaaacggagggaatactatatataattatatattgtttcattgaatcacatcacatgagtaaaataattaggagtaccatgtgtacacgcacagttacacacgtccagtgcggtgcggacaataaaattacaaggtacggtgcggttgcgatgggccctggccggcgactttgccggcgatgaccaacgcaactgccgtgggatatcatcaaccgggtcggcggggccgccgtacgtcctcctccgcacggagcacgtacggtgcattgtccaagcggcgtcacacgagccgcaagcccaccatcccctgaacagggttcactctatcggttgagccgtttatatcgggggtcaccgaaattccgaaatttcggaaattttaaaaatttcggtctaaaatttccgaaattttgagtaaaatttagttgaatttaaacaaatattacctaaatttatgaaaaaaatttaaaaaataaaaaatttcagccaaaataatatcgtatcggaagtgaccgaaatttcggtccgaaatttccaaccctgccctgaacacactgtcagatgggctaggctgggttcggttctagaggatggaccgttaaacgagccatggtagaaaaaaatctaggtaaaataacccaacaaatggacaggcagttccatcggccagctcaactggtgggtagactattgctgcaaaagacttgtaaattaacttcttattgcagatcattttctttatgaaatgttatttgaaattttatatttgactttaattcctttttaaactattttggcaatggcacaacaggaacaggaaaagaaaacccaataaataccagcatgataaaattttgaaaaaagattttagctgtttcaaattttgttacacgttaccatctaaactccttgggaaaagaaactgttgatttggatatatattagtatatatggtcttcaagataaaagtttcaccgtcaatttctattgcaaggtatttaaaaatgctgataaaattatactaacagtattttttttaattcattctaaatatttaaaaggacattaatatcgaaaacttttaaagtttgccattaaacacatctaaactgcaatgagattccattaaagtcaacagtatagttgttccttcaacatatatagcagattgttaaagtaggaaaacactttccagaaattcagtaaaccactgagaagttcatttggaatatctgaattaatataattgaattaaactgaaatgttacaataaccctctttttgacagcgacacaataaataaaggttagttttaaaatattaacagcaagaggaccaacagggcaacaggacagagggcccaaaaccaagcaggatcaattgataacattttggttaaattttcattataaactgttggatctagcagtcaaatttgaggttaaaaaacaatatatacatgaatacccagaatccaccacatctctttaatagtacctacatatactgctgaactgaagacatgaatacctttctttctctatggtgacctacagaatgtggcacagatgtagcagtgccacagatgtaacagttattcaacttgaacaattcaagttaaacctgggaccaaattaaaatctccggccatgctgcaaatacaccccttgtacttccaacacaatctcaacaataactgttctttcaatgcagccaattgttgttgcaaacttgcagttaattgttcatgcatctctgcatgcattgccctaaaggaaagataattaagttgcccagtgccagatgcacaatggcaagaattgcagatctgagaaaacagagagaacaatcatcaacttttaacggcacatttactaacaatctgcaaagccggtgcctgattgaactggtagctcagctgatcactactatctactacctagctagtcgcagtttaatttaacacaccatctacctagttgcaatttaatttactctctcctgcatatgccaaatgcttctgttgcacttgcatggatatgaacataatattgcatgtagctttgcatgcatatgctcttcttgatcactatataaacccatcactgcctctcttcttgctcatctcccaatccactacttcttgctgatcatcatatatctcttgtgagcttcagcaatgggggctctgccaagggctctagtcctcggcgtttgcgccgccgtcttgctggtgaacgtgctcgccgttgccgccgacggcgacgccgcggcggcggcgtccatggtcgtcggattggccaagtgcgccgactgcaccaggaagaacatgaaagctgaggccgttttcaagggtatgttgatatcataaataatcacgcaatatggtccaattaatcattgtcatttatttaaactactacctgaaaaatgcttgttctaagttctcataaatgcaagacgtttttggttgtcctaagtcaattttttttaaattaaaccaaatttatattaaaaatatatatcgcaatatttatgacaccaaattaatttcattaaatctatcattgaatatattcttttatattgtgtatatattttgtgttgaaaatgctgctgcatttttattcttgattttgttcaggtgttcgcgtggcgatcaagtgcaagaacagcaacggcgagtacgagacgaaggccaccggcgaggtcggcaagtctggcgcgttcgccgtgcccctcgcggcggacctcctcggcgacgacggcgagctgaggcagcaatgcttcgcgcagctgcacagcgcggcgtcgaaccagccatgccccgggcaggagccgtcgtggatcgtcaacgccgccgccgacaagaagaagaccttcgtcgccgtcgccggcgacacccacttcccgtcgtcggagtgcgcgtcggcgttcctctgcgacccgttccacaagaaggacttcttcttccactacaagaacccgtcgccgccagcgccggcggcgtaccacaagccgccgccgtcgtacacgcacccggcgccgccggtgtactcctacccgacgccggcgtactctcacccgacgccggtgtacaagcagccgctgccgacgccgtcgccgccgatctaccacccgccggcggaggagaagaaggtggcgatgcaggacgacgcggaggctgaccccgagctgttcaagaagctgctgccattgatcaagaagaatccattcctcaagttccccaagctcccgcctgtggaggtggaggcaaagccatagatggtcgccggcttcgccgcggcgccatgatcgatcgatcgaagcgaggaaacatgagtactagctggtttaattgcttcgtttctttgtgtgtttttcacaccggctactcgagctagttaattactgcccttctagcgttgttgaagcttggtctgttgcctgcctgctagcttaactattcagatataaataaaagcttctgttctctatgatgtgattacatgtttgccggattgaatggatacctagctactagcttagctagcttaattaattttattggatgcatactaaaatcttgcattttttccatacaaatatttacttcctcgtttcatattataagacgctttgattttctttatttttaagtaaagtgtacgaccggtcacttagcttgtatcacgtgtcatctagaacttgtgtcactgtgtcatctagatccccgaactctaaaaatgctaattcaggtcccataacttgctaaagtgtgtcattctggtccaagatggctacggaccattatagcatgctatgtgacactggtgtggcataccacacggatgctgatgtggcatgccacttctgcttgtccaactaaagaagagggaaaaaaagagagagaagaaagggaaagaagagaggaaaatggaaaaaagaaaaaggagaaaaggaaagaaaacttttccaagtgggccccagttgtcagtcaatatagagatattgctggtgccacgtcagcatttgtggggattttggattatttatcactctcttcgatggtgcattctcaaatgccatcattcccattaactttgattatttgccattgtgacctaccaagttgtttctattttaccattttttaactaacaactcagcaaaacgatgagaaaatgaccacattgcccctctcattcatcttccttctaccatcttcctctccgacatggcatgaaccagtctccaacatgggacaagccaagcagtagggacaactattgccatgaatgagctggggcagcaggacgagcaatggatgtgacgatgcttgatggttcgccgttgggtcgtcggggcgaaggcaatacatctcggttgcaggccctctacctcgcataaatcttgtgaacttgagagaagcaacgcaaatggaggtggggcacccgggggggaggtgtcagggttatggataccacatacctaatagtagttgactaaatctcggcatgacccaccacttaccatgtcctatacggaaacaacctgcggatataggaggagttccggataagaaaagacaaccagagttctacatggaaacgataaggactactcggattgtatccatattggtttccctagttctacttggacaaggggacacctatgggtataaatacaaggccccctaaaaggagaggggatacagacgatcaacacacacccaccatagaagacacaaaacaatatatcaagacacaagatcaacatacaagccaacatacgccaagacaagatgccggatatcgatttcagggataagcacggctagtcccctacggtgtctccagatactgtcaggagagacgaaagcgctatctttgatctcgccgggcacgaactcgaggaggaaggctaccctgttgtcaactacgagtcagaccttcagaccgccatatcgacaacagttagatagactaccccaaatattgtactagtgtgattatgatgaataagagcaatgaccggcatcagccaacaggatgtagggttattacctgacaattcaggggcccgaacctgtataaaaatccctatctccatctcttttacctcagtctcgtgtatatcctagtaccaatgatccccataccatgcgaataccggaatcgcgacatcaaacgtcgacaggagggcaggagccagcgtgggtcaagctgtcaagttgtatgctctctcaccagcacgagtatctcgcttgtggtcaaggtggcctcgacatatcctcgctcatcaacgacctcaccgtcaaaaataccggaggcttgtgtcatccatccaactgcaactgtacctgggattcccacgccggagaggaagaagagaagatatgagaggggcagtgaggtcattttctgtttcttttagtatgttggccgtcaaaagtgataaaatagaaacaatttggtgaatcacgatgacaaacaatcaaatttactgggaaagatggatagcatttgagaatgtgccattcaatagagtggcaaatagtccaaaatctcgcatttgtatggcatgtcacatcaacgccacgtagcaagctaaaatggtccatagctatcttggaccagaatgacacacttttgctggaatggtccgaacagagtagaaaattggagagcaaatcgaatcaaaaaaataatatatgacaaaatgatcttgaatggctctcttggcacttaaagagaaatgttcagacttaattttcactcttaagcaaacggccggcgagcaggtgcctgcctttcactggatatttcggattgttgggccgggcattaccgggccaggatttggctagcttcattcgatgggctatagcccagtctaaaatgcctctcgttgagcactgagcccattgggtttgtacatcgctggcactttcgaagcgcgcgcacctgcgccaagagaggatcgatggtgtgcaccgccaacgcggcatctccgacgcgtgtaacgttaatcgcctcccagcatgcttaatgctaatggcaattagcgatagacatatttttaataattaaaaatatttgagttgaaaattttaaatcatgaattgaaagttaaaatttaaatatcagttgaaaatttttgtaatttgagttgaaagttttcaaatttgacttgaatattttcatattcgagttgaaaatgtcgtaatttgaaagttttcaagtttaagctgaaagttttcaaaatcggatatagtatatttaaaaagaataggcaagctttgcctttcgttcgaaattttctttttacaggtaaggaaaaaaatatttacagcatcacggtcgggaatctctgctaggtgtttggctccagccatagcccaagatttcgcctcttcctttatcttcgcgattagggccaccgtggttagctccttgttttggaaaattcgttggtttcgctccttccaaacttcccaagagattatgaggattaagaatcgagtcccatgcttgggtgcttcttgacgtgtttcaagtgattcccaccagtgatgtgttgtggtcaattgcgctcagtttatcagcatgatgggttcacaggcaacccaagtagcaatggcatcccagattttccttgtatatctgcaatccgccagcagatgtagggatgtctcatctgtgcaccggcaaaggggacaaacgccgttgttttgccagcccctgatcgccagccggtccgaggtccagacccaattttagattattagccatgcgaaggttttatacttgcgtgggcccaagctttccaaattaaggtgtcaaagtttgtttttagcgaccccaagaactgcaccttgtaggctaaggatgccgagtattctccatgactcgtgaacttccaggtaatttcatcattctcgtgttgagagttttatatgtaaagttaaaagtttaggatttgagttggaagtttgaaaagttgaacagaaaattttaattttttagttaaaagtatttagagattaaaaatcaagactccacatcttcgtttggtacacttttagcctcacaaaagcctagcgggccacgtgagaaaccagcctatgcttgtgggctcatgcgcgagcgacttctttaagttgcatgtctgtgcgaaaacgactcctctcgccactattttatacgtaaaatctaattcgagagcccctctcgttttagcgctattgcgcgatgctggcagagccgtccgatctccaaccacacgcacacgcaattcctgcttcaaagagagtcacagagagaaaggctacagttttctctcccatgtcatttttctcttcaaacaaagttttctctcaaattatttatccgatctacaatttgattacaccattgtgtttgttataattaaatcttcacaacaagatcttacatgattatattacgatgaaaaaatatttatatttgtaaattacttttattatatacgtaagttacttttatcatatatataagttacttatagatttcactaaattacttcttagacatataaaagtaaattcaataaagtctgcaagtaatttacatatattataaaagtaacttaaaacaaaacgtaagtaactttgtcacgacattagaagtaaattcgttgtagggataaaaatatactttatctagaaattaaatttaatcagcacagatcaacacacgtaagtttaacaatttttaaaagtaacttcaatgttaattggaagtaacttttgcatggttcaagttgaaaggagatgctagatagagtacaaactagctaccactagctgtgtagtcacgtccaatgaaaaaaatgtattaattagagttactttctttttgttataagttacttctataatatatgtaaattacttttaggctttattgaattacttttatatgtctaagaagtaatttagtaaaatctaaaagtaatttagatatattataaaagtaaattattatttttcatcaaaatataatcatgtgagatcttgttataaagatttaattgttatgaatacaacggtgtaatcggatcgtagatcggataagtagtttaagagaaaattgtatttgaagtataggtggatagtgcctcttatagattgagtggtagctggtttagacaaaccagctaccacttgctgtgtagtcacgtcctattttatactccctccgtattttaatgtatgacgctgttgactttttgacaaacgtttgaccttcgtcttattaaaaaaattatataattattatttattttattgtcacttgatttatcatcaagatgacataagtatttttatatttgcataaaaaatttgaataaaacgaatggtcaaacgttgattaaaaagtcaacggcgtcatgaattaaattacggagggagtactaccttgaaaagcaatatgcgtttttgagattaataacgccttctaagaaaaacatcatattcaattcatggaatattgatatgaaatattgcgcatattattatttgatactaactaaatcgaggtaaaatacactgcttaaccaaaaactactctatcggattgcaaaacacattttgggatatacttcgtatatttttttaaggaaactttgaacacaaaatgtatttttaaatacttggtttggctgcttgaatatcatgtgtagatgtctcaaaaggtactttcaatttcataattttatttttagtttttttcaaatattagaataaaaatgcacaaatgtgtaaagtgaatatatacataatgttagtgctatgaaacacatttatagtcattatgatgtatttactacgactccatggtaacacaattacagtgacagaatgacgatattaacgctcaggtgaccactagtccattattcctgtggtattaaattctattattcctgcaagtgcgatgcacaaaaagctgaggacaagaattggtggcctgggaatttttccctcctttttttccacaccagctggccctcggagattattatcactttttccagctggctctccaaagtaaagcggattttttgctgtgtttaaccaatttgttattggcttaatgctaggcttcacttctactttgtgtgttggcaaattggtactggcagattctttttttagtcaccacgtgcaatgtactagtactatatactgagtgaaactctatgcgttgcaacggcaatttaatcatttattatgataatttattatgataacagtaagtatatattgatggtattaatttccaaggtatgatatgatcgattgccctgaaaataacagaaaaataatctatactttatataaagttataatctactaagcctaaaactcgacatacaatcttatcacatcatcaactactagctggtaatagttacatagttaacctcatgcaagcatacaacattatctacaatttatttaattctacaaatcaacatgcaagcatatcccatcatcacccctcacaccatttgcacaatattttaacaaatcaatatattatttttataatatttaatatatttattaatatgttaagaaaatatattaagaattagtaattcccgcgttaaaacgtgagaagcgtagagttcagcacctggtatgcatgcagcatggttggattggcgtgtttgtgtgactcacgtctctcttctgacataactatacattgataaagactagggaatcattagttataaatgattgcgatatggcctctgtcagattgtgtacgtgagcctctcgatcttggatggaagatcaaatgcatgcggggtgttatttattgacatataagaaacgtgcaagttaattaattggattagtggtttctccaagcttaatgatgcatcgaaaatagtttcttttcagaactaaaaatttgtttgttcaactcctctttagttgagatgataacatcagtagtagtagatgagaacaggacatggcagctgacaaatcggatcaaactagatcagactattaagaattggtcacatttaaaaaatatagatttggccagttcattttgttgattctatcaattctgaggctccgttcatttattatgagattcagattctacatcaattttcgttagcacgtttttaaaacagctaaatggtgctaaacaactaaacttcctatatagaaaaattacttcgacaagtaaatccatttttcaagtttatactaattaaaacttaattaatcataagctaatttttttcgtgtgcacttacttcatcataaccatcatccatctcaaacgggacctataatatatattgatcaaatatatggtaaaaaaagaatcatctcctattcagaataaggtaaaaataatgggcatattccttgtgccataagaccatatagagctagtcaaatgtaatatagtgacatgcatgtttggccatttttagggagatatccggttgatgctcttatgctcctactaggggacaactttgtgctccccaccatgaggaactataggctctatatattatgcatcaatccaaaaccgcgaaagaaaatttttgccaaaacagaaagcccctggctcttgcaaccgataatttttttctccaaagccatgaaattccttagcatggataaatgtgtccccttttagttatctcgtggtgtaactcgttttaagaccgctatatttgatacatatcgtactataaaggctatgtttggaaggagtttttactatctactgttttttttcaaaatctttagctccttaaacgatgtttaagatttttactcaaattatgagaatatatggttgtatcacactaaaaagccataaccatggaaacccataatttccaaaatctcattggccacaccccagttattccttgttactagaatttatcagtttccagaacaggaccaaatacagttgtacattccccctggataactacaatccaaacccaaaaagaaaaaaaaaacaaacaactgtcaccagaaatattaaaaaaataaaaaagtactagctcatattcatggtcaacgagtcaacggtcgtaatccccctcgccgaagaaaacaatataataataaagaaataaaaaaaaagaaggatcatactccaaagaaggggtactttgcaaccggcccgaatcggacggccaggataacgcccaccctatcttccgggaatctccagagaaaccacggcgaaaacaagaacagcaaacacacgcggccgacgacacggtcaccgcccgtgggccccacctcccctctcccctctctcttctccactcgactcgactcgacgacccacctctccaccaactcgcaactccaccaagcaaaccaaaaaccccaaatcccccaccccgaattcggaattcccccccaaatccctcgccgcccgccgattcagccccgcggagacgcgattctcgaaggaattctggttcccggaggcggagcaggcggagaatcgtttggtttttcttttgggatgggggagggggtgaaggcgatgctggcgcggccgatccagctggccgacgaggtcgccaagcagtgcggcgcggcgcggtgcttccgcgcggagtgcggcgagctcaaggcgcgggcggacaagctcgcggcgttgctccgacaggcggcgcgcgccgacctgtacgaccgccccgccgcgcgcatcatggccggggcgcagcaggcgctcctcaaggcctcctccctcgccgcgcgctgcgccagcggccacccgcgcctcaggcggctcttcacgctcagccccgccgcggggttcccccgcaccgtcgccctcctcgacaccgcgctcgaggacgtcgcgtggctgctgcgcatctcctcgcctcgctccggtggtggtggtggtggtggtggtggcggcggcgacgacgacggggacggcgacgacggcgacctgagggggctccccaacatcgcgcagaacgagcccatactgttcctcatctgggaccacgtcgcgcgcctccacaccggcgggctcgccgcgcgcgccgactccgccgccaacctcgcctccctcgcccgcgacagccagcacttcgccaagctcatcatcgaggaggacggcgtgccgccgctgcttaggctgctcaaggaaggcaccgacgacggccaggaggccgccgcccgcgcgctcggcttgctcggctgcgacgacgagagcatcgataagctcgtccaggccggggtgtgctccgtcttcgccgcggcgctcaaggatccacccatgcgcgtgcaggctgccgttgccgatgccattggtactctcgctgaccggagcgctacgtgccaggagctctttgcgcagaacaacgccgtccgctatctcgtcggtcacctcgcctcagggaccatccaggagcacagcaggtactccgtcggctccagcagctccaagaacagcgctgctgcacctcagcacatgacgtcgctgcactctgtcgtgcttgccaagacgctcagcatgcgccacggtggtgaccgtggcacctcctcctccaccgatgagcccccaagggtgtccaatgagcaagacacgaaaaggaatcagatgcagtcggtcgtgcaatccgcgatggctgctaagactaagacgaatgggtcgttggttccacccttcaggccacagctgggcacgagtggttctagtggccgtggtgctgtccgggaggtggaggatccggagaccaaggcacggctaaaggccatggcagcgagagctctgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57966 - DNA, 4294 bp, Oryza sativa
tttcggaggctgagcgtcttgctgccggggtccggagctgtagtgccactcagattttctgctgatggcccgatgcgcatgcgccctagcaggctagcagccattcctgatgggccaatatcgtgccatgggccatcgggccatcatcgtgcctacgggccattcgcgtgccgtgccagcccaagtacggcctagcccatttacgggccgtgtcagaccgtgctttctagcatgtcgggccgtcgtgccttaggccggcctgataaagcacaacccaagtcccagctcccctcgcctgcacgccgccgtcgccgaggcccggagcggtggcgtcgaatgggaggagcgggtggcggcggagctcctcggcaaggaggtgtcggtggaggtagggatggcaatgggtcgggtcgggcacgggtagagcaaaaccatgcccgacctgatgcctaatattgcctgtccaaaccctacccactagagttagcgtgcaaaactccgtgcccgtacccatgcccggtgggcgcgggtatgtccggcgggtacccaatggatctcatataaataataacttaaaatatatataatttaagaaagaaaaataaaatcaataatttacgaaattattggttaccaacaataatttgaattacatcacaacttagtatcagttagcattacaaatgaaccaatagaaagggtataagaattaagaaatgagtcaaaattagctaatacatatgtatcgggtcgggcatgggttacccatgggtaaaaaatgaaacccgcctgttgcccatgacgtcttcgggtatcgggtgggcgtacccatgggtaaaaagtcacactcacacccatgcccatcgggtcgggtatctgtggatacctggacccatgggtaaaattgtcatccctaggtggaggaggcggataacctctttgaatttgctcgatgcgggatgcggcgaggcccaagaagagcgtagcggaggagaagtcgaagggggagaggaccgggtaagaggcgaaggtgttgagtagggaggagggatcgagggcagagaggaggtggtcggggatggcaacgataggtcagggacgacggagtggaggaggaggtgttggcgatgaggtccatggaggtcggcgagaggagtagcccgtcgttggcacggccatggcccgcgcagtggttggcacatgtcatgtggacctacatggcggtggatcccacaattttttttgtgtgaatgacaaataggacccatatatttttttaattctaatgctacataagtgacacgtcaacaccacgttgtataaagaccagttcaacaccgtcacgtaggcgccacatcagcgaaatcgctctgcaaaaccgtcaagagagctaaattgcaccggttttaatagttagagggttatgatatccggtgttgtagttcagggatatgaattagactcatccactagttaagggagtcaaattggacttaatccaaaagagaacggcccatgaaacaccaaacggaaacagcacgctcggatctctttcccttcccttcccccgccacgcggccacgccaacccaaccaataagctgtctcccgtggcacatctccccaatcgcatcacgccacgtcacccctctgacgcgcgcgaccccttctccttctccccagttgcgcccccgcttctataacacgcgcctccgccttcctccccgcggcaccgatctccctcccccctcgccggcggcgcaccgaccgaaccgaaccgcgccatggtcaccgcgcgcaagggccgcggaggcagaggccctccccgcccccgcgtcgtcgacggcggcggagggagcatggtgtcgcgcgtggccgtgctcgcattctgcgtcgccgggatctggtcggcgtacatcacccagggcgtcctccaggaaaccctgtaagcgcccgcctccctccctccctccctctctctctctctctctctaatggtgctcgggagcggaggggaattgggctctgcttcggcgagtttctgaaaattgttcgccgttttctctccccgccgttcgttcaggtcgacgaagcggttcgggccggaggcgcggcggttcgaccacctcgcgttcctcaacttcgcgcagaacgtcgtctgcttcgtctggtccttcataagtgagcctcctctcctccctctctcatcccctgcccctgtcgtgtggaatccagtgcggtcgcatcgcatgccattgcgcagaatgcggatcgtgtgaggagtttgtgacactggttttgctcgcgcagtgatcaagctgtggtcgagtggtgggagctcctccgctggccgcgcgccgctgcggaagtactggggcgtcagcatcaccaacactgtcggcccggccatggggatcgaggcgctcaagttcatcagctacccagctcaggtttggttgcagctgcccttttgtcgtctcgcttcgcttgctttgttgctctatgcatttttgtgcagctattgtatctgtaattagatgtttccattttcgttatgggtgataggcaacgcagtagtataatgcctgcgaagtggaatgttctatttttggattgttcaactgtgctaagtaaatcagtggttggaatgttctatagccttatttttgccttgattgatgcgatagatacggtcatttggagaatttatgatgtgtgagtgattattggagaagaaaattaagtttggttgagtgaaattacgaattcagactctctggttctgatatacttggagttttgaatttggttcggtctgaccaagtcagacggcttatgggctgattcagaaatatctgaacatataaacaatgtttagatcatttgtttattagcaatttttatacgtagaaaacatttatgccatgagtattatgcacaaatgccaaaatatgattatccatgatactcttatcgctgtatcgcatggatgggtgaagacagaaccatatttcctcatcaaactttttgattgaactttgaaccatccaatgtacagttatacatcaaaatgtgtttggctcaagcgcaatgtaatttgatttatcttttgaacttattggaacagtcgcaacaagcctgtgttttctgaatatcatttttgtgtctcatttttgtgccgtaataatatatgctgatttgattaaatagcacattaccgctaaggaattatttgctctatgttaacaggtcctggcaaaatcttctaagatgattccaggtgagttgcattgatctatgcatgctatgtaatgtaccttacagaacattatctacatctgaatagttcttctgatcattaatttgagcttgggtgggtatactcatctgagcagtttctgtgtaaaaaaaaaagtacactggaaaattggattttggtttggcaccacaatattggctgctttagctgttagtacgacaatacttgcattttttttgtcaaaaccatatcaatttcatgacaagagcatttccattagtgctgatatttggtggtcagagtggtgtaggtaatagagcaatcagtgttaagaataacttttaacagtagccctttcatgtttcatagtctgtatagtgatgtgcgcatatctctgaccaatgatttaatatgtacagtaatgctgatgggaactatactgtatggtgtcaagtacacatttccggagtacatttgcacctttcttgttgctgggggtgtatcatcctttgcgttgttgaaggtaaagatttaatctatttcaattattcaccaatatcccacgagcctaaagcaaaagcagaaacattttggcactgtttcactccgtagtatgaaagtagaaaagaatatgttttgttccttacagtcatttgtattatgatgaatacaaattagaagagaaaacagccacatcaaagtcactataactaggaatctgcacctctaatgttattagaagctgtagatggcctaataaaattttatgtgtgatgtgctgatgttaactgtgttttcatttctgagtattatgtttgtttcctatgtatcagacaagctccaagactatcaagaagcttgctaaccctaatgcgcctctgggctacacattgtgcttcctcaacttagcttttgatggttacaccaattcgacccaagatttgataaagtctaggtaactacaccctgtccattccatattaaagcattctggaaattttatcatcttcttatctacatggaaagtaatgtcgtg

SEQ ID NO: 57967 - DNA, 22890 bp, Oryza sativa
  unsure (1)..(22890): unsure at all n locations
aaatcaacacatcccctataggatcctatgtggcgctgatatgacatgccacatggacgtgacgtgtcatttcttttttttcttaattttctttttcttcgttttcttctcattcttcgtttnttccttcttctgctcgagtcacagagaaaggagaagaaagggaaaaaatagaagaaaaaagaaaaaggaaaaattttaaatgggacccatttttcagtcaaaatgatgccacgtcattccgtgtggcatgccacatcaacgccacgtaggatcctgaaggggttgtggcgatttgggatctagatgacacactataaaaaattctgggacttggatatgcattttaagagtttagaacctatatgacacaccgctacaagtttaaggaccacccgtgcactttactcaagaaaaaaggtcttccaggacgaaattacatgccgatcctctaatttgagtctttcgctccagagggacgcatcttcaatacacagcactaataatcgacgcaaagaggggcttcgtgcctgaagacaacccagtggtggtgattccacgggttccaaaagcattgcaagtagaatacccaaaaagtgcttggagggaactcgaatcggtgtgggaagagaagcaagctcagctaacgtcgcgtcattaacctgcatattcagcgtgccccagaaggccacagcaaaggggcactggaagcagaggtgaagagctgtttcatcggcagaattgcaaagatcacaggttggggtcggcactatggttttcctgtgcaagttgcgttttgttgggaggcgatccttagccaaaagccaggcaaaaaagaaagggttcaaaggagcttcggatttatcatcagcaagagcaattaatattcagccatttccatttccaaaccatataaattgaggtagcccttgctagtatcagttgctttgcaaagctgctctgatcagaaatcccaatggcaatggagaagagccctcctccggcgccgcacttcctcttcgtggtgagcgggatacagggccacatcaacccggcgcgccgcctcgccgcgcgcctgatggcgtcggcgccggccgcgcgcgtcaccttctccaccgccgtctccgcgcaccgcctcatgttcccgtccctgccgtccccggccggcgaggacgtcgacgacaccggcgtcgcgtacgtcccgcactccgacggctacgacgacgggtacaagcccggggtgcacgcgagggacgactacatggcgcgcacccgcgccgcgggcaccgagtcgctctccgccatcgtcgcggctctcgcggcgagggggcgcccggtgacgtgcatcgtgtacacgttcctcgtggtttgggcccccgccgtggcgcgcgcgctggggatcccctcggcgatctactggatccagccggcggcggcgttcgccgtgtactaccactacttccatggccatggcgaggccctcgcctcctgcgcgaacgaccctgcccgcggcgccgtcgtgcgcctccccgggatgccgttcctcaggtccgacgagctcccctccgccgtgtccatcgtctcgccggagcacaagcactacctgctgctcgccatgctgcgcgacctgttcgaggatctcgacgagctcaagcccagggtgctggtgaacacgttcgacgcgctggagcccgacgcgctccgcgccgtgcccgatctggaggtcgtcgccgtcgggccggtggtgcccgacggcgaagcgtctctgtcgagctcgagcacggacatgttccggcgagacgacgcgagcgcgtgcgtggattggctggacacgaagccggcgcgctccgtggtgtacgtctcgttcgggaccctcctgtcgatgagcaagcggcaggaggaggagatgaggcgcggccttgaggccaccggccggccgtacctgtgggtggcgcgccaggcgccgtcgatggcggcgcgaccttggacagcgcacccacccccgccgccgatgccggcggcggcggcggcgaaggggacgcgcaagggatggtggtggagtggtgcgaccagatgaaggtgctctcgcacccggctgtgggctgcttcgtgacgcactgcgggtggaactcggcgctggagagcatcacccgcggcgtgccgatggtggccgtgccgcagtggacggaccagccgacggtggcgtggctggtcgaggcgcgcatgggcgccggcgtgcgcgcgcggctggacggcgagggcgtggtcgagcgcggcgagctgcagcggtgcgtggagctcgccatggcgggcggcggagacggcggtgtccgggcacgggcggagcgatggagggagcgcgccgcggaggcggtcgcggccggcgggtcgtcggagaggaatctccgggcgttcgcgtccggggccgtgacgcaggcggtgtgctcgagcaggtgattccgccggcggccgccggcgatggcgaactcaacggctggattattgttgtttttttatattcccagataatagctttgtcatttggtgtggcgttgacgcaatcagtatgttgattagtcgacgtaacagcaaatttaattggagatctcattaaattttagatgttgccatatcatctacaaacagttcaataaagggagcaaaatttccctcttcgatctatccatgtggccatgtgcaacctccagattacgaggccttcacagtgcaagcacccaccaggatgacacataggataaaaagctacaaggaaactttctctacagggcaagcaccggtgtgggacccacagatactacttcaccgaatcccccacctccctcagtcaccacgcccctcaccctcttccaactccaccggctgtcccctcctctcctcgacgacactgcatttcccctctccccgccggcggcttctcctttctccccgccggtggcctctcctctcccctctccccgccggcggcttctcccttctccccgccggtggcctctcctctcccctctcctcacggcggcggcagcgaagtaggctggggacgcggcgaaggaggttggggacgcggcggtggatccagaaggctgagacgatggtgcttgcggccagcggttcctcccacgccgtcgcacctcctcgcctcccatgctgcggcggcacgtcggggatgccgccgtcgtgcgcctcgcctcgccgtcgaccgcgccgcccgatttgttgccgcttttgttgccgcgatttgtgtagattagttgccggcgcaagggcacgggaggcgcgagggcacgagctccacagtgcggaaaagcagccgctaccgggcctcgcgagagaaggtaccgcgtgcctcagtttgggtgcgaggtgctcaccatgggcgcacgccctagctccacgcaagcccaattcctacgtggctgcccatagcaccggtccagcatggagcactgtgagaggcctttaagccgccaatttgaatattcctttcatcccttgtctcaaatctgagggcagtaccagtgcaagcaacgcataacgtggctttagctcatccgtacagtgaaatcagtccaaagtcatctgtacagcaacgcataagccatgcagtccacaacgctcgtgatctctttttgatggctagaatatctgccgcacgcgaggcgaaggaaacatatgcgggggcacgctctcagtaacgcggacgcgtgagacgtctcctgcgccgcgcgtccttgcctgcaggcgaaggaactcgcttcccaactaaggcccgagcatctgagcagaggcacgcgttttgtcaacgtgtagatgattatccgagctggaaatctgaaggaactggccacgtcctcccactgtgaagggcctgacattgttttattgtcacaagtgagtatcgctcgaaagccactgtgcagatggattttgataaaatatcactttttaacgtgtggctagacgttataatactactccatttagaactgtatggtgacgacgaactcatcctcgtggcctgccacggtgacggttgcgggcctttcgtcgtcgcatcccacgtatatatatcacgggtgcctgctccatcctcctgttgcgggcgcccacgcggtcgctgcctgtccccacgcggtcatggcgcaacacggctcccacctcctcaccgacagctagtccagccacgtctacaccatcgcgctcctgtcccgtggcgacatctcacttcttgttataaaatcagccccgaaatcgacattggtagctaaacgcggaagaaaatactataggagattcaaaacgatgacgacaccgagacacgatatttggtaacggagttcagccgtagcctacatctccggagcactgattacgggcgctcctccccgatccagcatatacagcgtatcatagttacaatgactcacggccggtcgatgccggcagccgctccctctcgctatactaagtctccatgcggttacaataggcacgcccctctatttatgagggatcctaggatagagtccgactcatactctagtcctaatatcttttacaactccaagtcctaaactttaaccgactacgtacacatattcgacgcaaactctaacaaactctaccttggcgaatatgccacaccaacttgaatctgttacttgctcgaacctccgtgtaccaggacttgagttggttctgccgcagctcacaccgagccgctcgactagcctacgccaggcttgccgccttcaggatcgtgcacaacaacaccagcatacccatcttccatgactccacctgcaacagcactcccttgtaacttgtacaaacatgaacttgtcctctcaccagtcataacagtcttgcgtccttcatgatattcatggtcttcctattagaatccacctgatacaaccaacccgtctcatgtaggctcccaagcgaaatcaaactcttccttagtcccggcacgtgtctcacatttgaaagtagcacctcgtttccatcatacatcttgaacttgacatcgcccactccaacaacacgataactcgtgtcatcgcctaagtaaacaacaccaaaatcaccagatttgtatgaagagaaccactcccgcttcgatgtcacatgataggaactagctaagtccaacatccacgcttctccagacttctcgttagacactgtgagaatctcatgactgctgctatctgaatcatcaccacgagctgctaaacttgcaatgccacctttcctcttcttcagtaacaggcaattcctccttatatgtccaaactcatgacacttatagcaccgtgccctcttctccttgctctttgacacccccgcttcatgatcatgctttgccctgaccagcaaactctcagcctgagaagcctccattgcctcgtttttctttgatcttctcaagtctcgtgcaagcaacgacgaaattatctcatcagttttgacagtatccttgccgtgcgtcagggtagtcaccacatgttcataagacggtggaagcgagcacagaagaattatggccttgtcttcatcatccagtttcacatctaacttacttagatccacaaccaactgattgaagacgtccacgtgcttcctaagatctgactcctcttgcatctgtaaaccatatagctgttgtttgagatacaacttactcatcagcgacttggacatatacaggcttgccaacttgtcccaaatttccttcagtgatttttcatccatgacctgatacatgacagaatccgagagactcaagcgtattgttgcagctgcctgcgccttcatctcctcccacttgccagcatccatcttttccggcatcgtctcctcaagagccttggatatcccctgttgagccaacagatccttcagcctcatctgccagagaacgaaattcccggtgccatcgaacttcaccacctcaaatttggaaaccaccgtcgccgccatcaacgataatcaactcaacagctgttgccctgttaaattgatctgccctgattaattgatcccaccgactaactcgaatagtaccagctggaccgaaccagttttttttctctctccaaaaaaccggaccggtttcttttacttggtcaaccaccagtcaaagaaaaacagatcgaccctgttccccttcttcctttggcttcctcgctcctcctagaaaccgtgcccacgccactttttcccgatgcgccgccgcctcctgctcctcacgccgtcggccctgcaagaagcactgcgccgcccgcctcagaaaccgcctggggcgccgccgcctcccgccgccgtcacttgcgccgaccctgcgaggagccgccgcgtcgcctgccttgggaagccgccggcctaccacctaggagcgcccgccaccgaagtccggcgccggttcctcgccgggaaccgccgccgccgccgccgcaagctcctgcccgagctgcgacgaacgccgccgagtaccacgccgccgtgcgccgcctgcaatgatgcgtctccagccgcccgtgacctcgccgcccaaaccacctttgcctctgcgaaaatcgggtacgaatctcgccctctgctagatgatttgtttcgactgcgttgttacaatcccgtggtccctttgctgcttttattggggaaaaacgtgtccgatttccagtctaaatcgaatccgtatccaactccctcctgtgtcgaacgcggtatccatccagcttgtcttcggtcgtgtccatgccgtgaccgacacatagataactccatggccgagtcttcctctacatcacgaatccgacaaccaccgaaccttgcacgtcctggctcagcccgctccttctcggcatcaccctgatctccgccgccagctcggcttcgacgcaaaacgcgcacaccgccgcgaccctgacctcctgggcttcttcgtatctccagcggaacctagcaccactgccaaacaccacttgccgactacaccaatgactagtgccactgatctgttgtcatcgtgattttcttgatctgtgctagaaacagtagaaccagacctctctagggttggaactagcacatatgctagtctagacgccctacgcttagttctgccatccaccgctaatacgccgcttttgaagcaattccagtgtggaaatacctgtcaacacctccaaaacagcctataggatccacccgctccgacatccgattgaacgccatcaatctagtcgcgagccgaagccgacaagtcgcatgccgtcttcccagccgccgaacgacccgagcgctacgtctagccatctccctgtcgaacgcaactcttcgaaaggcccgggccaccccgcccagagtgttcgaatccaccgatcgagaacgccgatcgcctccagcttcaatcaacccgagcgtgcggccgcacgtctccctgtcgagagtagctcaccggaaagtccgagccacccgcccgaagtgtccgacccatcgattggatcgccaatcgcttctgccgccatcaacccgagcaccacgtctagtcatctccttgttgaaggcagccatcgacggttccggccgccgccagaagtgttcgatccaccgatcaagactccgttgatcgccgccgtgctccaccttgcgccaatgcccctccctgggcattacagcaggctacgcggtgtggagcacctccatcgcgcctctaccatggacctcccgcaggctctgataccacttgttataaaaccagccccgaaatcgacatcggtagctaaacgcggaagaaaatgccataggagatccaaaacgatgacgacaccgagacacgatatttggtaacggagttcagccgtggcctacatcttcggggcactgattacgggcgctcctccccgatccagcatatacagcgtatcagagttacaacgacttacggccggtcgatgccgacaaccgctccctctctttatgctaagtcaccatgcggttataacaggcacgctcctctatctatgagggatcctaggatagagtccgactcatactctagtcctaataccttttacaactccaagtcctaaactgtaaccgactacgtacacatattcgatataaactctaacacttcttccgcgcccacaagcagcaggagaggcacgtggcggcacaccaccgtcgtggttggggagcatgagcaacagcaggatggagggatgagcagacaacggtggcctctttcgactcccacatcgccgcgacattcttgagccttggcgcggcagtcaggctcctccaactccgacacagcgaccggcatgccccaagtccccaactccgaggcaacttaaaggaggaaggtgaggaggcgggacggtcagtggcttgccgatggtatttatagagggaaatatgacattggagttgggagagaagatggggaaggaggctaaagcaatttgatcatgtatagtattctagcttgtagctatgagtaacgagttaagagtggtatttttttaatgatcatttataatacttttctttgtttttcatttataaaatttgaggtaccaaatacacttgaatattacgtttttcctatgctgtgtttcaaaaaatcataagctccaaactaactcttatactactattaattatacacttgctaggccggcaacacgataccgatgtttatagtgataagctaggccatgagctgaactgaaaacgacctatatcgatctgtggatacaggatagaaacagtaggaaagagtcaggccggtcaggtagataatcacagctatatatatgccggcctgcggctcatgttaaaatcttatctcgacggcattgcctccaagcaattaagttcaatctgccaggagacagcgatctccggccgtcgcctagtaagccaggtagaaaaaaattcactacttcaaattcactacttcattcaggagttaagaaaaaatgttactccagctaggatctgcattaggttacttctccctctctctccgaaataactttattttgtaccatcttatttatcctaaattaactcatctttcaaaagcaattatattggactagataaaatgggatacaattatattggatttgataaaatagagggtattctatttttttcacttatattggtatgtgtggtctgggtagaaaataaataaagttattttgtaaaagaaaaaattgtgtcacaatgtgaaaaagagaaggtgccgtgaattcgacaccatggatcaactattgaacaaggtaagtgtcacgtcgactcaacctccacgagatcaagatacatacgtattcaccatttgtccatagatgacagcttgcgtggtggagtaatatggttgtttgtatgcatctcaaaacttatggatcaggagttcaggaccattcccgtcataaaaaaaaaagcacagaaattattcgcatacgcttaattccttttatactcttactactacgatagggttgtcgtaggcggccaaaacacgttttaacaggtgaccgatcatgtcatctgtgactaaagacatgtaaaaataaaggcatgggcccgatcgcctgtaaaaaaaaaagcatttatatattgcaatgcttttatatgtaatagtgacttggatatataccgtctgtacaatgcttttgtagtcataatacaatttacaaattaacactatacaacacaacaaagttcattcttgtttggcatggccaaactcctggattaattcttgcaggcttgcagaaattagagtttgtagattgaattaaaatggttcaatcttttatttgatctaagatatgaattaaatgtcacattttaataactctactctagcagcagccccaactccatgaatttctagagctagaaaaacttttgaccatggatttatcagaaaacatacttttcatgacagcagtactaatgctgtgtaaaagcacactgtaaatctattggtataatatttatacaactaacaatgttcaagctatgcgttggagattattgagtcaacaacacgatcaagtcttgaaaacagccactctttaacttccatgagtcctacaataatgtatggagcatgcgaccttatggactgaacgaaccaagtatacaatatatgttttatgttgtctgcatagaaacttttagaatatttagaggattcaattttctaatttttttttctatagacccctttagttcatatagaaattgtaaatattccatagaattgcatttctacggactaattccacaggattacattccaaaaaaaaagcaagagataagaccttttgattttttttagaaaaaaaattatcctgtggtgtagttaatttcttctcttctcatttccggtgtttttggttactatagacttttttaaaaaatacaactttaattcttgtgtgttttttctatcctacctttcaagggcgataattttgcaataggcacattataatttcttagaaagctccccctcgctccctcgtgcccacacccacactaataatcaataaaatgaaaaaatgtataaatatacttgttatctgactaattcatcattaaaatctacaaaggtggaaatttaaaattaaaatacatcttataattgacacaaattgttttcaaatgtcacttctggcacttcccaaccacgaaagtcatcagattatgatccgacgagtagggatgggcagaaaaagaccgaaccaaaagaccgaactgaaaagaccgagaccgagaccgaaaagatcgagaccgagaaattcggtcatcaattcggtcctaggcagtgaaagaccgaattttgttcggtcaattcggttagtatcctcggttaaccgaatatatcgaaaagacagaattatcaaaaaaacgtctaaatgcaacctacaatccactatgtttaataggattaaactctaattttcacatccctacttcttctaggcatgcaacctaacaagagtctttactcataagtgcttacgaaatttttttgtgatttttgtgttgaaactttccattatttctttgcatatatgaaaatgttgttgaatttcggtcaggactgagactgagaccgagaccgaatttgtcggtcctaacatttttgcgctgaaattcggtcttcacttttcaaagaccgaaaagaccgaaagaccgaagaccgagactaaaattttcggttagaccgaatgcccaccctgttgatgggtgatacccgtagaccgaatatagagggtattggggtacgttggtataagggttcacataatacgacatcaagcaaacaaaagacgaagattatactggttcaggccccttgataggtaatagccctaatccagttgatgtgggattatatgatggaaaacacaggttacaaagggaacaatggaactcgatggatccggcgagatcgtagtcgagttggttcgactagatcctcgacgatttggctcctgcaggcttcgacttcgtaggctgtgggggttgtgttggctctaagattcgatgccttatgtcctccccaggggggtcccttttatatcgcaggtcaggcggtttccaagtagaactcggagacatcagaccctacacgatacattgacgacccagtcttgtccgagtaggactcttttcgtccgtaaactccgtgaaggatttccttagtgtatgtagagagtatccgtatgcgcgtgggcatgccataccgatatgtgacgtatatcaaagggtaaagggtatacctaacccgtaaccctgacagtagcccccgacttctgcttaaatgaactcgtgtaaccattcgcgacttctcgtgtcgaggctattgttgttcccggtgcgagaaccgtggagacaggacgtaatcgagaacaccatgtgaagcccaacggtcacgagtgaatttaaactgaagtccaaaatactgccgcgcgtaacggacccagaaatttccggcggctatctctctcctttccttggaattcgcaccgtcggtagtgcgtctatttaaaggaattttgggggatccattttgaagcccgcctattgtgaagaaaacctcccgcctgcaagcgttcttcgtcttccccgctcccacaagaaaccctagttcgtcgacctcagccctttctccggcgatctccgatcggcgatggatctcggcaaatcatcctccactagcgtgtcgctgaagaagcttcaggaggacggcgcccttccgggtcgtggaaccatggaaagggaagcaggaggtactgaaccccagcccatcttaggtcgcatggttgtgatcgaggactacattctctgcggttttctccctccaccttctgaatttcttctcttggttttaaacttctatggtctttctttgctccatctgaaccccaattctatagccttagtatttttcacatctttgtgaagcctacattggggtagagccctttctcgatctcttccgcttctactacgagttgcgttggatggaatccaacagggtatctggatgcgttggattccgacttcgggatggcctaaaatcgcgttatatccccttccagtgtccctcctctcgcagcaaatggcagacgaggtgttctatcttcagatagaagattcggatcctgtcttcgttgttcctgaggaacaaccagacaagatttcgtcttggaccgcaaaaccccctttgaccccttctcttcagtcgttcatcgatgtggtcgacgatctccgagtgcgtggtttgtcggggtatgaagtcgctgttgacttcattagtagacgaatccagccactccaggctcaagcccacctagcctttgactattctggaccggaggatgcgacccgggtttctcctcggggtatctttctcgcatttatcctgatatgcttgtgtgcgcgctcctcctggctcatcgaaatttggttctcgattcacaggtctgagcaacgaagccgtgggacgtcgtgtcggccaggtgatgatcagtggcccggcgacggcgagtaatgttcccgttcccctttgcgagaagggggcggccgaacgcgatgccgccatcaatgtaagtgtactcagtagtcattctgcgtttttcttctgagatcgctttgtgactttataaagcgtaggctcttcctctgactgacatcatcgggccgctcgcggaccatcaggtggtggcatcattgaaagagaaggtcgccaaggaggcgtctgatgctgctgctgctgctaccacaagtggtggcaatgttccagcaaaggggaggaagttctcctctgtaagcggacatcgtcgcaaggcatcagccccctcggtaagctatcttgttgtctgatcaaacagccagaacaatttcgccttacttcgcatcaactgttctccaggcctcggacgcgtctcccccacctccacgtcaacagcgacttgtgacacttggcgagaagtaagtgggtgaatttaagttttcgtgattttgtccgagcgttgtctgaaccatagctgtctcatagggcggcgcgggcgaaggcggtgcaggatgagtctggagggacttccggtgcgtctcccgctgtagcctcgacggatgtcgtgcttgcgcccgggagccgcgaggtgacaccaagcggcccagccagcgatcccgcggctggtcgtggtccaccggctgtcgtcctcacctgggaggagctccaggtcgaaatgtggtgtctcctcgaagctggtgctcgcggcattggtcgcgagattgcggaggcaaggtcggcggcagcgtcggcaaacgagcgtgccgaccggctggcatacgagttggcggaagctcgtgaagacctcaagaagatgagggagttggtggctggcaacgagcgacaatggcaggggctcgagcaccgcatgtcaaagctcgggaacaatttgtcggaaatccgtggctcgttgcgggtcacctatactggtctgcaccagctcgccgggtagtgcggcatcaagtctaccatcccggcgaatcccgatgagttctcgctgacatcttctctagcggagctcgcggcggcgatggaggagattccctccaagcatgcggccaggatcggagaggagacgtccaacgggatctacaccgaggcgtgccatgtccttgcgtgtgtgaggctggcgcatcctaaactcgatctgcgcgagatcttggatcagggggcggctagcggcacgcgtaaggaggtgatggaagaagtcggcgacctgggggaatctgttctccccctttttgaagagtaggatctcttgtactccttagatgtgctatgtaaaacttcgatgggtttcgatcgcctttgtgcgtgtagtcattaccctagctttctcttgcattttgatcttgagtactttttgtcccttgtagagatgttgatgacgaggatgtccagcagcgtgggcagcctgagtcattggcgatcattccggctcttgcgtttgaaccacatgcgtcgccggacaatgtagaccagatcctacccacggggatagagatggcgacgacttccttaggttagtggtccctttatccctttttgctcctccgattagatcagtcgtgttcttgaaagagaagtgaagcttgacttagttattcccacattgagcatatctcgagagtgctcttgctgggcaagatcgtcgtatccaatattggaagacgaaatttgaagtagcggaacttgagagaacaatgctagcagtaaagaaggagcaagctgtggaaacgctccgaggtcgtgaggtgtggttcaactcgtacttgaagagttgctgcacgtccatggccaaggtctgtagagagctccgagtacctcgtggggatcccgaggagtcggcggccagatacatctcgtggctgaacggggcctatgcttagctcgagggcgtcggcaagcgcattgacgaagccttgaagtaggagtgtcgtcgatcgagccgatatgccggggggcacgtgttggcctgcctatgagatcatcgcccgcgactggacatcgattttctccatgaaggttttgctcgttctcggaggactctggcagagatagaccacctggtgaagtcgatggcgccattggcggagaaggtcttctaatctgtggactggcgttggccttcctggtagcctttgtaccctgtgatagatatcttaggggaaagtgtaatatagccttagacttgtgtaagaattgtaaggagtattttgtgaaatagaaaagaaatctatctttagaaaatatttcttactccggatatcgtgtgtaagagtgtgtcctcagttcacgactttagtcggttgtttgagtcgtacactctccctagcccccagccttgtcaccggaggagttttctcagaggataaggctcttggacctttgacctgccttggttgaataagcactgatcctagcccccagccgtgaagttggaaagttaatttccgattacacgacttggttaatacgcacggcgagaactcttacacgaccaggtcttacatggtctttcgtctctacaggatctgacaaggccttatcggctctgggcgtccccagccgaagatcccttaggttcctcggaggccttgtcaagacggcgtaaagggacatgaggatagatttcaacgttaggtgtcatctgggtaagggatcatcggacaggaacactttgattgtaatatggtcctaagaataggctttattgatgctgtaaggtgtcttacaggtatggatgacattgactcatacatagaatttacgtagttggtcaatgttccaagaatttgccaactcgcgaccatcaccgtctgcaattttaaatgcgcctggtcgcaagacttgtgtgatcgtgtaagatccttcccatttgggtgagagcttgtttcgccctgcttggctttgaacccgtcggaggaagtagtcgccgatcgtaagcatgcgtgctcggatgcgcttctcgtggtaacggcggagggcctgttggtaattggctgctcggacggcaactcgttcgcgatgttcctcgagtagattcacatcgacgtttcactactcctcctgatcctcgtcggaatacttctgtactcgtgtactctgatgtcatagctcgctagggagcatggcctcggaaccgtacatgaggaagaagggtgtttccttgttagatgttgtcggtgtggtgcgtacggcccatagtactgatgggagttcttcgacccattttttgtcgtgtgacatgagcctgtcgtagacgcgggttttgatcccttgtagtactatgccgtttgccctctcgacttgtccgttgctttgagggtgagagatcgaggcgaagcatatcttgattcccagcccgatgcagtaatcctggaaatcggtgctgatgaactgggagccgttgtcggttatgatgcggtgcgatagtccgtatctgcaaaatatccccttgatgaatttgatggcgttgtcggccttgatttcccccgtgggtactgcttcgatctacttagtgaatttgtcgatcgccacgaataggaacctgtaaccgccctgtcctcgtgggaatggcccgagtatatctagcgcccagcacgagaatggccaagtaagagggatagtctggagcacttgcgcgggtagctttgtgtgtttactgtggaattgacaggcttcacatcgctggaccatgtcgcatgcatctttgagggcgattggccagaaaaacccttgtcgaaaagctttcccgaccaatgtccgaccggcggcatgtgacccatagatgccttcatgtatatcaaggaagaggtgtctgccgtcgtcggacgagacgcatttgagaagtaccccgtttggcgcttttttgtatagatcgttgctgaccacactttagatttttgctttacgggttattttctcggcctctgtatcgtcctcgggcaactcctcgctgttgatgaatttcataagtgggatgtgccagtcatctgtgatctcgatatcggcaacggcgcgttctgcctttgtggcctccgcgccaatgtctggggcggccgggctaacttcgccgctaacctcttttactgatggcttcgtcaggatgtccagaaaagtgtcgggctcgagcagttctcgtctaggcgcacgtcatgctaggtcatctggctcgatgttgtccttgcggtaaacgtgtcgaaccttgatcccatcgaaccttttctctagtttcctgacttctgcgagatacttggataactcggggttagagcatttataatctttgtgcacctgattcacgactagctcggagtctccttttacgattagtcgtttgaccccaagtgcggctgcagctcttatcccggcgagtaatccctcgtattcggctgtgttattggtcgccctgaagttgaggtggattgcgtgcttgaattgatctccggaaggagacgtcaagataaaccctgcccctgctccttggctgttgagtgcaccattgaacgccattgtccacgtttcgttgtcgacttggttgtctgatttgtcatcaggcatagtccaatcggctacgaagtcggcgagtacctgggacttgatggctgttcgtggtataaagtggacatcaaactggctcagctcgactacccatttcgcaatgcggccgacaacgtttttgtttctcacaacttcaccgagcgggaaggaggagccaactgtgactctgtgggcttgaaagtagtggcgtagcttccttgatgtcatgatgaccacgtaaagcagcttttggatctgtggatatcttgtctttgcgtcgtggagagcttcgctgacgtaatagactggtcgttgtactttctctctctcgacaacaatgacggtgctaacggaatatggcgtggcggcaatatagaggaataattcatcattaggttggggagcaacaagtacaggggggtttgataggtagcgcttgagtgcaatgaatgcctcttcggcttcctgtgtccatacaaatttgtcttgtttcttcagcagagcgaagaagggttgccctcgttctcccatcctagcgacgaacctgttcagtgctgccatgcatccggttagcttttgtatttccttgagtcttgtgggcgacttcatgttctcgattgccttgatcttctcgggatttgcttctattcctctgccggagacaaggaatccgagcagcttgcccgatggtactccgaacgtgcacttctctagattgagcatgaggcgatatcgtcggaggttgttgaacgtttcctgcagatcgtcaatcaatgagtcgcttgtcttggtcttgacaacgatgtcgtcgacgtatgcctcgacattgttgccgagctggtcgctaagtgcgccctgaaccgtgcgctggaaagtattccctgcggttatcagtccgaatggcatcttaacatagcaaaataccccgaatggcatgatgaatgttgtcttctctttgtcttcttttgccatgctgatttggtggtagccaaagtaagcgtcgagaaagctcaacagctcacagccggctgttgagtccaccagctgatctattcgaggaagagggaagtgatccttgggacatgccttgttgaggtcggtgaagtcgacgcacattctccatttcccgttggcctttcgcaccatgactggattggctagccactctggatgtagtacttctctgatgaagccaggcttgagaagtttgtcgagctcttctcgtatggcttgttttcggtctggtgcacatctccgcagactttgctttactggcctggcatcgggtcgcacgatgagtttgtgctcaatcacctccctggggacccccagcatgtcggacggctgccaagcgaacacgtcagcattgtcgcggaggaaggtgatgagcgcgagttcctatttctcgcttagtgtcaccccgatcttgacggtcttgtcgggattggcactggagagtggaacgatcttgattgcgccgtccggtttcggcgtcttgtttgtcttgctcactttcttgggtggcttggtcgtggcgggtgggctgggcgtttgctcgaccatgtcgaggctccgtttgtcgcattgcaccgccagctttgcattcccttaaatagtgattattcccttcggtcccggcatcttgagcacttgatacgcgtagtgagatgcggccataaacttcgcaagtgcagttctcccaatgatggcgttataagctgtatcgaattcagcgacatcaaaggtgatctgctctattcggaagttgttagcttggccgaaagtcacaggcaacgtaatcttgcccaatggtttggacgatgactggggagtaattccatgaaagggttaatcggttggtgtcaattcgctttgcggaattcccatcgcgtccaaagtgccggcgaaaagaaggttgattgagctgccaccatcgatgagaacccgcgtgaccttgatgttccgaatagtgggttcgaccacgatcggatatcgtcctgggatgacggcagtcttggggtggtcttcttccgagaattctatcttctgttcagaccacttcatcttgggtgcagccccctgccatgtcgaacagacttcacgttccactttcttgtattctcgctttgaggagtacgttgtggaacctccgaagatgtgtgaaacgtggaggtcagagtctggatatgctgagtccgactccttgggagccgcttccgcatccttttcgaccacgcgtactcgcttgcctttttcaaatgcaatgtgcttctcgagcgactttttgaaaacaaggcaatcttccaaagaatgtctgtccgttttgtgtatggggcaccatgctttctttgcgtcgctaccttgtgggtctgggcgcttgggagggttcgcgtattctgctgcgaggacttccgcttgagctttccttttcccatttttgcgatttttcttcttgcttgactcaggtgcgtccgtggctagtttcttctctcccccggtcttcggcttatcgttcttgcgtcttagcgcatcatctgcgtgggcgcatcgctcaacaatttcgaacaatctctgagtagttgtgatgcgtcttgttgccaactcctgagtagtatagcgatctctgacgcaggacttgaaggcgcgaattatagaagtgtcggtgatttcggggattgtatttctgcactcgttgaagcgccgaacatattccctcaaggattcactcgagttctgtgttaacgcgtgtaggtcgtcttcgatcgcgtggcgcttgtaggttccttagaagttggcgacgaactgctgccacaggtctgcccacgaagagatcgagtagggcgggagatgcatcagccatgaacgtgcagagccatttaacgcggttggcaaataatttgctaatgcattgtcgtctgctccggcaacgtagagtactgtggagtagacttgaaggaactcttctgggtcggtgctcccatcgtacttctctattgctccaggtcggaatctctcaggccatcggacatcatgcagggaacgactgaaagctctacacccagcgctgggggcggtgggttatcggcgatcgtgtgtccttcatggatgtctatctgatgatgaggaagacgaggataatgacgatgacgatgggtcgcttggttccagtgtacgattacgaggttgtcggcctggctctcgagaatcctgtcgccgtctcccgctgttgtctcggcgccggtctccatcatcgtcgtcattatggcgacgtcctcgaccagtatcgcctggcacccgctgttcgcgatcgttgtgatcgtggcggttatcacggtctcagtcttcgtttgaacggtctcctcgatctttgttatcatgacgccgtgaagagacatgacgccgggaacggttctcgttgtcttgtgtgcgtcgtgcctctcggctgccgttgaggtgatcacggagatcgccggtgccgcgaggtggaggggtggctcgttgaggcgattccctccgttcagggttttcaccattggcatcgccagttggtggctgctctgggtgcgctgcggcagcggcctcttcgaacgcgttgctgaggttggtcactgattcccgtagtcgttctgtccaacgcgcgagatcatcgttcagaacgggatcgtagggggtttccctcagtatagcgttgacggctctgatgtgttgggccggagtggctacttgattctccgcttctgcattggtgcgctgtgacgtgccgacatcatcaatagccaatatctcccgtggcacgctcgttgtcgatgatccatagtcttcgaggaggtgcaagactgatggttcgtggggatcgatgtcgattaccccaacaaatcgatccgaagttggcgtcgctcctcattccttgtctttatccctgatgaggatgtgtgactgttggaccttaggagatggcgccttcatggcgctgagaaagaccttgcagcttgagaggtcgtgattctttgtcttgtgaataggagaatagacatcacgagttggagaaatacgctgaattccacgctctttgcaggagcgaatttcagcgcggacgttgagaaaaacccagcaggcttgcaaagtgtgtttcctggttttgtggataggacaccaggaccttgtcgctttggaagtcatcctcgtcggctcgtggttcttgtcggagtgacaagctttggtcgccttggaatccttctcgagctcagatgtcgttcatgttccgttctctgcctcggcgggaggatttttcgacatggagtcgtcttggtttgtatccactgcgttctcgtttccggtcactgatggaccggctgagatcggcatcgtggtgtaaaccgggaagacgattttgccgacttgagtctacaccagcattgttgaagcagggaatacttggttgaggttggtgttgacgctgttgtcgacgaagctggatgacatagtagtagaaccttgagcaccaagtgcccctacctggcgcgccactatcgacgggtgatacccatagaccggatatagagggtattggagtacgttgttacaagggtccacgtaatacgacatcaagcaaacaaaagacgaagattatactggttcaggccccttgataggtaatagccctaatccagttgacgtgggattatatgatggaaaacacaggttacaaagggaacaatggaattcgatggatccgacaagatcgtagtcgagttggttcgactagatctgtgggggttgtgttggctttgagatttgatgccttaggtcctccctggggggtcccttttatatcgcaggtcaggcggtttccaagtagaactcggagacatcaaaccctacacgatacattgacgacccagtcttgtccgagtaggactcttttcgtccgtaaactctgtgaaggatttccttagtgtatgtagagagtatccgtatgcgcgtgggcatgccataccgatatgtgacatatatcaaagggtaaagggtatacctaacccgtaaccctgacacacccctaccgacgagcctcaattccctaaagccgcctcgaccgctcgcttccatgtcgccgccctacgccgcacctctgctgccacctagaagcctacgagcgataggatacggactgaagaaggaataggagtgattgtatacatgggccttgtttggatcct

SEQ ID NO: 57968 - DNA, 6748 bp, Oryza sativa
agcaagattccggagggctatttaatagccctccggatccaaacatggccatggactaaagaagaacttggttgagtacataggtagggtattgggctacgaatgtgtaggcaccgttcacttgtcggcttctcaccaaatagcctagctagtaaaactatagcaaactgtcatcaattagatatctgggttgtgcagaacaaacatgctacgagcctacgaacgattggatatatgggtggtaatttctcccgtggggttggggttggggacccggtgagtacccgcccctacagggacgggtgggaattctaacccgcaggggaagcgggtgggggccctggtcatttctgggtgcgagggcagggatggtatattacccacgggaccccaaagtagaaagtacaccagagaaagcccatgttcccttacccaacaggtagttcagttcggtggtaataatttggcccaacaatatagcaaaagcccataaaaaatgagagcccagttggcagctactccctccgtccaataatataagggattttgagtttttacttgtagtgtttgaccactcgtcttattaaaaaaaattatgcaaatataaaaaacgaaaagttgtgcgtaaagtactttagataataaagtactccctccgtccaaaaaaagacaaaccctagtttccgtgcccaacgtttaaccgtccgttttatttgaaaaaattatgaaaaaaattaaaaagacaagtcacgtataaaatattaatcatgttttatcatctaacaacaataaaaatacgaattataaaaaaatttcatataagacggacagtcaaagttggatacgaaaatccagggtttaccttttttttgggacggagggagtaagtcacaaaaaagtaaataataattccaaatttttttgaataagacgagtagtcaaaccgtgcaagcaaaaactcaaaatcccttatatcataggacggagggagtagttcagtagaggttgtacatacaagtgaacaaacagccaaaccaacaagggaagaccctaggatccccaaatcgttttcaaattaaaatacatcttataacgttttcaaattatgtcgttttcaaatgacacttctggcaccctccacgaaggccgtcagattacgatccgacgaccctcctttccctagagcctccgccaccgctcgcttccacgccgccgccgagcgccgcacctccgccgcctccccgtctcccatcacctcctcgacccgccgcctcagctccgccgcgcgcagcacgccgtcgccgccgtccacctccgcgcgcacgccgacgcgccagtcgcgctcgacgagccgcgcgttcatctgctggtccgacatccgcgggacgcccaccatgggcacgcccgacgcgatgctctccagcaccgagttccagccgcagtgcgtgacgaagcaccccaccgccgcgtgcgacagcacgcgcacctggtcgcaccactccaccaccacgccgttcctgcgcgccgccgccgccgccgtcgcgtcgcccgtctccgccacggcggccttgttgtccttccgcaccacgcagaggtacggcctcccgctctcctcgaggccatggagcagctcgtcgacctgccccttcgccatgacggttaagctcccgaacgcgacgtacaccaccgagccggccggcttggtgtcgagccactccatgtacttggcgtcgttctgcttgaacagcgcggcgtcgtcgccggacgggagcaccgggccgatggggagcacgtcgtacgccccaacggcggcgagcgtgtccgcctcgagttcttggaacacgttgacgagcacggtggccttgggtgtctccctgtcgagggcgtcgaacaggtcgcggaacgtggtgaagatgctgtggaagtagtcggaggggtcggtggcttcggtgaggaaggacgggaggtccccggccgccatcggcggaaggcccgggaactccaggacgaacgaatggtcgcggcggtgctcgtcgacgacgccgccgaggccgtggaagtagtggcagtagatggccagcacggcgacgggctggatccagtagagcgcggacggcacgccgcggtcgcgcgcgacgtcggccgcccacggcaggaggagcgtgtagacgacgctcgacacggggcgcccccgcgccgcgagcgcgtcgaccatctccccgacgctgcgccggcccgaggcgtggaacgacgccatgtacgcgccgagctccgcggcgtcgccgcgcttgacgaacccgttctcggtgccgtcggagaacgggaggagctcgagcctgccgtcgccgtcgccgccctccccctcggcgaacatgcggcggtgcgcggcggcggcggtggagaaggtgacgagcgcgtcgggggcggcggcgagcaggcgcctggcgaggcggagcgccggcgcgatgtggccctggagcgggaacgtgagcacgaggaagtgcggcctcggcgtcggcgacatggctccacaggtcacgagtcaccgacgtgtggctctcggttagctagctgtagtgagagctctagctcagctcagctatggcgcataggcaaaatgggtggcaattggccagctattttttatctgttagtggtgtggcgtttcgtgtggcgagcgagaggagtgcacaagagttcgagatggcagtgtcgcatccacgaactcaaccagcgttgcttttagttacctttaaacttttaaaaattccaccacattaaatgtttgggcatatatatatatatagagcattaaatatagacgaaaaaaaccaattacacagtttgcatgtaaattgtgagacgaatcttttaagcataattgcgtcatgatttgataatgtggtgctatggtaaacatttgccaataatgaattaattaggcttaataaattcgtctcgcagtttaccgtcggaatatgtaatttgttttattattagtctatgttttatactttaaatgtgtgcccgtgtactttaaaatttttacacctaaacaactaaacacggtccagattagttggcgtcatcactgagcttaagttggattagaaaaaagacgagtaagactgttcttcctgaccttacccagtgtcgatcagattcggtcgagatcttgtcgtctgtttgccagttccgtcgtggagtttgagtccagcgacatatgtcccccccgcttggtcattgtctagactgaaaattttgtagttagtctcgtactccctccataaaaaaaaacaagtctaatagggttctcttttagcacaacgaatctggacaaatcttttttaggttgggtatttttaagacaaccttaaaggatccctttctagtacaacgaatctaaacaaactctttctaggttggttttttttggacggagggagtatgctccaatggcttgctcccgggctaatgtactattatttggtgtttggacacgcatatgcatctcttccatagttggaaaggaaaatttctatctattgaaggagggctcacactaattaacttagtgtttattcacgtcttaaaacaagacccaatctaattgggggatgtgacacgaccaacttggtataatggatttagatataaaggtatccagatttgttatactatattctttcttttgtttcataatgtaagtcattctagtatttcccatatttgtattcatgtatatgtatatatatatatatatatatatatatatatatatatatatatatatatatatatatatatatatatatattcattaacataaatatgaatgtgggaaatactagaatgacttacattgtgaaacggatggagtatgtcacatcccatttagattgagtttttttttcatgaatgaagtacttcacagtagcgagaggaatttttttaaaaaaaatctactatttttgctctggtttttgttgttagagtgatggtaaaaaaaaaagccaagtgagacatactatgccgccttaaagataaggtggtttagaaattcagtattactcagtaagtggctatttcagttgcttactgtagatgatgtttggaaacagctaatacaaaataagtatttgagttcacagccgctcacgcaagttcagtagaaggccggagacagcctaatgaagatgaaatgagatctcttttgtcttggatcctacataattaagaatggttactaaattaaattagattatggaaagacaaatgattgggagatgtaaccctacgagaacagtacactttcctctacagtgttgttaggtataaataggtaactattgcagatgttttagagaacagatctaactagatcaaaattactggcatggaataatttattatcacacatcactaatattgatttaattcaggagcaatattagtttatatggaacttaacccttaatggacggttgaatgtgaagtccatagtgacatcccaaatctctgaaaactaaaagtgcctttgaaggttaaaattttccattgatacattcgtcgcggagttgtgttaaccaaagataatttatgtaaacataattgacaaggcaattaaaattattgttattcacaagaagaagaagacaattaaaccctttttctttgaatgccacttagcccatttagtgtggagtaaggaattattccatctggtagtatttcacgcaaattcactagttggatttggggtgttcaagaagatctgcaaccatatatatcttgttaggggcgactgctatatgctggttgcttaagggggtgtttgggaactagggactaaatttagtccctctcacaaaagtatagggacttatatttttgtgagagggactaaagtttagccccactttagtccctccaaccaaacaccacctaagttatatgctggttgcttaagttatgttggagtgatatgtttttttgatagaaattttttttctcccatgcaggctatctatttaactatccattggctacgcacttgggttatactatagaaacccagcttgcaccttgcaggatttgattattgccggcatatctatgtttggagcatgtggtcaagagtgttttaacagggacatgtgtggtgatctaatattacgattgatagttgttagggaaattttactacaggacatcgtgacttcgcggttttagctgtaggacaccgcacgaagtgacttttagggaagacactctcaaaagttaaatatttactggtggacatcctactcattaaaataataatttccggtcgaagatgagagataaatcgcgtgaaatgtcaaaaatgcccttcagcccacatatcagctctcctatctctcttctctctctatcccctcctccatgccgctcggcgaagagcacgagctggccgcggccaagaaccgccgttcaagtgtgctgtcgagtagacgaaagacaccatcatcgcgagaaacgatgcggggaagaagcgggcggccgtggaggagctccaccggtgcgacgagctatgacggttgcggtcagaggtcgtcgcgttgaggaaggagaagcacacgctggagcagcgggtgctcgtccggcactaggccacctgcacgttgcagctggcgtggtccacggccaccgccggccgccgctactgagtaggccgcgctcttggcaccgccgcgtgcgtcgcgccgctgagtagcctgcatgtgctccgggctttgccaccaccgtcgagcaggccgccgcagccgccgccgagtaggccacacacgctgccgctgctaagtgggcatccgctgtcgtgtaaaagagagaatgaaagagagatgggaatagataaggaagaagagaggatcagaatgagataagaggggtaatttggtcaagctgtgtaaaaaagtgggccccctctcgtctagtcagcacgaaaatattaatttaatagatgtagtgtcccttggtaaattaccacatttacatagtgcgctccctcaaaagtgacttcgtgcggtgtcctacagctaaaaccacgaagtcgcggtgttctgtagcaaactttgcctagtcgttaatgctgcttgtactttctttcttttaaacttgttggtttctgttatagctacatacatcctagttaggcagaggccgagcgcattctcggagtaattattagttattactactagagaattaatcttttattgtggtacccaaaatcacaaatatcttgattagattaggaaccggtactaaatatgctttagtatcggttctaaaaatttaacttcatggaaacttttttagtcctagttggtgttaccaactagtactaaaaatgcatctttagcaccagttggtaacactaaccaagactaaagagctctctagctctttagtctcggttggtagctctttagtctcggttggtgtactaaagatatttttaataccggtaagatgtctacagggttagttaatatctatccaagttagatgtgtgtagtaggagggacggtaacgtaggatgaggtgagagatcttgagttcgaatctctcacatcccacatattttttttaacttgatatgcaaatttagtaccggttatttcagtcgatacttgaagatcgagatctttagtctcgatttgttggtcacggtgttataaccggaactagtgggggtttttaaccg

SEQ ID NO: 57969 - DNA, 1784 bp, Oryza sativa
tttcccttttcggccgcaacttctctctctagctatctcgcgaaagaaacgtgcacaatagaggaggagacctgcacggctgtcaaggcatccgtgcccctgcaaggcacgagcgctctcgtggggcacgcagtgctgatctggattagaatctccgagctggcaacatgagaccactagataagagtactcacattgtagtctacacctaactggatactcaacttctacataataagaaagtaaatagaaccacacatctcgacggtgcaccgtgtttccattggcccatgcaattttgtcatttaagcccatgcatattttgtttcaacccttgttatatattaattttttttctagttagatctttacataaaggacctttttctaaacaaaaatatatcaaagatgttctctgctgccccacctgtttgtgatacagaacaatggaatcccatctccttccactatccctcctgcccggctgcccgatgatgccgacaacctcctcacctccctctcccaataagctcctaacaactcacagattaggacagcggtctcttgtcgatgccctttttgccactccttcttgcctcaaccatcccccttcttcctaatggagcagatggagcaatgagtagacggggcagcgcaggtcgacaatgttagcatttgcgctcggcccggcagagcgaggtggatagccttgtggcggtgcggccgacaaactcatgacagttcgcacatcggggtagccagtgcggatcaaggtggtgcctcctcctctcccctctctccacattatggcggtagcgaggatgccaagcggcaccgtgttgacgaggtcctcccaatttagatcaaggcagcaacctctcaaaggtggatcgggcgagatctagttattgagggcactccctgccggaggcacctttggctaggcaagatcaacggcaaaccggcgaagcagggtggcagagatgggagctccgcgatggcaacatctctctcatgttttctgcttcgctggacgtctttctacttttctctaacaaggccaccaaatcctaacaggaggacgagggactcactatgaacaacatctgcttacgtggaagggaatctcgaaagtggcgtatttagaccaaacgccacctcactgcaaggattgagatcctctaacttgtgtcactgacatatggaccctctaccagcggatccacatattagtgacctgtaagtagaggatctgtactatgaatggcctaattatcattgcattgtggatgacgcttaggacctgctcccttttagcattagcggtaaaccagtaccccttcatttcatattataagtttatggaaaaatatagcagtattttcaacacaaaacaaacatattatcaaaatatatttaatgtaagatttaattaaaccaatttaatattttatatgttgttaaatttttctacaaatttaatcaaatttaacaaagtttgacttaaaaaagtcaaataatttataatattagtactaacttttaggggcaattgcgcatttgaccctcttttgaaagctaactactaatttgatcctcttttttcaactttgcttatttgacccttctttttaaaattgaagatacggtatgaccctattctgttaaaggcttctaacggtgttaactgaagcacaaaaggtccattttacccttagtcatttgaccctattacatgtgggacccacccgtcagttctctcttctctcttcttcttctgacgt

SEQ ID NO: 57970 - DNA, 7879 bp, Oryza sativa
tctgtacagtgttagtggttaactggatgctgtgcggctttttagtccggtttgtgagctcaaagtggtgatgggaaagcaatcaaaataatttgctgctcaatggcatgcagctaagtgaagtttggtacagttggcactctagtcaaaatgcatgttaaatatttcatccagttgattgttttagtttgaggttttgaaaattgacactcagttacagatttcatgcgttccgttagtagcatagagccctagacccacatttggagctgggaatttgcaaagcttactgcacttacatgggtttcatgtactccgtacaattctagcgctgtcatgtagacactaatagatacaccataaatttatggtattgatagttatgtcctcttcacttgcagaaaagtagattacatatttatttatttttaacaagcatcccttgttttttactcaacaattcccttcttgattttgtatataagtgacactaaccttctgaagaaatgatgcacaccaactgtgtatcgagtacattggtagctttctgaggttcactcacatatttaaggtctcatatgattgcagaaatggaccttcgatacaaggcatttcttgatgaatgggaaacaaatccaagtgtcaagtgtgttcttgtggaaagcagttcaccccgtgccttctcagctggtgatcacctctctgtttttattcgttgaaaaagctgggccttgtacattgaacatgctgttttgcgcctttttatttccggagcattggagatgtttgcaaataagattcatgaccaatgcagggatggatattaagggtgttgcagcagaaattcaaaaggacaagagcacaccacttgtgcaaaaggtttttacctttgtcatgtgtgtttttgatctgattttacttttaaagctcatatttcttttctatttgttgttcaacagtttatgtgacagtataacggtgttgttaacaatcgttgctttgctcagatagtgatattgtttagtgtaaactgcaggtggggatgtgaagagacttgctaatgattgcacaatgccagagataatagaggtctagtaatagcatgattaatgctttcctggagatagtttccatcgcatgatggaaaaccttttgttgattgcggctattttgctctgattttctaaaaattataatgccctctttgtatctgaaaaagtgtatataagatatcggaattgatattgcaatcataatttgagaggagagctgaataggttttttgtatatgaagttcataacgaactgaaagtcatgcaatattgaaatagttttctgaaaattttgatttgcagtttaatattgtagttgatacatctaaacaataattgagatttaacacataattaaatttaactgatgattctgcaatatccaaaaatacaagtacatcctcctgctcctactgagacatgaggatctaaaaattctggcattgttttcacatattattggtgggttttgattatgttgtcaaaacatattattggtgcgttcatattacacataaaaataaaaagaaagaaggaactgatctgtgggtttagtaactgacatttattatttattcttctcaagttgtgcaatgcacatacagttgaaagacttcagttgtttaatccatcgtagtctgttgtatccttttcttttctaacaccatctgatccgccaccaactcactttgaagcactatcattttccaacacagttacaatcacttctatctgctgcaaactacaagctgtgtttggtgtgctccttgatgcatgcacttgtttgaaaataactggttatgacttgtgaccaataacctgctttggattaaccatgcctaattcacataatacatctatcatgtatgtatacatgcacttgtgcaaaacatatttcgactcatttgaaaaaaaaatggattgttatttttgtaaattacttaatgtttcccccacactatgcagaacaacttctatatgattcataaccagctgatttgtacataaataatctaaaatatgactctggtggcatatttaattattgatgccaactttaggtaattagtagtcagtcgtagaggggtttctgaaccttattccatgctagtttcttcttcttttaattaaagtaccatgggaactgaaattcagcatgcttagctggtttgcaaatgacttgaggttaggctgctgagcactgagacaccatttgcatcttattattgcacaacaaatggtgtttacagggctataggcatgattagtcctagtaggcagtagcacacattttctactcctccccccccctcccccttcccccttctctctgctgcctgggaaaatggatgtagttgatatgtcctctgtccaaaatgttcttaaaatttacatcactgaaaaggtactttatttgttttcaggtctgcacagcagagtactctttgatttgtaagattcatgagtatacaaaaccttatatatgcctgatggatggtgtgacaatgggatttggaattggattatcagggcatggccccctaccgcattattactgaggcaagtttgaaatttctgtaactctgatttagattttatgttcatcatttgtattctcagtatttgaattgtaaggctcaaaatgttcgcatgcactactgttacagaggacgctcctggctatgccagaaaatggtattggcttgttcccggacgttggctttgcttacattggtgccaaagctccaggaggtggtgctgttggtaagattcttgactatcttgtttcagtaaccctgtagaaccatgtcttccgctactaattttgttaataatctatcatcataactcattttgagcttgacaacataggaattgttctgtagttctgagctatgagttctggacattgcatattattcagttcttgttcaattttgcaagatatgtaacctggttctaaactctgtctttatttgctctcctaaattatttgctgctccaaatgtgtaaaagcctttttcatttccttctattcactgccatggttattaaggcgtcgctatagcatcgtgacgttcccagaagggcaaggcatccttccgccataggctacctccgccttacaggcataaactgaaggaaagagggtgagagcagaggggaaaagtctgttgtcttgctgctggtcctccctagcatcgccctctcccttcttgtgctgatggggagtacagggagatcaagagaggcaccacctgctgctgctgtgccacatgagagagaaaaggtggaggagaggaggctgctggctgcaatagaggagagaaaggataggatgatggtgtatgcttgctgcatcgtgcacaaggagagaagaaaggtggaggagaggagccgtgctgcacaatgggggagagagatctagatgaaggtgaggtggcggctgctgggagggaagctgttgggtagggttaaaatgttgtttgctaggtcaaaagagcaaagtatttggactaggctaggtaagtgctactattgggctgggctgtgatgaatggagtaccccattagtatttttagggcccatattacttaatactttcttatttttcaatgcacttaaggcgtcgccacgccatacgtcttatcgctatggcggtaaggcggtgctgggttggcatacttcgccataccgccttaataacacggttcactgctcacttctgcttctttcaggatcttaccttgggatgacagggaaaaggatatcatcacctgctgatgcccttttctttggtcttggaactcattatgtaccttcagcgaacctgggacctctcagggaatccctcttgagtgctaacttgtatgttccgaactgttatttggtaaaaacttactaaatgctagcaagatcattatgttcttttaattactactagctgaatgcccctgctttgctactgaaaataaataaaaacatattttccatgatatgtgttacccatcctttttctatagggaacatccatcttaatttgattttatatgtggctatccatttagattcaaggggcaatttgcaaaatttacaatgggagtaggtgggatgtcagattcactgcctccaccattccattcttttaaagaagtataaattccataatttttcattaatagaataatagtgacacattcaaaactcggttataattctgtttgatagtgtcttgacatctgatatcgtgttttttatttttgcagcacagatgatcctcacagagatgttgagtcattgctgacaaagttcaagaacgagccagagtcagggccccagctagataagtttttaccatatatcatttcttcctttggtcctgacaaatcagttgctgaatctgtggaagagcttaagaagtgtagtcaaagtgatgatgctgcaggtactctgcttttaagctaaggcgtcaagagaatgttgttatatttatgcacaagtgccaacagtgtttctatattgagaccgttttataaattcagtttagtactgactagttgcacgtgtatccttttcattgttgtctgcagtggcagaatgggccaacgaggccttggcaggactcaaaaaaggggctccattttctctatgtttaactcaaaaacatttttctcaagttgcatcagcatataggaataatgaacactatctatcgaaggtatgactgctatcctgtacaattgaatacttttatttggttaactattttattttcaggcttctctttttcttttgcaaggacattgctaattctgacatttggtttgttcagttggctggtgttatgaaagttgaatatcgaattgccttgaggtcatcggttcgaaatgattttgttgaaggtgtacgtgctgtcttagttgacaaggaccaggcaagttatccatgtgacttagtatctctttactctccgattacttaaattgtttggcggacaatttataatcaccatagcgtatagtaaatgttttaggatcacatttccataattcaaaggacatccatcttctgacatttgcctctccatagtgataattagacacctcctgtgtctgtgggtcccagggccacatgtctagcacatgggttgcaaattacaaactatgaatgtcacattaaatagttgcttttgtggcgtatcatccgccagcttattcaacttgtaattaaacttaagaagcttaattgtttaaaatcaattgtttatttgccactccctaatatttaagccttgagctacttttcgcggagctatccactaatggatcgaaacttctgtcaatgaaattctgaagaacacttcgtactacagagtttgaacatttctctgagttgttaataagaagtaaaccagtagaggtagaccttagaattcaaccatgtcttgcgcactgtgcgacttctgggaaagagggatacagacattatagcatgtgtggcacggtgcaaagttcactctcctttgccttgctagacataggcacatagctgttctttttccatatacctagtaataatataaaaaggcacatagttacatgtgtggtgtgttttgtttaactaatggtgttatgtctctagagttaggattaatagaactagataaaaccccacgcattgctgcggagttttgtatgatattagtcgaaataacatgtaagatggctacactttgtataattttcatctatgatcgactattaaaaaagaaagctataaacaattaaaatgttgtggtttataacaatttaaatcatatatggattgatcaatcaaaagcaaaacttacgtgatgtggctagatgagagaaggaaaaaaaaaaagaaagtaacatagattaatcatcaaagacaaaactaaggtggtatgactttataagagaagaaaaggagggaaattatttggaccacatatcaattatcaaagggctagaaataatcgaggtgatgtgtcttaataagagaggagagaaataatatttactaaacttggtggagatgaactctatagatatatatttactaaacgtatagctaaatttccttttcaatttgtagaatccaaagtggaagccagcaactctggaagacgtggacaagggtgaggtggaatcagtttttgaaccattagctgctgaggctgagttaaatgtatgatcttcacagcaaacatgtaatattattggtaccggaataccctcttcaatttccctgttatgttgcaataagaaataacaatgataaaaatgatgattattgagccaataaataatatcatgattacagtatttgtgacttactgaagtactagcaatgtattgtcatttttgttaggagtaagtctattttgccttcctcatctcttgccggtcaaattgtatccctcaccagcaaattgtatccctcaaccacaaagctaggtataacgtatctctttactttaaaaaccgatacaaatcgatttcttcggtggttcggaagctgacctccacgcgaacaggagtattatttgatgtcgagcatcttcttgcaccgacggtgggagaagtgcaactggcggtggaggcgacgtggagtagagaggaaaggggaaatcttctgttttccctctcacgtgcgtgacagggcggtcaggatgaaattgtgaatgcagttgggggcaccgtattccagcttttccctacttttaatatctattgtatactagcaaaagtgctcgtgcgttgcaacggaaaatgtacagaccaaaaaattgaggaaaagttaagaaaaatttacattatgtaattaattaaaatacaaatttgctgaaatatttggtatttttaagtaggtaggtgtataattaaatcaatttacaagtaaagtaagtgagaaataaaatgacatggttaaatttaattttattaaattctccatgattagttacactctttgaaattttattggaattttcagagcttaattgctaatttaaataatacaaacatcatttaacaattatttaattggaaaaaggaatcaaaatcctcccttttaggtttgggccgaatatagaaaagtttatattccttcccttttatctattctaagagcacccgcaatggtaaagtaaggtgctatctataaaacatgtacatctcagcaatagactagattaataataaacaatctcaatagtatgtctacatgggtatctatagctctctaataaattgcctcgtttttctctataaactatcttcaggttagtagatagctttgctctctctcttcatttaatctcttccaagtagaaaaatatgcttacatggatcttttatagagagtctatagataaccattgtgggtgccctgagggtgtgtttgagaaagaggggattgaggagattggaaagatacgtaaaacgaggtgagccattagcacatgattaattgagcattaattattttaaacttcaaaaatggattaatatgattttttaaagcaactttcctatagaaattttttacaaaaaacacaccgtttagtagttcgggaagcgtgcgcgcggaaaacaaaactatctttctctctttctcctgcgctcgaacgcagcctaagtttctggcctgtttcctttcttcgttgatgtccattttgtgtcctccattcggcggcccaataggcagcccgacgtgggagcagcttgagccgtccaatcgaatggacggtccagattaatcctaacctaaataaatatacccgaaacctaaccctaaccct

SEQ ID NO: 57971 - DNA, 1262 bp, Oryza sativa
agatgcagcaactacaggtagctgaacatataaagaacatacttgaaagaatcatgttcaaagatcatataacaagtaagtcatcattgagtcttcgatttcatacttggaaaatcacatctaccagtggtgtctgtgaaagaatcaaaaggctacctctgtttccggttattccaagaacttcaaaacttggggtaccaaatgtatacatactttggttagagaagatagttacgagcacgacattagcacccacaaagagttgatcaattagcaggaccattaatcatgtataagtatgttccttattacttttctaattccatggcatcaacacatgaagcctgtgcagagactcaaatatagcaacatggaaactattatcttaacctacacccttcacagatctcataatttgatgatttcttaatgtatggtatgatacttctgccagatttgcatgctaataaactgccagaagtagtgatcaagaaaaaacagaggaacatattacatataagtagtgcacattctagttaaatgtaattattcccatggagaagttctcattttgaatttaacctttcaaacttgatggagtctttgctcgacagaaaacatatgacaaataggtgatcaagttggtctgatcaattcagcatcctgtgtccatacattgatctgtaaatatttgttttctgaccatattactttcattaagctcagcatgcatagatttggtgtgtacttctcacataactctatttctagaagcttgggagctcccatattaactagaaaagtcacaagttcccacgctaattgaaaaaaaaatgttaagcgctcgtctatgacatactagtgttgtgccaaacaaaacgtgaactgggctaagtcaaataagtgagtatttgttaccagttccaagtagtcttcatcttcgatgattgcaattgttccttttagcttgcggcactgccttttgagctcttcgctttggctttcataaacatgtagtacttctagtgaactcggaaaacagcccttgggcagcgaatgaatgtttggacagtatgcgatctctaatctcttgagactggtgagtctatgtaacccagcagggagagactgcagcttcgagcattgcacaaatataaggacctcgagggaggagagcagctgaagggccatgttttgctccttggtgaagcgctctaccttgtggttcatgcttaagcttaacttggtgagtgatgaagaga

SEQ ID NO: 57972 - DNA, 1168 bp, Oryza sativa
gccgccggtccctgctccgtcttcgtcgtgcgcgatgcgcgagccgagagagaaaagagcaagagagagaatagagagagaggaagaagagtatggcaggcgggtcccacaattttttattacaaaaatgctgactggattgccacatgtgcgccacgttggacaaaactactctgaattggttcgaggggggtaattcgtccggtttgcatagttgggggtgaagaatatccggttttgtggttcagggggataatttggacgaccgcgattgttcgtggggtaattcgtactttttccttttaaaataaatatgtgtgggacccacgtgtcatcctctcgggatggccctcattccgggctggataattcgggattgatttgaggcccatgcaaacaagagtttaaggtttggttaattacaatgcatggcaagcgagtcagcgagcgacgaaattacgatgcatatgctctgcgatgcgaaattaatttcgctacttacatgtcatctaagttctcctcgctagcatagtcacttccgtggcgagcggcgacggcgaggacgacgcgtccgtcgtcgtcgggtaaccccggttcggttgttttggttgtcatggcgaccggttggctcgagcgcagccatcgttcactggaagcagctattcttcaccgtcgctagtcacatcatccaagaaccaagagctcttcggcttggacgtacacgccggtgactgtgagccttcccacgtcaagctccaacctgaccttgatcctagggtcggaccgcaggcacccggccaccacctccgccgcccccctgcaccgctgcgccacggcgcccagcaccgcgccttcttctccgcctcgacggcctcctccatctcccccacgaggtcctccagctcgttcgtcgccccgtccagcctcagcttccactccacgcgcgccagccgcaccttggggtcgtcgtcttcgtccacgacgtccagcgccgtcgccgcgcccgccgagcggaagcgcgcggagttgtgcctccacgatgtccagcgctgtcgccgccgccgtcgggacggaaggggccgacaaccctcggccttcacacgccgtccccgctgccgcgcccacgccgcttccaccgctccggcggcctcttcagggacttgggccg

SEQ ID NO: 57973 - DNA, 1483 bp, Oryza sativa
caactttttcaccatctagtgttcgatcatgttctgtgcgattggtgttgaggtaatggttaagctccgcatctgggttccaatttgacctgctacctgatgaggaagcttgttccttgcccttgatcttcttccacaaattcattgcacttgatttgctttactttttttgtggggtttcctcaggcacccaacgaacaacacttagcttagtttggtacatacggaaaaccctgaacaactcatctctagcatgttgataagcttcagaataatcaagacccactgcatcacctattgatatgaaagcagcctccacgacctccaactttttacgaggatcaagtaccaaagcaaaacaataaaggtgtggaatagtagtgaagtatttgagaaattttccttcattggttgaacagcagaagctaaaactctatcatgtcggttttcttgaaatataagggacgatttccaaagacattcaagcaccaaacaagaagtaggatagtaaatcctagatagtaggactatagctttataaaaaggctttaggaatatacatagacatgttgctatgtcccattcttcctcagtaagaagcaaaatctcacaatcaccatcctcatcggtatcattacttctaaagtgcaatgaattaatgaaaacagaaattatttcctcataccctttcaattgacgcagcatgaggtatgttgtgttccaccgatgtttcacatcaatgccaaacatcctcacaggtttatcctttgctcgacaatagtcccggaatctctccttcatcactgactgaccctcgatgatagaaacagcttgacggatcttgttgtgtaaattggtaataacagtaaatcctacatagataataaattccttgtcacatatgcattaaaattgataaattatttgcactaaaaaatgaatttcaataaattctcaacgactagtaatacctgcttgcacaatcaagttgatgatgtggcaaatgcatctttgatggataacataacctccaatgtagctttgcagatttggctccaaaatcgtcatgcccattgtatttgctgatgcattgtcaagagtaatagaaaccaccctagattgtaaattgaattcttgtagtatatctagtagtgtggcagcaatggctcgtctagtatgtgacgacatcatttaaaaccctataaccctcttatttagtgtgcgattattgtcaagataatgcacaacaacactaacagaagaggttctttggtgcttggatgtctaaatgtcagatgtcacaacaaaagaaaagctaacaatactgaacaagcgtttcaactcatccaacctagaacgatataatgaaacaataaagttcttggtggttttccttgaaacctgggtgtactgtggacaaaaagcatttcagatcatcctctcaaaatttttcctttcgcccatcctaatcggtaggtcctcc

SEQ ID NO: 57974 - DNA, 22317 bp, Oryza sativa
cttgtaactaaatctgggttaacttttctcaacaagtaaaacgataattttcctcatatctcaactctttcctccacagccaacgactagctgatgcacccaaccatcagtccctcttgagagttgagacatccgagcatcgccaccacatgtgcaaaagtacgagctgagctttcgagtgggagagagaagcagagtgaaatcaagttagttacctctcctctgggagaagagctgcgggccgcccatgcgctgcaccaagaactcgtactggttccggatcgcgtcctccttcttcgaccccgcgaagatctgccggaaccactcctcctcgtcctcataaaccctgttgactcccccaagaatcagagcccccgaaatcgcgagcaagaagaacgaaccagatcggcggcgagcgagcgaaagcaagcgagacctggtgtagaagttggtggagaggtcgacgaacggctgcgtggtgccgcccagcgcctcgaagacgttcccatcgtcgatggcgaacgcatcccccgccgccacgccgctccactccgacgccttgtcctgcagcgactgcatcgccgccgccgccgctccgatccccccaaccaaacgcttggctgccgtgaggttgactcgtgcggtcgcggtggtggtggcctacagtaggagagagagagagagagagcgcacacgccactcacttcaccgccttttatacccgccggccaatcgtgaggcgggcatgcgagggtgcgggccccgcagtggagtggggcccatctgtcggcaagtgggggtgcccaggtcatatatgtcgacacgattttgccatgggtgacggcatctgccggcgagtggtggtggtgcccacggaatccgggctgaaaccgtttagcaagagtagcacgcggtttcgcgacttgggttgcatacttgcatcagccacttcttttttttttctcttttttttttaagaaaaaagcattgcgcccagctttactggaagaagattgtttttttttttttactggaagaggatatggcgtggatagtcgaactggtgaaattggaggaactacggattattgagctgtactccatccatcaaaaaagaaattgacgtaaccaagtagaaagaacagggtacaccatatcctatcatacgtttgagaggagaaaaagaaaagatatgcaaaactagcatatgattaatggagtattaatctctactattataaaagttgaaaatgttttcgctgatattttgatacgttgttcgtatttgagtcagtttttaagtttgttcaccttttgaaaatacgtaagaagtcatataagaaatctttttaaaaaactttcatgttaatttgggacgagagtcggactcctatttcctttagaattcttgccaaatcataagaaaacaatgtataggatatggccatcatccccataaaaaattcaaattagatatcaatactatcaaaataaaaatccaatatactattttttacattaaaaaactaataataatatgattgaaatagcctttacctattgcaactaggggtggacgaaaagctcatgactcgttagcttgctcgactcgtgacaagctcggcttgacttggttcggctcattttatttttctaacgagccgagctagcctttcagctcattagagataacgagacgctgagataacgagacgctcgcgagccgtaacgagcttttgtaaccagcagcagcaggcaccctacaaagcccacaagcccagtaggcccatcagattagagcaaaccctaatactgatgatgtctctcgagtctttgatctattctctcctcactccatcgctccgccgccacaaacatcgcgttcgcgtcgcgtttcgcgtgggatgctccagccgctcgcgccgctctccccagcgctcgagtctcgacgtcgccgtccgcccgcaacgcccgacggaaccagcgctcgacgtcgccgcccgcctgcagcgcccgacggcctcagcgctcgacgtcgccgcccgcccgctgcgcccgacgccgccgctcgcccccagcattcctcctcacggtccaagtgccggcggaggtcgagctcgtcccatccaccgtcgagcttcttcccgtggtcgccgacgatctcgagctcgtttccttcaccgtcaagctcctccccatggttgcagtgccggcgaggtcgagctcgtccaatccactgttgagctcctctcgtggtcaccagcaagctcatccctgtggtcgccggcaagctctccccgtggtcacggcgccggtgaggttgagcttctccctgaggtcaccggctaatttctctattgtccccaaagctcgcgagctaaacgagctagctcgagcttgcagacgagccgagccaagctaggtttctagctcgttaggataacgagaccgagccgagccagctcgacatccacccctaattgcaacgcacggacatgtttatagttattttaaattttaaaagtagattactgtaatttttaaaacaatttttatgtagattttcttaaaaaaatcctcgttcagtagtttaggatgtgtttgtgcgaaaaaagagtgacttttcagctctttgcccatctgtagaacgcatctaagtgtgatgaggggataagtatactacaaataacattatcttacattgtaatagaccagtctcatgcaagtagggataaactataaatgtgattagaaaataaaacattgaatatatatggtggctatgtatatagggattagctctacatttgttgtcaaattttaactaaaaaatttgacagatgtaattatagtataatcgtgatgtaattacagtgtgacttacatataactatagtctatagtttaacttatacgtaacttttaaaaatccttaggcgacatgaaaattcagtgaaaacggaggtaattgtaccgaatcacctcacatatgcgtgggttgtgattttttcctacctccattgcacaaattttaaagcaaatcgaacggtttaaaactaatttgtagttacaacaagttacaatataattacactatgattatgctatatttacattatcaagtttttagaaaaaaatattatcaacaaatatatagcaaaatcgttatacctatgttatactccctccatcccaataaaaattaacatagcaatggatgtaacacatccaaatattatgaatctgaacagatgtatgtactagattcgtttattttcgaatggagggagtacatgtgtaggtgtgctgcacgtggtgtgaggaggttggaagcatgggtgaaaacggtcagaatcaatggcttctcttcggaaacgacgcttgatcggctaataattgaccatatttattatttaaactactcagtgccgatattaatacaatttagaaagaaattagaaaaaaaacaaaatttaaaaatagtacagtcagaaacggtaccctttatacgaaaaatgcactcgatcaggaatttcggtggacttaaaaggagtacgacaccgcttttaagctacagcgtaccgtaatagagatgagagaaggggagggtacctacgagtttggaaaaagtccactttgactcccttaaatataggtaaaatctaattcgtacccctcaactggaaaaccgggtaggacgactcccccaactattgtaaccggtgcaatttgactcccttggcggttttggagagtggttttgctgacgtggcgctgacgtggcaaaattgacccggtcttcgtcccacgtggcattcgaattaaaccaatatatgtgggacccatctgtcattcacaagaaaaaaaaatatattgtgggacccactgacatgtggggcccacatgtcatcatcaatctatctcttcccttcatcggtttgcaggggcgggagctagacaagcggcggtaggcaggcaggcgactgaaagtgcatctaggacccctcatttattttggtgttaatgacaacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgccgtactattaagagggatgccacatgcatataattggtagaacactagtgctcaaaatcatttatttgaagtgttcctgttttatgtctgtcggactatcggatgttgatcagactatccgatgctcagactatccgaaatttcacagaactttgctcactgtcttcggtctgagtgttggctaaaaaatatcggactatccgatataaggtcggactatccgatacgtcggactatctgaaatttctcagaacttcattctctattttgaattgctttttattccttttgagtgagttttaaatcagactatccgatgtgatcggagtatccgatgatccagagactccgaaattcaatggaacttgagtctctgtgagaggatgaaattcttggttcaaaaataacggaatatccgatatgacatcggactttccgatcgatcggattgtccgaaatcctccagaatttcgttctctgtctctggcctgcttgggggtcaaaaacatcggactatccgatgtcacctcggactttccgaggtgggatgaaaagattctctcccaacggccacattttaggggcttctataaataccccccacctaacccttttctagggttacccaactcattcattcacattcactttgggttgagcttggtgctaaagtgttttggatctttgagctctctctccctctctcaaatccctctttgttctttgtgtagtagatcttggtggttgtggatttggtgtttgagggcctagtgtgtgtttcactcgatcttgagcactagggtttgaccaagagttgtgtggtgtttgttactcttggaggttgaggactcctaaacggctaggtgtcactcccgagccaccgatctacgtgtggttggccgggagaagtttgtgaaggccggatctcgcctccacaaggaaagagataccccttagtggaaggaggagtgcttagtgcaacctcttgaggaaagggttagcaaagacccggctcttagtgagctcctcaacggagagtagaatccccttaaggatttgaactccgggaacaactcggtgaacttcattgttggtgatatctcttctcctattatttagctttgcttttgtgccgctttagatctagtcgctgtttgcgccatactcttgtttgtgcactagatctacttgtagtgttcctttagtggatcagacagtctgatccaacatcagactatttgatattttcggatagtctgactgtggatcagactttccgaccctaactcagttttagcttccgcataaagttttaaattagcctattcacccccctctaggcctaattgaccctttcaattggtatcagagcctaatctcctaattaggcttaaccacttggagagatcatgtcgggccaaacgggggaaggcaaagatggtgataagggagttatgtttccttatgactatccaactacatctacattttatgtgagtacctatagcggcaaagctccgtatttcaatggtacggactatgccgcttggaagcataagatgaagatgcatttgaagtttattaacccatctatttggagaatagtcaaaaaaggctatgttttgcagaatcccgaagatcccaccaaggaggacgatgagaacgagcacaagaacgctcaagccgccaatgcaatacttagtgccttgagtggaagtgagttcaaccgtgtggatggcattgagagtgccaaagtgatttgggacacgcttcggaacttgcatgaaggcacggatagtgttcgtgagtccaaggtggagatcctcaaggggcaatttgagagatttgtgatgttggatggtgagagccgaagtgacatgtatgaccggttgagcaagatcgtcaatgagatcaagggacttggctccaaggacatgaccgatgaggttgtggtcaagaagatggttcgagccatcacttcaaggaactctaccttggttaccatcattcgtgagcgtccggactacaagactctcacacctcatgatttgctcggacgcattcttgcccgtgacatgcttgtgcaagagtccaaggaggtcatccaatacatcaaccaaggctcaatgacaagcatcaagaaggaagacttggcattgaaggcaaaggaagaagaagaagagagccgcaagagcaagagcaaggaggagatcgatgatgaagataaaagcttatcctagaacagattagttaacttattcatgattatagcctctgacaagccaaaagcccctaaatccccttgcatattgtggactcttaattcagggcagggtggattgttgcagatgtgagattgcaggggtgtataggctgaacttaaacaatccggtcattgcacttttagaataagactaagctccctttgacggtcaacaatccataaaaccaaaaagttggcttatggcataataagcctaagctagagctacacaaaatcaatccatacagaacagagaacatgataaccaaacttcaaaaaggggtacaaaggaattgaacaattatttattcggtgcaaaaatattaattgcacaactattacagcttgccctaaataaatgaacaaaataacttaagatgtatgatgacatagtatacctcaaccaatcacaacacgtgacatgcttctccctaaacaaaccagcaaaaaacccaaacttcaaatatatttaaagtcacaacttgtaaagtgccacatacaaaatgcaaaatgttgctaaactaaagccatgcaaaatacaagaggaagctcatattaggattagttatgcactaaatgtaattgttcgttaaccgagttgttctggctgagtgggggcatattattagttctcctttctacatttgtcctcgaattgttttgttttgcttgaattcggaaaaacctagctttgtgcacgtcattgctaatacagtgggaaattgactttagcttatgtttactaactattttgagaatgcagcaccatatattgtcaaattacttggaactcaattatctaaagagcatttccagtagaacaaaactaaaaggaaaacgtgttgctaccttgtttactaagattaagcatccaagctaaaaaaaaaaactaatagcctaataggtataatcatatcaagaaactgtcatgaggattgcgaactgcttactctagaatgatatggaggtgactccttgtcttcaatgatccaagatacttcacaatatttttgtgattcagattctgcgtaaagtggcagaacttagaattcgcagcaatacaattttcttgcgaacgtatatacatttcagatatcaagaaccatttaatttcaagtacaatagattatagatgtgaccactaaccacagaagaaggaacggtatcatttttcattaaattttgggcatcagggcatccataggaacatgtagctaaacatttaaatagaagcttgttgggtgtataaaaataagtatacattgatggaactccaaaattttcttcataaatttgttcatgtaaggctatagctatagaagcataatgataatagcaacacttacatccaaagataaaggggaacagatgcaacaaaaacaaggataggcacacctggagatgcctcctttgatgatttattcccacctaagaagcgaggagatcatggggctgaagcttcaacatccactactggtgaagagcttcaatacaatggtgcacaaaatgatctcgcgaaggaactcaagactaggatggctcagaagcagaaggaaaatgatactgagcacatgaatggtggaaaacttcttgaatatgtcatgcgtttgagggaagaagatattgatggaacggtattgctttcactaatatagtaatagtactatgtattttattttgcctgtacctttgagaatataaaataagtgacacaactctgatgatttcaggcatttgatgagactattcctggagagagtctttttcctttgcaggtatgcgatgccctaaagctctgatgtttctgtgactgatgtgtacctttatcataatgtagcaatgctcttgcttaaccttttctttttaagtttgagtatgtatttgtcttatatatggatcaagtgtccagctacgcaaccaagaagtgacatttgccatggactttggcagcactcatttgccttctcatgtattcaaatattgcattaggtgtcatttcatgtgcatgctagcaccaaggtccagcagaagcacccagagtactgcagaagttttagaatccaactgcatctgctggcaaactgtctacgtaggaggatagattgtgctagttaacactttattcatcttttttgaaagcaggttttctgtgcctaaaatgtatggaaaggttttttgtattttcttatttatgtgcatccctcgctgtgactactattcttgtctacaaacctacggtggataaacctctatggtgcatatctgtttcgcctaacttgtcttagtcattcccacattgaatcgaaactctcaatgccccaagaagttcggcaagttcatgaggcgaagcggcttcttcaagggaaattcttccaagcatcactccaacaagtcaagtggaagacattccgcaagagtgtgctatgtgtgcaaagagcccgggcatttcattgcggattgccctcacctcaaggatggttcccacatcaaggaagataagaagggtgagaagaaggatgagaagaaggagaagtataagcataacaagcgggaacattattgccaagctcaccttgggatgatcttcggctccgactccgagtcaagctcaagtgatgaagaaggagtcgccacgttcgccgtcaagccttcatcaccgctgagactcttcgactactcaagtgatgaggatgctcccatttgcctcatggcaaaggagcctaaggtaccttctcctctcaaatcatttaatgttgatcttgttagtgatgaggaggatgaggttatggatgacgaattgtccaagtccataactaaggaatcactaccacacttgagtgagttgctagggagaattgaggaccaatatgcaactcttgagaggcaagaggatttgctcattcgtgagaaagagcgatctcatgaactcaagagtgagcttgccaaggagagagaaaaatgaggctttggtacggctctacaagcaaaccaaagagtctcatgctaatcttgaagtggcgaacgctcaacttcaagagagagtggatggcttggacaaagcatacctctctcttgaagagaagttcgaaaccttaaagaatagtgtctctctccctagcgagccgtcttgttccaaaattgtcccaagcaatgaatcatgtgtgagatgcaaagatattgttattgaagcttgtgctactaactctatttctttgagtgctttgcaaaagcaaaatgagaagtttatgggactccttcacaatggcctacttaagtgccatatgggtagtaaggctctaaaagagtacctagcctatcaaagggacaacttcaaccatgagggtcttgggtatgttcctccaccaaaaggaaaggtggacaagagtgtgatgatcaagagaccccaaggtcttagcaattttgttaaggccaaaagtatccttcctaatgattatgcttcacattgttcttttgatgcatcttatgttcttaagaagaatgttagtggtcgtgttgttgctaagtatgtaggcccgaggggcaaaaatgtttccatcaagagagttctttgggtgccgaaggcacttgtcactaacttgagaggacccaagcaagtgtgggtacctaaaactagaaattgatctcttgtaggaatatctctccggtggaagaagttgggtgattgatagtggatgcacaaatcacatgaccggagaagaatcaatgttttgctcccttgatccaaatggcacttcgcaagagaacatagtctttggggacgatggaaagggaaaagtaatgggattgggtaagattgcaatctccaatgatctttccatttctaacgttctcttggtaaaatctctaaactataatctcttgtccgtttctcaattatgttccatgggctacaattgtctttttaccgatgttgatgtgaccgtatttagaagggatgactcctcgatagtctttaagggtgttctcaagggcaagctttatcttgtggatttttcctcaactaaagccaaacatgagacatgcttagtggctaagtccgacatggggtggctttggcatcggaggctagcccatattggtatgaggaatcttcactagcttctaaagcacgatcatatacttggtctaacaaatgtaccttttgagaaagatagggtgtgtagcgcgtgttaagccgggaaacaaattggagctcatcacccggtcaagaacgtaatgacaactacaagaccgttggaacttctacacatggacctctctgggcctgacggagcgtggggcccctcaccgggagaccgcgtaggcccccctttgccggttcggccgggggcgctatgtgaggttcttcgccctcgatctgaggaatgtcagcgagaaggatcgcacaagacgcgggcgacgtagacaggttcgggccgctgagaagcgtaataccctactcctgtgttctggtggatctgtatgtgaaggaatacagagagctcgagagccagagagagttcaggctcctcctcaaaaatcccccaagaaaatcccccttcttctaggcctgggcctcctttttatctggtcaggggtcaccacaggggcctctagctgcctaagaaaggaaacatgctttttacaatgagggctagtctacagccggaagtgacccttgacaagcagtgcgcacgtctcctgccccgctcgtcagcttttccggaggacgcccatttcaaacttcatttaatggccggcgacttccttgccattcttgcgctgaagtctggaatgaatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgactggtcacggactggataagcatgcgctgcgccgcattgaatgcagcgtggcgcgctcgtctaacccgctataaatgcggttaggtgagcgcctgctgtgctcacctaacccacacacatggtgccaaaaccacagggggtcggggcgccccagccctcggggccgaaacgggtgcggcccgacccctcggggagacagagggaggggtggccgcgtcaccctcgggcccgaaccccccccccccccgagggggtcaggccacgtgggcgaccgcggttacccaagcctctagtcacgatacccccggtcccatgtcaccgacagtagcccccggcgttacgccagggcgatcgcccccctcgagggaagcgctcgggcgtgacgccactccttaggcctggtgacaggtggggccggtctctacaggcgggcagaaacccagcggtcgtaaatcgcgcgcatcggcaagggaaaaccgatcgacaataatgagcggtctcttcaagaccgctgcattactcgagcagcgcgcgaatcgggacaagccggttcgtttcgcctggagacatgatgatggcgctcttctcggttggcgaacgcagttaatgcgcgcacgatctgccccatctcaaccgtcacggccgcacatctgccgcgtgcgccgcaaacgggcgagtggggttagtggaggcgtgggcgcgagaaacgagggggcaaggtagtgggcacgggaagcgaggagccggacatagcgctggcaagggaataaagacgccgaggaagggattcgtttccttcctctcgccactattccccttgccttcgccacttgcgctctaactcttcgtttcctgtgccctaccctcgccgcacttgctcgctctcaagctcctcctccgccggcgtcatggcacggggctccgcaccgcttgatggtagcgtgctgccgccttcccgcatcgtgagcgagaggcaggccgggctgccgcgccgattcatgccggaatctgccaccggccgggaggtggtcgagctgggcgagggatgcctggcgccacactacccggggcggtccgtcttcttcctctctttcgcaatggccgggctggtcccgccattctctaatttcttcatggatgttctggagttttatgatctccagatggcgcacctcacccccaacgcaataatgacgctggccatcttcgcgcacctgtgcgagatgttcatcggggtgcgcccatctctccggctgttccggtggttcttcactgtacagccggtgtcgccgccgacggtggtcggtggctgctacttccagccgcgggggcaggtgctgcaccgctacattccctgcgtcctccgcaagaagtgggacgactggaagagcaattggttctacacccccctcgccgacgaagcgcgcctccgacttccgagccagcccccggcgcaggcctccagctggcgggcgacggtagatctgggagacagctacgacgccgttcttgaccgcctggcgggtctgtgatcccaagggcttacgggggccatggttttcggcgactaccttcgtcgccggatcgcgccgctccagcggcgcgcccggggtgcctgggagtacaccgggcccgaggacttcatgaggacccaccaggggcgcaaatgggactgggtccctgaggacttcaggatggtggtccaacgggtgctgaatctcagctccgtggaggcatcccttatcccccaaggtgtcctccccctctgcagcgatccggatcgcgccaacatcctgaccatcatgcaggcagtcggggcgtcgggggagcgggtcccccgaggccacgatggcgcgggcgggagccgtagagggaaacaatctaccccgggagggggtcacgcttctgggccccgcgacgggggcccggggggcagccgccctgccgacgcccggggaaagaggaagcaggagggcacgccccccccatctcctccccaagggggcggggcggtgcgtgccagcagcaggcgcccggagggtgctgtgccgacgccgcagcccgagggggagcgaaagaagaaacggctccgcaagatgggggggaccgagccatgccgggggaacctcatctcgcccccgaggtggtcgtttagccgacctccccgcaggtttgtccccgcgcccatcgcgaccgcattcattctcccatctcccaaggcgagttttcactcacccgtttctttccgtcttctggtttttcttctgcctcagcgagatcccgtcgcccccccccccgccattccaagtccggcgggctcgaggccgaggagacggcgaccgcggaggcccggaggcgggaagctgaccggcgagaagccgcagaccgcctccgggaagccgaggaggctgcccaggaggccgtccgggttcgccaggctgaggaggccgctcgaaaggaggccagactccgccgggccggggagtccgtccgggaggaggaggcggcgcgcgtacgccaggcggcctgccaagcccccgacccgactccgcccgaggcgacgacgacttccgaggccacccacgacgaggccgcggacgcgccgctcgggcccgacccctcgggcgatgcttgggacgagccagcttcgggggacgcccccgggtccggcacgtcgatcggcgggccgagccgcgcggcacccacaccgaggcggctctcccctctgtcttccgctgccccactgagcgcggagcccctcctgcaggccttagtcgccgtgaacagcacggtgctggacgggttaagcgcccggatggaggccctgcaggcggagcgggcggagctcgacgcggcgtgggcgcgcgtcgaggaggggcgacgctcggtggaggccatggtggaggcgggccgcaaggcacaccgccggcacgcctccgagctcgaggcccgtcgtagggacctggcggagatcgccagggaggtggaggaggagcgggagactgccctcatcgccaccgccgtacttgaggaggtgcgggacgacctctgcctccaatacgggagccgggcggcggagctagagaagaagctcgacgccacccggggagtccttgacgccgccgctgcccgggaacggcgggcggcggagatcgaggcggcgtcccggcagcgcgaagaggcccttgaggctcgcgccacggcgctggaggagcgcgcccgcgccctggacacgaaggagaaggacctggcagaccgcgaggccgctgtcgccacccgggaggcaacactggcggcgcacgaggccgcctgcgccgaagaggagtccgcgctccgcctccgcgaggacgtgctcaccgagcgggggcgagctctcgaggaagccgaggccgcggcgcagcggctggcggacagcctgttccttcgcgaagcggcgcgggaggagtaggctcgccgcaatctggaaggcgcccgcgccgagagggccgcgctggatcagcgggctgctgagctcgaggcgcgggcgaaggagctggacgcgagagcgcacagcggtggggcggccgcgggccacggcgacctagtcgcccgcctcgcagccgccgaacacaccatcgccgagatgcagggcgcgctggactcgtccgccggggaggtcgaggccctccgcttggcgaacgaggtagggcccggcatgcttcgggacgccgtctcccgtctagaccgcgccgggcggcaggtgggcctctggggcgagcggaccgtgaagttcaccgccaaccaggggggcgtcgcccagcgcctctcagagatggccgggaccctccagcggctccccgaggagctcgaagagacgatcaagtcatcctcgagggaccttgcccggggggcggtggagctcgtactggcaagctaccaggccagggaccctgacttctccccgtgggcagcgctggacaagttccctcccggaaccgaggacggcgcgcgcgcgcaggtccgggacgccgccgaccacatcgtccacagcttcgagggtacggcccctcggctcgcgttcgccctcgactccgacgaggagggcggtgacgacggtgcgaacgacaacgacgacgaggccggcgacccgggcgcgtcggagtgagccccaggcccccgccaatcttaataactttttcttctttttccgaggccttcgggcccccttcttgtatagactgatttaatctgtaatcaaataaagagggaatttctacgtcagttctgtttgttgtatgtatgagacgaggttggtctgtgccgcggtccttctgtgtcttggcttgaacgagggctcgtgcccaggccccagcctcaagcggcgcgggtcggggctagtgcctgaggagatccacgtgtcgagactggccaggccgggagcgtggtgaccgagggttatggatgacccgattgtgggcctttgccgattccccccccccccggagttcaccacgccccggggcacggctcggttctgggccccgtttggcgattttagccggcccgggccaccgagggcagggtcgagcacgagcgtgctaattcaagccaagattcttcaaaaggaaaacgatggcacagacacagtcctcagggaatcgaaagtgcttttattgaaatacggaagagaaaaaaggtaagtatatgcatgtggtagcccccggccaaccctgcacgcccaagaggggtgcggggttggcccgagcccaagacatgacacccgaccccccctaggggtagaagcgacgaaggtgttcgatgttccacgggttaggcagctctgtgccgtcgcccgtggccagccgaacggagcccggccgggggacgccaatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgtgcagctcggagggccgcgcgccgccttcgctcctccaaatagtcgaggtcgtctcggcgaagctgatcttgatcagcctcgcaatacatggatacccgaggggacctcagggtgagcttagatgggaggaccgcctccgcgccgtagacgaggaagaaaggcgtttccctggttgctcggcttggcgtggttcggttcgcccagagtaccgctggcagcttctcgatccacgagtcgccgtgcttcctgaggatgttgaaggtcttggttttgagacccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccgaaccgagcagtgatgccccttatgaatttaagcacggagtgcctatcgatcttgatgaccggataagcctcgggccacttagtgaacttgtcgacagcgacatacagatactcgaacccgcccggggccctcctgaacggacccaggatatcgagcccccagacagcaaacggccatgaaagaggtatggtctgcagggcctgggccggctgatgggtttgcctggcgtggaactggcacgccctgcaccgccggaccaggtcgaccgcatcgttgagagccgtcggccaatagaaaccctggcgaaaggcattgccaaccaaggtgcgtgaggcggagtgggctccgcactcgccttcatggacatcggcgagaagctcgacgccttgttcccgaggaatgcacttcaggaggacttcgttagccgcgcgccgatagagggtcccttccaccagcacgtagcgcttggagatgcgccggacgcgttcacccccttcgcggtattcgggtagagtcttatctgcgaggtatgcctggatctcagtgatccaagcaatcaatctaggggagttgggagcgctcccctcgggtcccgaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccatctgggcacgtgccgaagctctatcccgtcgaaatggcgctccatacgccgcacctggcgcacgtaagcgtccatctgggggtcagagcacgggtactccttacagacctggttaacgaccaactgggagtcgcctaacaccaggaggggggggatccccagtccagctgccactctgagtcccgcaaggagtccctcgtactcggccatattgttggtcgcccgaaagtcgaggcggaccagatatctgaggacgtctccgctcggtgaggtcaacgtgacccccgcaccggcgccctgaagagacagggagccgtcgaactgcatcacccagtaggcggtgtgaggcagctgcgaggagtccgaggtggcctcgggggcggagacgggctcgggagctggggtccactccgccacaaagtcggcgagggcctggctcttgatcgcgcggcgtggttcaaagcgcaaatcgaattcagagagttcgattgcccatctcaccacccgtccagtaccctctcggttatgcaagatttgcccgagggggtaagacgtaaccaccgtgacccaatgcgcctggaaataatggcgcaacttcctcgaagccatcagaatagcgtagagcatcttctgggcctgagggtatcgggtcttggcgtcccggagggcctcgctaacgaagtagacgggccgctgcacctttcggcggggccgatcctcttcgccaggggccgcatctcgagggcgctctttgtccgagaggccacgcggggcgcactcggcttctgtgccgacgacctcggggtcagagggcgacaggcgcggccttcccgcagtggccccggggccatcctgggggttgggggcgcctggcaccgtcggacaagcaggcggagggccagctccggccgtcgggggcctcgggccgccgttcggctcgggggcctctcttccctgctctctcccgggtcgagtcgacacagggtggggatgcgcggagtgagggttgtcctcgtcgcgctccacgatcaacgccgcgctgaccacatgcggggttgccgccaggtagagtagcaacggctcatctggctccgggacgaccaagactgggggagaactgaggtacgccttcaactgagtgaaggcccgctcagcctcctccgtccaggtaaacggcccggagcgtttgaggagcttaaataggggtagcgccttctctcccagcctcgatatgaaccgacttagggtagccatgtagccggtgacgtattgcacatccctaagcttgctgggggggcgcatccgctctatagctcgtatcttctcggggttggcctcgatgcctcgggcagagaccaagaacccgagaagcttgcccgcaggcacgccgaacacgcacttgtcggggttcagctttatgcgggcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattcttgttaaggtcggtgtagtcgatgcacatccgaagcttgccgttcgccttgggaacgacgaccgggttcgccagccactccggatggatgacctcacgtatgaatccggcctccagaagtcgcgccacctcctcgcggatgaaggcttgacgttccggggcctgccgccacactttctgccggaccggccttgcgcccggccgcacggcgagacggtgctcaatcacctccctggggaccccgggcatgtccgccggtctccaggcgaagacgtcggcatttgcccgcaggaaggagacgagcgcgtcttcctatttatcgtccagaagaccaccgattcgtgtggtcttggacgggccgtcgcccagggcaacctccttgaccgggacctcgtcgcacgtgaccatccgctgcctcggggcggcggggacggaggtgccgagcctttcgtcgccacccgtgggcttggacgccgcggcgaggtggtacgcgcgctgctccatacaagcaagtgcgactttgaggtcgccatggacggtgatggggccaccggggcccggcatcttcatctggagataagcgtagtggaccgctgccatgaacttcaccaatgcaggcctccccaggaccgcgttgtagggcagactgaggtccgccacatcgaagtccacccgctccatgcggaagttggcggagccaccgaaggtgaccgggaggtcgatatgacccagcggccaggtgtgccccggcgtcacaccgatgatcggctgagacggccggagcaccatccccggggccttgatggcgtcaaaggctgcaggggaaaggatgttgagggctgcacccccgtctatgaggacacaccccaacttcacattgcaaacggtgggggaaaccaccatcgcgatctgtcctccccgggcaacgcatggcgggtggtcggtctggtcgaaggtgagggcaacctccgaccaccacgcccgccgcgtcgcctcatgggtaggggccgcggccagaagctctcgcttcatggccttgaggcttcggcgagaagcgtgagcgcacgctcccccatcgacggtggcgatggtggcctcaggctcctagaaccccaggtcatagtcgccatcgtcaatatcctcgccgggggccttctgcttggcctcacctcgccggttgccggcgggagccgctggggccttgccctcacggcgctcctgcctcttctcctcctcccacttcctcgtccgctcagccaaacttttgaccgcgcggcagtccgcgaggtcgtggagggaggtgttgtgcacggtgcaccacttgccggtcgggcgctccctgctgggagcgccggcctccttctttttgtcgctcgcaggcctcccctttcggggggcccgcgaagcgccctcgacggcgagtacatgaccctcgtcgtcggaacgggccgacttcttctttctcctcctgtcccgccgccctgaccgagcggcggactcgggggcggccggagctgccacgccagagccggaggagttccaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtaccctcgctgttccgcatgcaagtccgctttttcgcctgggcgcggatatgtgccctgaaagttcgtggtgaactgctggcacaaatcctcccaggagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacgggggccggcccccgtgcccggaccgaagtggcgctccggacgagaaagcgccctccgttgcgtgggcggcgcgacgatcgtcgcgctggcgctcgatatcgagccgggcatccgaccccccacgctcatcttcttgggtcggaggcgttgacgagggaatggcggacgaacggcgggtgacggccgccgctcgccgcgccctccgccttgacgacgtggagccggcggcggcagcgccagaggcctcgggggcggagggccgcccaccggcgcctaggcgctgctgcgccgtcatgaccaagtcggccacgtcatccagccaacgtcgggctggagtctctggatcggggacgacgggcgggtgacgcaagagcgcacccgcagcctggagcgcgccctggggcgtgctgccatcgccgtagtcgaggcggcgacgcgccccgtctcgccgtcctcccccgtcgcccgcgggcggcgatgtcgcggatcctccgacctccccgagcgcctccccccgcccaagatttcggcgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttcgaaaaacacgcgcgccccctacctggcgcgccagatgacggagcgtggggcccctcaccggaagaccgcgcaggcccccctttgccggttcggccgagggcgctatgtgaggttcttcgccctcgatcagaggaatgtcagcgagaaggatcgcacaagacgcgggcgacgtagacatgttcgggctgctgagaagcgtaataccctactcctgtgttctggtggatctgtatgtgaaggaatacagagagctcgagagccagagagagttcaggctcctcctcaaaaatcccccaagaaaatccccttcttctaggcctgggcc

SEQ ID NO: 57975 - DNA, 6121 bp, Oryza sativa
cccgacccctcggggagacagagggaggggtggccgcgtcaccctcgggcccgaccccccccccccgagggggtcaggccacgtgggcgaccgcggctacccaagcctctagtcacgatacccccggtcccatgtcaccgacagggccaattgcttatctaagcattggaggtaacaaatatggtctcgttattgttgatgacttcacgtgggtgttcttcttgcatgacaagagtgagacacaagcaatcttcaagaagtttgcaagaagagcccaaaacgagttcgacctcaagatcaagaacattcgaaccgacaacggcaaggagttcaagaacacgtgcatcgagagtttccttgatgaagaaggcatcaagcacgagttcttggctccatattcacctcaacaaaatggagtagccgagaggaagaataggactctcatcgagatggcgaggaccatgttggatgagtacaagacatcggactgtttttgggccgaagccgtcaacaccgcatgccacgccatcaaccgcctctatcttcaccgccttcttaagaagactccctatgagcttcttaccggtaacaaaccaaatgtctcttactttcgtgttttcggtagtaagtgctacattcttaataagaaggctagatcctcaaagtttgctcctaaagttgatgaggggttcttgcttgggcatgggtcaaatgaatgcgcataccgcgttttcaacaacacctccggtattgttgagatcgcgcgtgatgtgacatttgacgaaactaacggctctcaagtagagcaagtcgactcacatgtgttaggtgaagaggaggaccctagcgaagcaatcaaaagattggctcttggagacgtgcgtcctagggagccacaacaaggggcctcttcctcaacacaagtagagccacctacattaacccaagccgacaatccctccacttcaagcttggatcaaggtgaagaaggcgagcaagtgccaccctctccgataaatctagctcacccaagaatccaccaaagtatccaacgagatcaccccaccgacaacatcttaggagacatcaacaagggagtatccactcattctcgtattgcaaatttttgtgagcattactcgtttgtgtcttctattgaacctctaagggtggaagaagctcttaatgatccggattgggtgatggcgatgcaagaggagttgaacaatttcacccagaatgaagtgtggactttggtggagcgaccttggcaaaatgtgattggcacaaagtggatcttccgcaataagcaagacgaggccggggtcgtaataaggaacaaggcgaggttagtggcgcaagggtttacccaaatcgaaggattagattttggtgaaacttttgcgccaatagctagacttgagtcaattcgcatattgcttgcttttgctactaacctcaattttaagctatatcaaatggatgttaaaagcgccttcctcaacgggcccatcaacgagttggtatacgtggagcaaccaccgggcttcgaggatccgaagtatcccaaccacgtgtacaagctccacaaggcactctacgggcttaagcaagcccctagagcttggtatgagtgtcttcacaattttcttgtgaaaaacggctttgagatcgggaaagccgattcaactctttttactaaaagacatgataatgatatttttgtgtgccaaatatatgtcgatgacattatatttggttctactaacaagtcttttagtgaagagtttagtaggatgatgaccaaacgttttgagatgtccatgatgggtgaattaaagttcttcctcggccttcaaatcaagcaactcaaggaaggaaccttcatttgccaaacaaagtatttgaaggacatgctcaagaagtttggaatggagaatgcgaagccaatccacactcccatgccatcaaatggccacctcgacctcaacgagcaaggtaaagacgttgaccaaaaggtataccgttccatcattggctcacttatttacctttgtgcatctaagcccgatattatgcttagtgtgtgcatgtgtgcaagatttcaagccgctccgaaggagtgtcaccttgtggccgtgaagagaattcttagatatttagtgcacacacctaatcttggtctttggtatcctaagggagcgaggtttgatctcattggttatgccgatgcggattatgccgggtgcacagcggatatgaaaagcacatcgggtacttgccaattcttgggtaggtcccttgtttcttggtcttccaagaagcaaaactccgtcgccccatccaccgtcgaagcggaatacgtttcgacggggagttgttgtgctcaacttctttggatgaagcaaaccttgagagactatggcctaaatgtgtccaaaatcccactcttatgtgacaatgagagcgccattaagttagccaataaccccatccaacattcccgaaccaagcatatagatattcgccaccatttcttgagagaccattccacaagaggcaacatagacatccaacatgtgagaaccgacaaacaattggcggatatcttcaccaagcctctagatgaagctaggttttgtgagttgagaagtgagctaaatatcttggattctcggaatgtggcttgatcttttgcacgcatgtgtttttcattcactagaataggtttgcttgccatatcatgacaaagtgaacattcaattcatgaataaacactagtcataatctatgtggataacttgaaatctatgtgtacggggatctcattctctaatgaatcttggtccttgcacaatttgctatagattcgtacattccctctctcgagggtgcctagttttctttcttttgctgcatttgtccaagtaatagtctagccatcgagttcatcctatcaaaatgttgttgaaaaaaatcttccttgagccatcctttattgtctctgccacaaaggatgtcggactgtctgacatcaagtcagactatccgactacaatcggacagtccgatttcaaatcggactatccgacgtggggccaagggcaaggggacttaacctccccgggggtaactctttcttaccccttcagtcatttgtctcagtcgtttctctctccacccctcttctccactccaaaccctagttctaggccaccaaaaatcttcgtttcggagtctccgattgctattccttcactttagggtggtttccctccctcaactccttccaaatcactggttccccagtgattctcttagtggttcttgaggtatttccttgttttccctcgatctccctcatggtgtattatttcaagatttccttcggtgaatcttcttgttttagtgcctagatctagtacctagaagatcctttgattccattggatatgtttgtgtgaatcgagatttgttggtctagggcaaaaggccgtcggattgtctgatatgctgtcggatagtccgatgtacaccggatagtccgacgtcaaatcagactatccgacctccttttggcccagtccaaatttctccttgcttcacatttaaatattcttcttccacttcttcttaatcattatcctctgttctaaatcagtgtatcctcatgatcacgggtcagttcaagaatcaagtttactctcgccgtgggacaatgagttctcgaggtcgctctcccgcttccaaggctcgtcatgctatacggcgtatgtccgaatctcgcaaagatgccattgacgcgcaagctcaagcctctgaccaagcagctcaagtggctaatgtggagcatggtgctcctcttcctcctcgccgcagccgagtcagtggagaaagatcaagtgcacctgctaaaaaagtaaggagaggcaatcctacggattcttctgagccgggtcaaggtagtggttctcatgcaccatcctttgaggaagagattcatttagaagaggacattgccgctcagcaagccgctcaggaagaagggcctttctttatcactgctccctctagagatcctaattatcatcggagagtcataaggtggaaccgcaagtggactgaagtggagaaagagcgtaagaagatctctacaaatttcaacagttgtccactgatcctcggttttggaacctttttcagcaggattactatgagacagtgaatgcacctaagaaggggcctattcttatgcagtgggttgattggaagtatatggaggagttgcatgattcaattattgatgaagtcattgaagcttgtgctcggcaaaacttgaaggaactcatgggcttgcaatacccatggtgcaaagaaatcttcgcacaattctatgccacactttattttgagcccaacaaagaaaagattattcattggatgacagatggcatcatatactccgtgacatatgctaagtttgctgccattttggggtttccgactcgctctcgcaccaatcgtgtcaagattcatgatgagaagcccatggacacaaattctcttcacttcttgtaccaagatgtggactatgagttaggcaccatcaaaggtctccttcccttctatgcctatctcaacaagctcttgcgcaaaactctcaatcccaaggaaggtgatgctagcaacgtccttgcctatacaagaaatttgctttacaagatgaaggctcacccacagctctttgacgcctttgacttcatctttgaagaaatccggcttatctccatgatgcctaagcgaggacttggctatgggccttacattatgaagatgattgagattgtgtccaagaagaagtttcacaaggaggtggcacataccgattaccaagtccgtcccatcaaggttgctgctgtgccggctggacgaaccactcgtgcttcttctcgtgccggtccctccgctaccgtcaccaagccggactccaactcgtccttgaggttcttcaagtccatcttcaacttatgcaagaccatctcagttcggcaagccaaggaacgcagagcaaggaagaaggacactcgacggatcaagaccctccttcgcaacacccatttgccgtgttctcccgatggttctgaggttgaggacagtggggaggatgtgattgaggacccttttgcagctgaggcaagctcctctcgtgcggatcatggcaaggctcctatggaggaagaagaagaggaggaggaaggtgactatgctgaggagtcaagtgaggagggcgaggattctgataaggatgagtgatcctctattttttcccttttggtgccttgttgccaaagggggagaaccacctatcatcaaaaatctctaatctatctcctttcgtgatggctagtcgacccttgggtttttgtgtcttgttatgtgcaattatctattatccatgctcaaatgtgtgaaatatcttgtcattggcatatgcatgaggttatattgtcatttctaatctagtgcatagattgagggggagctctcctatttcatttctagcatatatttagggggagctccaccaaaatcctaatcttttattacttctaagtgtgttgtcattaatcaccaaaaagggggagaatgaaagtgcatctaggacccctcatttattttggtgttaatgacaacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgccgtactattaagagggatgccacatgcatataattggtagaacactagtgctcaaaatcatttatttgaagtgttcctgttttatgtctgtcggactgtccgatgttgatcagactatccgatgctcagactatccgaaatttcacagaactttgctcactgtcttcggtctgagtgttggctaaaaaatatcggactatccgatataaggtcggactatccgatacgtcggactatctgaaatttctcagaacttcactctctattttgaattgcttttt

SEQ ID NO: 57976 - DNA, 3517 bp, Oryza sativa
tttgtggggaaacggagaggaggacgatgcaaagtcgacgacgcagtggcttggcttggcgtggtccagattgacgggaagggagatgatgtcgtggaggcgtcgcttcggtacgcgctccagagcgccgtgggtgcgccggccaccgccgctccggcccccgtccgccgccgccgccgacgatttggcccctgctccggccctcgcccgcccgtccttcaccgctgctgccgctggccctcgtcccactctcgtgaagagaaagagagggggaggatgaaaaaggtagagaagagaggatgacatgtgggccccacatgtcagtgggtcccacaatataatttttttaatgacagatgggacccacagatatttttttaattctaatgccatgtaagcgccacgtgggacgaaaaccgggtcaacattgccacgtcagcaaaaccgccctccgaaaccgccgagggagtccaattgcaccggttacaatagttaggggagtcgtcctacccggttttccagttgaggggtacgaattagattttgcctatatttaagggagtcaaattggactttttcctacgagttttgttgtgacaagcccactgtggaatgacgacccataactgcaacgtgttgatgggccagatatgaaacaactttagcatagttgggccttgttaacacataaatgggcttggatttcggtccatcgtaacatgatgaacgtatggagatggaatccgtatttggccttgttggcttgtcatgggaaaagaaggccagataaacgctatgtgtgggggccctcggaaggaatttccgggccaaaataagcatgattctcaggggaaaattccgaatctaaagtatttaaagaactaaagtttcttgcaatcgagctaggtcacgaaagaaccactgttggatgcagacagcaagcaaaaaatgaaacattagattcatacttctattaaaaaaccagaaaaaaaatttcaaggcacaggagctgccctcaagaaacttctagacttccaacgaggaagtctcaaagctgccaggcacatggtcagccatagaaaaaaaagaatggcacaactcaaattcaaataaaattataaaatgtatttacgaatagtacaaagtactagcatattagatggacttcgatatgctttattttgtttcagtttttaatatatgatgctcttgatttttaaatatatatttgaccaaaattacataattatttttattatttattttattattagaagtactttcagaataacttatatgtatatttcatatttacatggcttttaaataagatgaatagtcaaaagcatgttcaaaagccagcggtgtcgtccgttaaaaactagagggagtatacgcttgattttttttattaatcgctaaagtgttgtgtttatagttgagctcaaaagcatcttttataacattatgttatctaaattatcatttatattccattcagcataaaaaatgccttagaaatacttataatatatatatcgtgatgaaagttcaatatgttgagtgaaaatatagtgatcgagagaagggtgtgtcatatgcaccaacaacaaatacttgaatggttgtatcctaatattgggcaacaaaacgatgtgccactaatttctacttttctaaaataacagtataaaacacttacaagacaacttaggaatatgtacaggttaacacttaggagtgtatattcattgttgcgcaacgcgcgacttagtgattggttaacatgagaacgaagtgaataggaacaggctcgaatacggtaacgaaaatttatcgaaataaaaattccttcatattgtgcttcaaagttcgtcaagtttaattatctaaaaaaaattactgcctcaagtctcaagtctcaacaatcaaccacacatcacaaaacacagccaattaggatgctacctttgatctaaaatatgggcacttgaatggtactcctatagtacctagtataaaagagactcggtattactccctccgtccaaatttaagtgcttccgcgtccaactttaatcgtccgtcttatttaaaattttttttataattagtatttttgttattatgagatgataaaacatgaatatgaatagtactttacttatgacttatgtttttaatttttttcaaaatttttttaaataagatggacaaacgatcaaaattaggtacggaaaaacatagttgcatttaaaatgaaacagagctagtatttcttaacttgaaaatttcaacggtataatagctcccacgtgcggcatctgttatggggcgtacagtgtgtcggtgtgcattttcagatctcggagaaaattttgcttgttgatgatacaagaaattaattacggcactgacgcaattttagctaagtttcttctcccaacttgtgcgtgctagaaaatggacgcatataacgtacataaaggctataaagaagatgtcaaaacagtaacatgagatttattattgattgttgtacgtttgcacagtttggcgtttagaacgtgcagtcgttattggagtttatatgtactctgtcctttcttgagtgagcctaccagagttgtaaatacacaaggaaacaaaacgtacatgtttatttttctttgctttagctaagtactctcgttgtttaatatataatgctattgatcttttaaaatactcgtttgactatttgccttatttaaaaagttatgtaattattatttatttattgtgacttgatttatcatcaaatgtttttttataaaagttaaatattttttatatttgtataagagttttgaataaaacagatgatcaaacatttgtcaaaatgtcaaacgatcttatatattaaaaaacaaagacagtagtatagttgtcatcatctgatcattaactacgtaaagaatcatctttccatgtcatgtccctggtcactttacatcataaccgaagactttgtggaaacaatagtgaatcgtccacttcgtttaaccttttggttataaagctggtcaaatcctacgtcctatctcagctcctctagcctcggtgtcgctggattcaacctgaccccaaggaaataaggtgacattgcgtacttgctaatgaaaaattatgcgcgtacactgctatagatgatgctcatatgtaccgatttaattggaacctatgcctattctcatttgtaggtaccggttcttaacttaaaaccgtccttatagttggatggaccgaccccttacactggtagacccacttaaagataccggtttatttaaaaaaacttgaaaagtttttaatttattggaacataggaatagagatggatcttatacacaacgatagataaaaggagtacgtatggcagtggtgccagtaccatataggtctaaaagagataagtgaatattgtgcgaggggcaactggcaacccatatcagtaacatttttcgaaacaaataat

SEQ ID NO: 57977 - DNA, 4723 bp, Oryza sativa
aatgcgggtgcatgccactactatttcgtcaaattggaaccatgccacaatgtacgccctgcgcgtgctttgccaccgttttagggtaccgtattttcgtatggacgtttatgccctcgtgttcacgtgtgcttagaccagctccggtccggctcgaacagcccggtcgccattcgttccccacaccgaaaccctagcttcttggaggcggcgcaggcgatggcgccggcgcaatcgatggcggcggaaggcggcggagcagggcggcggcgcaggctacggcgacggagggcggcgtcgcagacggcggcgcaggcttcggcggcggagcagggcggcggcgcaggtgaaggcgacggcggagcagggcggcggcggaggctacgccggccgaaggcggtggcgccggagctcctagcgacggcgcaggcgaccggcggcgagtacgacctggcgcgacggcaaggcgacgatggaatcacctccttcctggcgcgacggcaaggcgatgatggaatcaccttcttccatccccacgctgaagtgtgcttgcggtgcctccgccactgtgcagatttcgaacacaccaaggaatcctcgacgctggtggctacaatgcggcaattcggtaagaacttgcttagtttcgttggtttcatttcggtgtcttaattcttagttgtttgcttagggctgttgcttcttatggatatgggaagacctgctgaatgagtatgctgaggagatggttgcgtactgtcacgccggcgagtacgatcatatgcaagaaacaatcgacattcttcgccaatatttagatgatgagaagaatgaaaaagcgaagatttgtgaggtccttgatgcaaaggaaaatgagttgaagtcaacaattgagacactcaaccagtgtaggctggagtgtttagcgatgaagaagcagttggaagaagttaaatttagccgtgctagacttctataccttaccttagtgatcactgtcttatttgcttgcttaatggtaggtagaaattagatgggaaaaaaatggatgtattgtcaacaagtgtattttggattggaaatatggatgtattgtcatgtgtatgtactgtggtgacctatatgaatgaaagagtatgtttcagaagaaagtatgtgtatgcacagtgctgaacaatatgaatgaaagtgtatgtttgagaagaaagtagtgaattgttacaataatagaaccataaaatttgcagattgctgggaaaaattgtcagattcctgtatagaatcagtgccatgcagacaattgtccatcacaaattttcagcaaagagatcattggtgcattccataatttcagtttacagcacagaaatctttacaaaaggagagagcacatgagtacagtaaattttcagcaaaagagatcattgatgcattccataatttcagttttcaggctcaacatatgcatacaacagtatagacatacatgagcaacattactggttcatagcagccttactagcaaaatacttaagagatggggcaggctacattgtcactgcaaataggttactacaagttcacaggcacacgtgcattacaagttcatcacagccattggcaattagcaaaatacttagagaggaggcagctggcattacagtagaagataggtagataggctcctaactactctagttggtggtgcacttgaggatgctaggtctttcctcttctggggagtcttcttcttttttggtgtcttttttttcctaggtgtttttttcttctttggtgcagagcagcttgcttcacttgttgacactcctggatcatttccttgcctgcacacttgtctcttcctacaaaaaagtgagaatttttagaccatatggcaagcatacaagcctgaatcttagtgactacaacatagcacaatatatcaggagtgtaactaacaataattatcaagttgggttttttttatcaagttggagttaaagaacacaaaccgcttgcacaaagactaattaagaatggaagcacaatgacagcaatataccgtttttggggggtgcagtggctgctcatatcatctgcatctacaggttcagctagcttgcatgttttctcaaaatgtccaaatcttttacatctcttgcatttcactctctttcttccaggctcaagaaatccccttattctctgtactctaggcctcccagcacctctcttctgcttagggacatgcaccttgaagcccaaatcaactactggccactgtgtcctatcagtcataggtggtactctgcctgcataagctgtcctgaacatttgcacactataatatgggctcacaaaatcttgtatccttcctccactgctgcatatccaggccaatgcatgcctgcatggcttccctgttatttgccaagccctacaggagcatttttggttgtctaggtcaacaatatgccttctagtcttgttgtcagtatccacaagtgtgacctctgcaaacccatcatcacttctggtaatcttcaccactttaagaagagatgtggcatcattaagctgcttcataacacctggaatgattccatcatccattttcttgccaacatctcttctagtggccatcttctccattattaactctcgtatgctgtcaacaagttcatgaggaagcagtcctttcagatttctgatctgagcattaaagcactcagaaacattgtttgtcagatagtcacatttgctgctttctccaaagccacatctgtaccaaattcttgaatgatgttgctcaagaaactctattgcatctggtttcactgcatatatttgctgcatatggtacttgaaaccctcctcagtgtagctcctagcagctggatacaaatgctcagtgataacagaaccatggtacttctttaggaagttagcatagaggtgcctaatgcattctctatgctcaacatgatcactaaatgcagcactaacagccttttctaaccccttgcatgcatcggttgagataactaacccttcaggacaaccaatagctctattcaattgtttcataaaccacaaccagttgttattagtttccaaatcaaaaattgcatatgatacataaaaaagccagttgtgaccatctacagaggtggctgaagctaactgtccagtgtattttctagtcaacttagttgagtctacacccacatatggcctacacccttgcaaaaagccatctatacatggttttagagctacaaacaaacgcttgaagcacattttatttcctaacttctccaattcaatttcaactatactacctggacacttcctctcaatttcagccttccagttgaaaagcaactgaaaactttcctcatatttaccatgtacctgttctagtgctaacttcatacctgaccatgcctttgaatacttcaacttgatctcatactgttcttgcagcttccctcttgcatccttagcacccttctttggattgttcttcaaccaatcaccaagcctatcagcaacccagccctgtgtagccatcttgccctctcttagtttggtagatgcatatttgtgttcaaagggaagaactgtaatctgcatgacatgacatggtgataaaaagttactaaaactaacactactttcaggagatgaaaaaataaattaactaaaataatacatttataccttaattgttttcttatcatggattagggaagcacgtattctccatggacagccttcagcgcgacaggttgcaatgaatcttgttttatctgtcttcaaatcagcaaactcaaaacctttcttaattgcataatgcctaactgcttttctaaaagatatcatgtcagggaatagagcattcttcactatatttggattctctggatcatgcaacactctaacaacctgagcttcatcagtgacttctacctcaggagcttcaacccctgtggcagcagtctgagaggattgaccactaacccctatggcagcaggctgagaggattggccaccaaactgtcacgtcccaaaacgactctaaaatacatcctctaaattatgcctagaataattaaaatccgtgtgaaagcctccaaaaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaaaccctaaaggtcccctttccctccctccccctcttgggccggctgggcccatctccctccccctctctctcctctccccgcggcccactcggcctctccccgcgcgcgccgctgacgggcaggcccgcccgccaccctcgctgacgggtggggcccacccgtcatccccttcctcccgccgctcatgccgcctcgcccgcgccctagcgccaccgccgccgccgaatccgccgcatcccgtcgtccccgcgtgcaatcaatagggggatttattccccgtgattccctctccctttccccccatttttccctctctctctatcgagttcaaacgggcggacttgcccccgcaaatctcgccggcgccattgatggcggccgacctcccgcgccggtttccttccttccccggccgccctctct

SEQ ID NO: 57978 - DNA, 12494 bp, Oryza sativa
  unsure (1)..(12494): unsure at all n locations
aaaatttaaatgaagaaattcgcaaatattcatttaaagagcatataaacttcaaatggccataacttggccatttgaactcggaattggaccattcaagtctctaatttttcctgaagaagtcaagaacccatttttgtgctttgttcctgcttgttatatggagtttattagagtaaaatccttttcttttccgttggtcgtgtaaacgctgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctgattaattaggcaacattaggtggttttataactctagactttgggaatattctcatcacctggacactatggaatggttggattattgtggaattggatttgcacctccccctctattcaaaaccctcaaaatggttttaggctaggctcgggtgcatggttttgatagtagcacctcggccatataaggaccggtcttcgggcctctgttgcaaagcactaccgtacttctacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctagaggctcagtcctgcctacctgtcccgggggttccggccgtaggtggggttgggtcggtactcttgtctatggctaggatgggttggaaactatgtcacgtcttctgtccgtataccgtggtggtatgtggcacatggttacacgtgaggaagatgtgtcttgtgggtaaagatgtacacctctgatcagagtataatctattcgaatagccgcgcccttggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgcatagctctagaatcgtgtttacaaaatagctttgagcaactaagtgtcttttaatgctgtttactgcaaacccccttgtactcccttgcatttattctgcacttgtgggtgtgtcttgttgagtacggtggttgtactcagtcttgctcaatttttcccaaacccagaagtggagttcctagaagatgaaggctttggtgtctagctcgtgcctgccgtcaagcgcctgtggtcgtcgccctagtcttcccctctttcccgtttgtctttgtgtgtgctgggccttcgccgcccatgtaataaattaactatttacgcttccgcttgataaactctgaaatgtatcaacttttggtgtaccttgcctcctgggacaaggaataatacatgcacgtaaggaacgcccgttgggttaattccggtcgtgacacaaaccctgtggcagcaggctgagaggattggctagaggtgtcaggtggctgagtaggttttggaggcagatacaactgctcatcattaacaccaacatattcttcctaattatcaaacatgtcaggctctctaacatctgcttccactgttgtaggctgtgcagaaccatcattagtagcagcttgtctagaaccatcattgtgggaagggttctcaggtgggatgatagcaatgggctcatgcacacaacacacagaagcaacatccatgctttcctcaagaactgctacaagtaagtggaaactggcctcggttgcatacatctcgaaaatatctggcaaatcagtgtcccctatgagcctaacatcctcacccaaatttttgttaaaataccacactgagggagactggttcgagccccacttaaactcaaccctcaaactttccattaggaaatcaaacgaaaaactctctgaatcgattacccaatgcccagtgcctcctttactgatgattttcctaccatcagcatctactgtcgcatagggttgcaccctaacatcgactgaaaaccaatgcctaccaacgaatgacaaaacaataactcaaatcgcacatacaaagttcaaatcgaaactcaaatcgtaattttatctgcataaagagttcatgggggaaggtactcacggtttggaagcaacccgtacaagggattcgcccaaatacattgccaacgcggtgggggatgcaggcgtaggcccctgcgcactcatcctcccatcggtggaggtcctccccttcggccgtcgtagcctccgccgccgccctgctccgctgccgccctgctccgccgccgccttcgcctgcgccaccgccctgctccggcaccgaagcctgctccgccgccgtcgattgcgccggcgccgtcgcctgcgccgcctccaagaagctagggtttcggtgtggggaacgaatggcgaccgggttgttcgagccggaccggagctggtctaagcacacgtgaacacgagggcagaaacgtccatacgaaaatacggtaccctaaaacggtggcaaagcgcgcgcagggcgtacattatggcatggttccaatttgacgaaacagttgtggcctgcacccggattccggaataggtgtagcatttttttttttgatttgccacaattcgcgtggcatggatccaattaacccttctctatatatacatatcgatgatgaattgaaaaagagaccagatcccaatccttgcaagttcttcaggtaatcacgtgagtgcgcgaccacactacatgagtacactccttgactcgtccgtttgtttcccatgtgcgggtgcctgtcaggccttgccgtcttggagtaaagtaaggtgatggaaatactccctcgtctcaaatagaataatttcccttttttaatgattattaaggagatagcaaaagtacaagtgatgaaaaatgatgataggagataaaataatgtattactcctttcatccgaataaacaaacctaatacaggggtgtgatatgtttgtttattttagaacgaatgggaataatagatgataggtgaggattaagtaaagtaaaaataggtaggtggaggaataaactataaaagagtggataagcgagatataaggctggctcaaattattaccaaaataaacatttctagaattttggtaatgccaaagttttggtgagttggtaatattatcaaattttaataggataggatagatgtattgttaccaaaattatctaggcattaccaatgtttgggaataaattaaatgtatccacgtatttctcaattttaccaaaaagatttaaaataacatcaacctaatagactcataaagtatactccctccgtcccatattaaacgtagttatgagtttccttgtctaactttaatcatctgtcttatttaaaaaattttatgattagtatttttattattatcagatgataaaacattaaaagtactatttttcaaaaaaaataaaataagacgtacaattaaaatttgacaactcatgtttgcgcttgaaatgggagggaggggtgggtacatgggcaataaatgatcatcttcagattataaaatcatctataatttaggataaatttaaaggactagctagtcagctagaccagtcaaatctgtgaatgggaaaaaaaactgtcaaatttgaaggacggctagcccaactagcacctggccagggcagggcgcacgcttctctttaaatgggtatccatagntaaatnaccccccccccccccccccccacagtaggactacgcttctcgcttagcgacgcaacagcaaagcagcgcgcggagagagagaccgatcgagccacaccgccgcgcgccatggcgagcgagagcgagagcaacggccaccaccacgccggcgacgaggcgcgcgcggagaacagcggcgcggggtgcctccacggcggcgacgacggcggcgggacgcccaggacgacgccggagatcaggtacaccaagctgttcatcaacgggcgcttcgtcgacgcggcctccggtacgtacgtacgtgtgtgttagccgcgcgctagctagccgtgggctgtggttatctagctacgtccagcccacctgcgttaattactggaggacttaattgtactctaccaaaacctagtaatgggatccaattcataatcgccgtggttgtcctattgctctcttcgatttatttcctttcttccaaatactagtagggattcaattccttatcgcaatcagtgctgtttcttagagcaagtacaatagcaaactattagtgagctataaatatattttaatgagataaaagataacagagaagagcagcggactacagatctgtagccagctgcagcacggactccaagacacagtatgtgtatgacatgtgggaccaaatatttatagtatcgtaagcaactattgtatgaattgactgttagattgactatatatagatgaattggagctagcagtgggctgtactattaaacttgctcttaatgattctctccataattaattagtaccagccagtttagattaattcttaggccactcccactaaaaaatccattctcattaaatatgaaaaaaataatatgaaaaagatgaaatgggttttatctatatgaaaccatatacatacactgttctcaatatgattggtctctgtatgtgttgcctatgaaaaaaacaattcactatattgctatatttcataagccatactccctcattctgaaaactattggatatggtatttacaagtacaacgaatttggatagtcttctgttcagattcactgtgcttgaaaatatcacctctcatactggtgggtttttatgggacgaagggagcaaaccatatacatcatttttaatatatttgtttctgcatgtgttgcctataaaaatagtttttttaaaaaagaaagtttagtactatattgctaatttttataaccgagaaagtaaattttgaagagttaccgtaaacttgtggtgctcctagcatcgtacggtttgatggcgagatgagatcatgggcagttcgccaaggagtaacacgacaaagaagcatgaacgggcctgcagtttcagtctctaccaacctctggcatctatttttcccatcgtcccgtgttataccatgtgcttcgcgtccccggctagttgctgttttcatctcacatcttttttttgctcaatgattagctagtactccgtactaatagtactaagtagtaaagaactattcaaatcaaatcattagggcattcccaacccaatgactaggatagtgttcatagcattaaataagttgtcacctaggacaaaaaatgatgtggcaagtgaataaatgaggaaagagaagaaaaccatgtcttgtatgagacatagtttctacacaacatctaagacatcatgtgagataaatagcattaaattaaagtatggaatagtggtgtttgcattggaagagtagtgtctagcactagtttcttgatgatgtggagtttatggaaaccatgtctagtgttatggattgggactgcccatatgtggctctagcagtagcacgtttcagatttggaacatttctgaattttcagaagaagataaatgcttccgtactagagatcctattttcttgtgtacttttatacacgtttcgtgctctgaagaaaaatcaaattcggggtttgcctcattaaggtgaagttagtgcacagaaaatcaagaagtcattagaatataattaattaaatttagttattataaatttaaaaaatatatttatttgatatttgtagagtaaattttatatagaaagttttttaatgaaatgtaaaagcatgctaacaaaatccaagacaatatttcaattgactttaacatatctaagataatattttacaaagtagcgaagagttaaaccgaaaaccttaataaaaaaatcaacaactaaaaattccacatatattctacattttacaattttaagtaaatatttactaaatatatatagaggtggtgttttgaaaaactttaaaacaatagtagttcggttatgtgtcacctctggaagcgtatagaagcattgcgatttccaaattattttctttgtgaatagaaaaaaaaccattgtatcgttgggtcgtaagtttgctcagaataattcagaacaaaacatctaccgtgttgaagcctatagccctatgcccctatggagttccatgaaagtatgattcttatcatcagaaactttttgtacgatgggtcaaattctatagcagtccaatctaaaattaaagacttcttgctcttgatgagagtcataaactaaaactaactctcttcatcaaggttatgatacctaggattttatataactttaaccatgaaatgtgaggtttactgaaattttcacttaattttatctttacataatctcatcctgatcatggaaggtcgccgtgctccgtgcttcttctccaggtaagacgttcgagaccagggacccccgcaccggcgacgtgatcgcccgcgtcgccgaaggcgacaaggaggacgtcgacctggcggtgaaggcggcgagggaagcattcgaccacggcgaatggcctcgcatgtcgggatcagtacggtcatcttcttcttcctctcaatcgtgcaaaaaatggctggaaagtgaccgatcaatggcgcatttgtcaaatgcaggagagagggagggtcatggcgaagtacgcggaggtggtggagcggcacgcggatgagctggcggcactggagagccttgacgccggcaagccgctcgccgccgccagggcggtggacgtcggcgagtgcgtcggcatcctgcgctacttcgccggcgccgccgacaagatccacggcgagacgctcaagatgtcgaggcagctccagggttacaccctccgcgagcccctcggcgtcgccggcctcatcgtcccctggaacttcccggccatcatgttcttctccaaagtctcaccggcgctcgccgccggctgcaccgtcgtcgtcaagcccgccgagcagacgcccctcagcgccctgttcctcgcccacctatcaaagcaagtaagaattttttttaaaaaaaaaataagcaagtaagattagtcacacaaacgagaaatgtgattaacattaactaattattaattatagaaaattgacaaataaatttatttatttttttaaagtaccttttatatagaaaattttcatacaaaacataacatttgatagtttggaaaacgtgctaatgaaaatcaagaaagtagctaatccaatcttcaatttagaacaggacgcaaaattgaaaaaagaaaaacgatatagtagtagctctgttcttgcatcaggcattttgtgctgtgtgattgctggtagtctaaaactctgaatatctctgaccttttcggaatgtgatattcaggcaggagtaccggatggggtgatcaacgtggtgacaggattcggcccaacagcgggagctgcaatttcatctcacatggatgttgacgtggtaagatatcatacattcagctgtcaattagcacatgaacattgatcggtttcttacaactttttttttttttgcaggtggctttcacgggatctactgaggttggacggcttataatggaggcctccgcgaagagcaacctgaagccggtggcactcgagctcggcggcaagtcgccgttcatcgtcttcgacgacgccgacctggacaaggccgtcgagctcgccatcggcgggaacttcttcaacaaggtgagcatccgaattggcagagcgccatgcattgccgtgatcttgattgaattgactgatgagagccatagccgtgatctgatcaatctgcagggagaagcctgcgtcgccgggagccgcgtgttcgtgcaggagggcatctacgaccggttcgagcagaagctagcggacaccatgaagagctgggtcgtcggcgaccccttcgatcctcgcgtcaatcaaggaccacaggtgagtgagtctgaaattaaattccgaaaaatctgaatcatcatccatccaacgagcattttttttcttgtgagttccaataattcagtgatgattcaggcctgattaactatctgaaccagagactgatcaccgtactgtgttgccctgctactatgttcatacaggtggacaaggctcagtatgagagggtgctcgggtacatcgagcaaggcaaggcagaaggggcaactgttctcacgggagggaagccctgcggtaagaaagggtactacatcgagcccaccattttcaccaatgtgaaggtaaagataaaaaataaattaacctttagaatttaccacgaacacaccatgtgtcttcacagtcttatctctgatgattcgcttgcgattctgaacgacaggacgacatggtcatcgcgagggaggagatcttcggccccgtcatgtgcctgatgaagttcaagtaaacccagctatatatatggatcgccatcctctctagtcaaataccggtacctttatcactaacttgtggatccagggatcatcggatccacatgtaagtgacaaagttacgtgatttcgatcgcagaggatctgaccatgatatgtcatatcaattcaaaatgtttattatctaagaaactactatagtggtaagagagattaattttgggtgcaggacggtggaggaggcgatcgagagggcgaacgggacgaggtacgggctggcggcggggctggtgacgagggacatcgacgtggcgaaccggatggcgaggtcgatccgggcaggggtggtgtgggtgaactgctacttcgccatggacaggagctgcccgttcggtggccgcaagatgagcgggttcggcaaggacgacagcatgcacgcgctcgacaagttcctcgccgtcaagtccgtcgtcacccccgtccatggctccccctggttctgagttctttctggatctcgtcgccgatcgagtcggccatgcgtatgtacacatgttggtgttgttggatttgctgggtggtggagtatttgtaacggtggaagattattacagagagtcaataagttgcattatccattattttccttgtatatgccagttggtgttctcctcctttttatactacctttggaagccaaaattctcctttttaccttggaagtcaaaacttgccataccaaaatatttgcattttaagcattaatttttggcaacgcttagtttactactaccaatacttccaataccgcacaaataatacacaaatattatttagcataatttagcatagtcatattttgtcaatgtagcaaaccaaacatatttttctgcgtaccaaaaagaaaaaaaaaacataactagtccataatttggcagaattaagtgacaaggcctattgcgagagcagcgatccaccagtggctgtaatcaacatactttaaggctctgttcgaaagtgagggatgaaaacctcacttcctagcatgcaaaacaaaacaacatttaggtattattaattaaatattttaaaataaatttaaaaaatcgattgattaatatgatttttaaaataatttttatatagaatttttttaaaaaaattatatcgtttagcagtttaaaaacgagagatgttggttggaaaagtgaagataaaaactcagccgtgaagcctgttacaaatatgtaagccgaaaaatgctcttctggagttcatccgtttcaagccgagaaaaatgaacgaataaacattggttaattgaacccaccgagttagtgactcgatcaattttacggaccgccaaagctccggacaggtagcagcaacctgagctgtcgatgagacatgaacagggaacaagctaggcaccgcacaacacacaagaagcagagcacaacgattcggccggtaaatttaatttctattagaaattacttcacatacgcctagttagcatcatggattcatggtttccccaaaccaagccaagaacacaaacgaactgtacattcacaacgcggatcaacgcctataactaggaacttagggaggcccggagttgcgaacttgcgattcccaggaagaatcacttggatcaatcaatgaaatatgagcagagaacaaagctagtcacaactagaagcagagcacaacgacgattgaacacaaccggatcgaaaagcgcttcaactaaactatgtgttcacaaatccaacggaaattcaatttctagccatcatcacttcacatgcgtctgagccagttagcatatcatagtttccccccaaaattaagccaagaacacaaacaaactgcacattcacaaacggatcaacgcctaactaggagggatcggaggtgcgattccggccacgaaggattcacttggcgccggcgggcgcggccggcgcgccgaccgccttgccgcggagcttgacctcgagcgcgcgctccatcttggcgagcacggcctggacggggacggccttgccgctctcgtactcctgcaccacctgcgcccgctcgttgatgcgcttggcgagctccgcctggctccaccccttcgccacccgggccttctggatcgcgccgcgcacctccgcgcccacgcgccccagccccgccggctccgtcgactcgtccagcttccgcgcgggcgccgccgcccccgccgccgccttgttcgtgcccgctgccgccttccgcaccgtctccaccggcgcccccgtccgcatcgcctggttcaccgccctcgtcgacttaaggtccgccgccttcggcttcgtccgccgcagcaccaccggctcccagtcctgcgtgatgttgccgctcaacctccccgtcggcattgctctctcccctctcctccctctcttccacgctcttcttgtgtatgtgattttgacgatgaggaggtcggagaaggtggagggatttatagaaaggtgggattcgggaaggttcaagaggctatagggtgttctggaaggttccgggaggggtggttccgttgtttttgggccgttgatttgagttgtatgggggaatcgggtggctgaggatgggctcacgggaacttggttgccacggaaaggatactgggttcaaacaaactgttggcgaccggcccaccaagcccaggaaacttggcggttactcctctactccctccgtcctttaaaaaacgaacctatcaccgaatgtgacatattctaatataataaatctgaacatatgtatatttagattcgtaatactaggatgtgtcatatctgatactagattagttttttatgggacggaggaagtagtgctttgcgattcgtgctcccccaccaagagatgcttcatcaggaaggtttggaaattccgtgaatgaaccgcagaaagtttatagcctgcatcagcatatggtcatgggcacaaatcaggttggttcgctttatagtcaatcagtgacggacgtggaaataaaaacaagatagaagtctagagggatgaaaacagatcagattcggatggatagttgtcatacgatattctatactatattttctaagtggattcgaagccagtgcggatgcggacggattatttctgattcgtatcctaaaccacaataccggatatctcgaccaccaactattaaaaccggtacaatttgactctctttacggttttaaagggcggtttcgatgacgtggcgtctacgtggcggttttgacatggtctttgttccgcgtggcattagaattttaaaatggaaaaactatgaattacaccactgaacaataacggtcgtccgaattaccccccgaaccacaaaaccggacattcttcacccctaactatacaaaccggacgaattacccccctcgaaccaattcagagtggttttgtccaacgtgacgcacacgtagcaatccagtcaacgttttggtaataaaaaaattatgggacccgccggccatactcttctttctctttctctctattctctctctcgctcgctctttcctctcgcggctcgcgcaccacgcacagtgaggacggaacggcgactggtggtcg

SEQ ID NO: 57979 - DNA, 931 bp, Oryza sativa
cgtgtcgtgccgtgctagcacggcctcttcagggacgcagcccaagcacggcccaatggcccgatgggcctattcgtgccgggccggcacaagcacagcccaaaagaaagggagcaggccggctgcgctgagaagaaactccggcggcggcagtgatggcgatgggcgcaggtaggcggcagtggtggcgtgcggcttcgtcgtcccgtcgcggcgacgcggcagtgacggccacgcgcaccctgctcctcctcgtcggctcgtcgcggcgacgtggccgcgtcagtcagcgaacaatcttgccaactgctggtgctggcttgctggttgctgctacctgccaccgatgaggcgatgaagaagagctgctacttgctgctacctgctagcggctagctgcatgcctgcatgggaagttttgaccgtggatgggtgatgggtgaagtgggtcacccgcgaacccacttataggtcgaaataaacaagttcgcgggttagtttagtttataagtgggttttgtgggtagccgcttgcacccttagcgatggctaatgacctcatgctgcactgctgtagcagcctgtaatatgaaatagaggagggaaattttgggatggaaatctgaaaagaggagggaatttttgggagtagggaaaacaatatggtcacactcttcttttttttcgcccagatggctctgcaatactttattacctcgtctaaaaatatgtattgtatttttgttctcacaccgaatgcaaataacctgagatgtaaaaattgagggaaaacaaatttattcagaatagggatgcaaagttgttgcttcgttaaaaaccttacaccctagagtagggttccccggtaagaaaaatagtataacaacttgcttacattattacataaattacattactaattttgattagc

SEQ ID NO: 57980 - DNA, 1708 bp, Oryza sativa
aaccccaaataatgatatcacgtaatctagacaccatgcctaaactaccagatactactctaatatcatcgtcatgacatagagtaattgcataagcaaacattatacccgtaccgatgcatctcccagataagctagcagtataatcagtataacttgaacataatgtaaagttggcattcatatactcggaaagtatttcaataccataaatgtatatagaagagtattctaaatagagtacaaagcttacaaaagagaagagaagagctactagagccatacccgaactcttccgaaagcttacggactctgatttctactctattcctattccactagcttgaaaacactaaactaaattgagagaatatgagagagcttttgcttaaggtgtgtattgaaatggagagagtaagaggggtttatatagcctcccaatgatggttgtgacggttggaatggtcggaaatatcctccaaccgtcattgggagccaatctacatcgtctagaagaagctctgcatccaacgacgatgaggggggttcggccgaaacaagggccggcccaaccagcccataatttggctagtagcctcctggacttctccactccacagacttctgaactttggcccaattagccgtgtcatttctgagttcttagcccgttcattgataagtctaattctcgacatcgtccgattgatcgatcgtctgaattgatgtcgattctcctccatttaatgattattctctacaaaaggttagtgaacctaatactagtggaatattattattctaacatggatatgcattacaagcaaaactagttctcctctatttcggtaatattgacggaagaaactgatcgctaatgaccatcaacagcagcataggcagcattgctggcgcgtcctcctggaggcctccagttcgacgtctttgtgggttatgaagggtgggaccatggcgatgatggtgtgggtggggaggatgctgtcattgcgggcggtggtagcggcggtggtagtggaggctgttggtatttcttaacgacattactagaaatataatttccagcaatgccgcagaaatacttctggtatattatggttagagagttcatccgcaagcgcacggatataccattgtagcatttcacccgagagtattccaagggtatcatatttattttatcccgtgaaaagatcatgtagagagaactcaactaataatttatatattacttgtgataatcatattctaagcaggggttaagataatccaagggtagagtgacacacaagcattaactactcattctcataatatattatctaagctaagtggaaagaaagagaaagaaaatctatttctatacttctaatatacatattatacatatattctagttaaccgatatactagctaatactccctccattccataatgatcagcgcataacgaaagtagagatattccgatttgatcagcgtattaacactggtagcatgtgcatgtcggatggattaactagttatcacagagatcgagttggccatgcgatttttgagctgcatgcagcacggaacatcccttgcatgtgcaatcatgcagcggcagtaacgtcgtttcgtttctccaagccgattaatatggagattaattacaaggattaaatagaaaatgggtagtgggtctctc
